United States Patent 11,583,558 (METHODS AND COMPOSITIONS FOR TREATMENT OF MICROBIOME-ASSOCIATED DISORDERS) - sequence listing, part 3

SEQ ID NO: 6 - DNA, 2400314 bp, Bifidobacterium longum WBS-01
attcagcacgctgcccggcatggccttcaacagctcactggcatcatccggcaaagctgtggcgtcgatggtcggcttggtcggctcggatgattcggttttctgctggctgtttgggtggtagtggaggtgccatcattcttctggatggcccaacccggccacacaaaggcgcgaaagcactgccaggataatcacaacagctgcggcaaccaccacttgcaatcaacttgccatgggattgcgtggtcgaggagttctcactattagtcatgccccgattctctcacagccgcgtgacgctagcggccgtaattttatcgttgtgcgcaagccgcgtgaaactcttgtgaacggtaaatttaccgtccgctggtgtttgggttagggtgagaccatggcgaaatcaagtgtgcagtatgtatgttccgaatgcggttggaacgggccgaagtggtacggcgttgccccgagtgtggtcagtggggcacggtcgaggaatttcacgaggctcggccggcggcaggctctcgcacggccgctcccggccgaacatcagcacgcagtcggttacggttgccaacaacgccagatctgcagcccgtccgattaccgaagtgggcacggaaagcgtcgagcggctcggtaccgggttttccgaattcgaccgtgtgctcggcggtgcgtggtgccgggttcagtaacgctgatagcgggcgaaccgggtatcggcaagtcgacattgctgttgcagacggccggcaatatcgcgcgcgttgtggcgggagacagtacgttccgaggggcaggtcagcggtctgcccaacagtcgggccgggcgcagggcaacgcatcgaacacggtgccgatgcggggcaacgcatcatcaacacacgccaacaccgtgctgtacatttccggcgaggaatcacaggcgcaggttcgtttgcgcgcttcccgcatcaatgcggtggagccgaacttgttactggcctccaccaccgacctgtccacagtattggggctgatcgaacagaacaagccggccttggccattgtggattcggcgcagaccatcgtctcgcaggaggtcgatggcatttccggcggttcgactcaggtgcgcgaagtggcaagcgcgctgatagataccgctaagacacttgacattccagtatttctggttggtcatgtgaccaaggatggttcgattgcaggcccgcgcacattggagcatctggtcgatgtggtctgccaattcgaaggcgacagcgagactgcgctgagaatgctgcgagcggtgaagaatcgttttggcccgaccgatgaagtcggctgtttcgacatgagcggtgaaggcatcgaagaggtcaccgatcccgccggattgttcctgtctggagacggccctgatgcggccaacgcggcacccgtggaaggcacctgcgtgacgttcacattggatgggcatcgcagtctgcctatcgaagtacaggctctggtcaccacgtcggtgctgcccacaccccgtcgtgcggtcaatggcgtggaccccagccgtatcgccatgctggtcgcggtgctctaccgtcacagcaagctcaacctgctgtccaacgacctgtatatctccactattgccgggggccaggccaaggagcccggttccgacttggcgatagtggcggcactggcgagcgccgccacgtcaaaacccattgcgcgagccacgtgcgccattggtgagatttccctgaccggtcaggtgcgcccggtaccgcgtatggaatatcgccttcgcgaggccgcacgcctcggcttcaccacggcggtcattccgccactgcgcaagccggtgcatgtcgagggacttcagctggtggagtccaacacattgtccgacgcattagacgccttgggagtgcgtaaatagccctgagatatgcctcaggcggtaagacgcttggtctcctcgacgttgcgcttgagttcgtcgacgagttggtcggggccatcaaacttgacctgcgggcgcaggaagccgacgaattcgacgcgaaccttgtggtcgtacaggtcgatccattcttcagtgatgcagtaggcctccaccacacgttcgttgagccctgttttctcgctgaaggtgggtttggtgccaatggagatggcggcgggccaacggttttcaccatctaccagccaaccggcatagacgccgtcgaccggaatgtagcctgcaatgtcggagccaagattggcggtggggaatccgatggtgcggccacgctcctcaccgtgcaccacttcgccctcgatggagtgcggagcacccagaatggcgttggcgtcctggattcggccatgagccagcaggtagcgcacattggtggagctccatgcgcgcattgccttggcctggttcttcttgctccatgcgcggcgctcggccttggtggcattggccagcgggtcgacgggctctccccattcgctcggggcttccggcttgaaatcgcgcggaatacgcacttcacccgggccacggtcatcgaccacatcaagttcgaatacaccggtggcggcggcaagattggcgatatgcttcacatcaccttctcgacccttgcccatggcggcatcctgcccaaggaccaacgtgcgcatacccagcttgccggtgagtcggccaaggaagaaaatgtatgacatagctgcgaaggccagcgtgtagtgcaccaccagcacgtggtccacgccgaactgttccatgcggtgcagtcgatcatccacactggtcaaggcttcggcatccacgttctgcaccgcgggttcttcgccatggtgcgagatgacccagccgtgcacgaatgcggggcgcggatcaaacagaatcaccacggaaaaagcatcatgctggtgcgcgagttccaccacacgcttgatcaccgcctgatgacccaagtgcatgccatcaaatgcgcccaatgtcaccacggccttcttatcgttactgaacgagggccattcaatcgaaccttcggcgtcaggggtcaggtgcgtgatatccatcagtgtgctgttccttttatccgtgcgatgttattcatgcaatatagacgttgttgtgcgcggcctgtatcaagctgcacttttcaccgcgtctactttacgcgagggggaatacggtgaccggcttggcctgatgagcgtttgcacgctcgataatcgccgccacatcatgcgtttgcggcacaatggcggcagtgggctcgctgattgtacgctcaatacggcggccgaagcgtaattcgctggcctcctcaggagtgatgtcaagcgccggcatcgcacctcgagcggcctgttccatggtaagggcatggtcaagcagccagttgcggcgctcgtcaccggcaagaccttcaggagtgtccaatacgcacttgttgcgcgtgacggtttgcccttcccgattagtgaacgtcttctgatcggtatgtgcggtgacggtatgggttcgcgtgtcaagcatcgcctcaggagcgataagtccgctggcatcgtccggcaacgcgaatcggccgactcgcgtacggcgcaaacgggtcaggtatccgccgacgccaagttctttgccgagatcgcgggcgagcgcgcggatataggtgcccgatgaacagctgatccgcacgtcaacatcaagtgcgggaatcgctcccgtgttcgcgtcttcccgcaatggttcagcggcctgctcccctgctacgaatccgctgcggatatccagcacggtgaattcgctgatggtgaccgggcggggtttgagttccacatccttgccttcgcgagccaagtcgtaggcacgctggccgttgattttgatggcggagaacgtattggggacttgttcgatatcgccggtgaaattggtggcgatggtgcgtgtgagcaggtcttgccatgaggcagttggtaacgccgttggttcgccgctctggccaccctcagtcagctgcgctgatagcgtttgccagcgggagcgggcttcgtcatcgacaagcacctcgccttcggcatcgtcggtagtggtgcgcaggccgaggcgtatggtagcctcgtaggttttgtcatgcgccacgatggcgttgagcagtcgtgtggcgtggccgaaggcgatgaccagcgtgccagtggccatggggtcaagggtgccggcgtgaccgaccttcttgatgtgcaacgcgccgcgcacggcggcgacggcgtcgaaactggtcacgccttgcggcttgtcgatgatgagcagaccgctgggggttgtatgaagcacactactcctcgtcagagtcgtcttcgaagtcgtcgctgggctcgtcgtcatgcttgtacggatcggcgtcgccggcgtactgggcggtggcgcgagcacgggcgagttcttcgtcacgcttcttggccacggcgagaatgtcttcgatctcgtgagcctcgccgggcacttcatcgaacacgaattggagctgcggagtcagacgcaggccagccttgtggcccaccagagaacgcaggtggcccttggcctgatcgagtgcctgctgggcgcgcttgcgttcgccttcctcgtggccttcgtggccgagctgggtccagtagaccttggcgatctgcaaatcgttggtcacacgaacttcggtgacggtgatgctggcgagtcgcttgtcatgcagttcgcgctcaatggaggaggcgacgacacgctgaatcaaggccgcaatacgtgcggcgcgcgggttggttcctgccataggaatttccttttctagacttgagccccctctgacgaggggctgccgaacgcagtgaggctgggggagagaaaatcatggaactaccatgtctctccccagtcagtctgcggctgacagcccctcgtcagagggggcttaacaatgactacttgcgctcgacttcccgcatctcgaaggtctcgatgatgtcgccgagttcaatgtcgttgaaggtgccgaggttgataccagcctcgtagccttccttgacggactgaacgtcgtccttgaagcgacgcagcgaggagatctcgaggtcgttgaccgtggccacgccgttgcgcaggatacggcacttcgtaccacgcttgacctcgccgtcctgcaccataacgccggcgatgttgccgaacttggaggagcggaagatctcgcggatctcggagtgagaggtgacgacctcttcgtattccggcttgagcatgcccttgagggatgcctcgatgtcttcgatcgcacggtagatgaccgagtagtacttgatctccacgccctcgcgctcggcgaggtccgcgacctgacggttcggacgcacgttgaaaccgatgataacggccttgtcgaccgtggccaggttgacatcattctgggtgatcgcaccgacgccgcggtggatgacctggatgccgacctcgtcggatacctcgatcttcatcaaggaatcctcgagcgcctcgacagaaccggacgaatcgcccttgatgacaatattgagcatgtcgatctcggactcggcgaacttcttcttgaagtcctcgagggagacgaccttgcgacgcttggccagctgggcggcacgctcggtggcctgacgcttctcggcaatctggcgagcggcacgatcatcggaggcgaccaggaagaggtcaccggcggtgggcacggaggtcaagcccagcacctgaacaggtgtggacggaccggccgcttccatcggctgaccgttctcgtcgagcatggcacgcacgcggccgtacgaagtgccggccacgatggcatcgcccacgtggagcgtaccctgctgaaccagcacagtggccacggcaccacgacccttgtcgagtcgggcttcgacggtggcaccacgggcgtccatgtcggggttggcgcggaggtccagctcagcgtcagccgtgagcagcacggcttcgagcagcttgtcgacgtgcaggttctgcttggcggagatgtcgacgaacatggtgtcgccaccatactcttcagggaccaagccgaactcggtgagctggccgcggaccttctccgggttggcaccgggcacatcgatcttgttgacggccacgacgatcggcaccttggcggcctgagcgtggttgatggcctcaacggtctggggcatcacaccatcgtcggcggcgaccacgaggatcgcgacgtcagtgagctcggcaccacgggcacgcatggcggtgaacgcctcgtggccaggggtatcgaggaaggtgatcttgcgcggttcgccttcaaggttcacggtgacctggtaggcaccgatgcgctgggtaatgccgccggcctcacgtgcgatgacgttggtcttgcggatggtatccagcagtcgtgtcttaccgtggtcgacgtggcccatgacggtaacgaccggcgggcgaggcttgagatcctcgtcatcctgcagttcttcctcgtcaaggttgatgtcgaactgctggagcagttccttgtcttcctcttctgcggagacgagctggatgttccagccgatctcttcgcccagaatctggaaggtctcctcatccaaggactgggtggcggtagccatctgacccaggtggaagagcacggtgaccagcgcggcctggttgacgttgatcttctccgcaagatcggccagggacgcgccctgacgcagacggatggtctggccgttgccgttggggatgcgaacgccgccgatggtcggtgctttcagctcctcatactcatggcgctttgccagacggttcttacgggcctttgaagacttgccgccctgacgtccgaatgcgcctgcggcaccgccgcgaccgccgcgaccgccgccacgtgcgggaccgttgctcggtgcaccgccgccctggaagttattgccgccgccttggccccacggaagccgccgcgtgcgccgccctgaccggcaccctgggagccgccgccctgacccggacggttgtggccccactggccgggacgcggaccgccctgaccaccttggcccggacgaccgccacggaagccgcggccctgcccctggccttggccgggacggcccggacgaccgccacgaccgttatcagcagtcggacgagccatcggatgcggacgcggaatatcacccggcgtcggggtgtgcataccctgcttgcgggagaacgggttgttgcccgggcgcgggccctgagcgtgcgggcgcggaatcgcatttgaagcggcattgccgccattggcaccggcgccgccctgagcgtgcgggcgcggagccgaagcattgccgcggttgttctgatgctgaaccggctggccattgttcggacggccctggttgttacgacgatcgttgttacggcgatcgttcgggcgactctgacgaccgttctcacggccttcgcgattatcgcgaccattctcacggttgtcgttctgaccgtggcggccgggggtcggcatgccggggcgtgcgccgccctgcggacgcggtgtcggtgcacccggagtcggagcctgctgatgtgccgaggcaggcgatgcctgacgtgcgggagcggccggagtcggtgcggaagatgaagtggaagccggggccgaaggtgcggccgggcggcgctgctgcacgggcttggaatcgcccttggcgttgtccttggcgaactctgccttcagacgccgggctaccggcggttcaatcgtagaagaagcggacttgacgaattctcccatgtccttaagcttctcaagcacggttttgctatcgacattcaaaaccttagccagttcgtatacgcgtggtttcgccactaattactcctattctgtgaccacgcgcgtgcatgggcgtggtcagttggtgatgacggcaagcctaccctgtctcatcgtgcgaccatgatcgtgttacctcgtctctggtgtgggcgatttcgcgcacactgcgccagcccacatacgccaatcaagcatactcatagcgctggatagcgtagacgcagcgagccgcgccattgctgacgcggctcgtatcaggaaataatgcgccctgaagatcattcgccttcgagcccggcggcctattcggcttccggagcagcagcctcggccgcagcctgggcggccttttcggcggcgactttcttggcatgggcctcggcggattcgatgccgatcttccagccggtcagcttggctgccagtcgtgcgttctggccttccttgccgatggccaaggacagctggtcgtcgtggatgaaggcgatggcggtcttgttcttctcgctgatcacctgcacgccggtggccacagccggggacagcgcggctgccacgaacttggccggatcgtcggagtagtcgacgatgtcgatcttctccgggccaaggttctccataacggcacgcacgcgagcgccgccggggccgatcagcgcgcccttcgggttcacgccatcggtgttggccttgaccgcgatcttggtgcgggcgccggcctcacgagcgatggccatgatggacacggcaccggagaccagttccggcacttcgcgctcgaacagcttgcggaccagctccgggtgggagcgggacaccacgatttccgggcccttgatgccacgggccacgttcaccacgtacacgcggatgcgttcgccgtggcggtaacgttcgccgggcacctgctcacggcgaggcagaatggcttcgacatcgcccatcgcgacatgcacgttggaggggtcggaagcatcctgctggatgatgccggtgatgagcttgcccttctggccggagaacgcaccgaataccttctcatcttcggcgcggcggaacagctgggtgatgacctggcgtgcggtggctgcggcgagacggccgaagtcacgcggggtgtcatcgtattcctcgcccagcttgggaacggggtaagggttgtcttcggtgggttcgaccggaatttcgtcggcggcccacacggtgaagttgccggaacgttcgtcaagctccacgcgcgcgtgcttggcggcgtgcggggtcttgaggtaggcgaggcgcagggcctctgccagcgcatcatccagggtttcggggtcgattccttgctcggcggcgagcttgtgtattcctgtcaggtccagttccatcgatccgtacctcctatgaagttatgtggcgcatggcctatgagtagtcacagttagctattagtgtatgtttccatgcagacacgcttctcttcaggacggtttacccggcgcttggcatccgtactatgcgcgagcgcgatgctgtgttcgctttcggcgtgttcgatgccgcgactggccggacgggccgaggcggaagctcaaatgaccccttgcgagaaagcgatgacgttggcgaactacgccacccatccggctgaaggcacaccgttattagagcagtatgccaccggtctggccgccccctggcttggattgacgttgccgggtattgttcgggtcgttttgccgagggaacgttacgtgacgcgcagaccaagcaatggatggcttttctggccgataaattcgggcagtccgcgcctgaggtgacgccggcgcgtcttgatggcgtcacgtccgccaacgttgaccgatcggtattggatgcgatggccgtggccgaggatcgcgccggattcgctatcgaggtcttggccgcacgaggacagaccgctggggctacgttggcgttgagtgatatgcataagaccgccgggcagcagttggttgcgctggcgaacggcaattttgatgattccggcgcacaatccagttcttccggccaaagcgacccccgccaaaaggtctatgccatcgaccaactactggccaaccccaccaccatcgccgacaaggcaagtggccaaaccgtaccgaccgccgccgccatcgaaatggactgcgcccgcgcgcagatcaaggccgtgaccgaatcgaaatcttccaccgagagcgatatgctgctcatcctcgccgcactggccgccaagcacgcctacaccgcgttccaacttggctacccagcgactgacgccgaattgttcgagtagacacacactcctcacgaagccgatgcgaacttgttggatgctagtgggcaagtcgagttgaggcacgttccaccaatgtgaaatcggtggtgtacgtacgggccgggcctgagtatccttcgatgcggtcgataagcatgtcaacggcatgcttggcataatcatcgatatgaggatcgatggtggtcagcgccggcaccgagtactcggcttccggcacgttatcgaagccgaccacttgtacatcgtcaggtacatgcaaaccacatcgttgcaattcatgaattgcgcctaaagcaatggcatcattgagacacactacaacatccgggcatgggagcttgtctagcatagcttttgtcacgcgcataccttcacgctgattcatgctttctgccggaatcacataccgccaatttaccgataatccgcgctcttcaaatgccttcacatatccttgggcgcgtaacgcctgggtcccttccgtctgacgacgcagcactgcctcatccaccagttcaggaagaacacccatcagagcaaccgtttgggcaccttcatccaaaaatcttcctacaaccgtggagatggattcaatgttgggcatggtgatccaatcgcttttcccgtaggccagatggtctccggtcgttacaatcggatatggctgctccagaacggccccttcatccgcgagcggcgacattacgaacagaatccatccttccgtccctaaacgatagaactcgtcaacgctggcaaccaacccttcaccgtcggaaccatatgtgttgatgactacaccgtaatggcgttcttttgcgtattcaatgaccttgtcagtgaaaaaaggaacgaacggctgcgagaaatcgaagatgttgagtccaataagctttgtgccgccagatcgcattgcacgcgccgaaatattgacggtatatccaagcttacgcatcacctcttccacacggcgacgtgtatccggtctcatactgccagtgtcattcagcacattggaaaccgtcttgatggagacgttcgcctcacgcgccacgtccttgatagttacgcggtttcccattgttcgaatccatttctgcttattacatgacacaccttcaacagcgtcattatgttcttattatggtaagtcacagtcgggtcgagcatctcctcctcatatcggaatcatctacccctcaacctcagaattcagccaaggagctttcctccgttggaccccatgcaccattaggcaaatatccttctgacaatactgcaggacgatcgaacgtagaggttaaactttctggttgaagaaacgcacgcacgccatccgaacaagggactttctgaccgccggctttcaacctagctttttacatacccgtcttttctccttattcctttgttgggtatcgaattgttccagtcgatgtgaatgacggcattgtcttcctttgactggtatgccacattacattagtggcgaatccgaacctctctttctgcaatccgggcatgttgatgattgtttgggtattgcttggtggttgtacagggcacagcaaccataagagactgcgccctgtcatgcgccaccgtcactcgaatcacttcacgtgcacggcggtccaggagaccggcggcaaggtcacacgcacagtgccggtatcggcgtcggacgtgatggtggtgttggggtgcagaacgactcggttctggtcttccagcgtgttttttgccagcagatcatcctcgtgcagggtttgcgcctcgaccgcggaaagtgcgaatccttccggcagcttgatggcaaagtcattggccgcttccatggagcgattgaccacaaacacgctgatcgtaccgtcctcaccacgcacggctacggaattgatcgtcggcacttcaccgtatttgtcggtttcatacgttccggaagccagtttcggttcaagcaccgtgccgcccttggcgagctttgcggtcagcgagaacggatagaacgtggtctgacgccacgccgggccgcccggttcggtcataatcggcgcaattacgttgaccaactgggccaggctggcggcgtgcacgcggtcggcgttcttgagcagggtaatcatcaaatcaccgaacaccacggcgtcggcggcgctgtacacatcctcgagcaggcgcggggcaaccggccaattgccgatgccttccggattcttgctcggctcttcgttgagataccagacattccattcatcgaacgagatgaacacgtcgtgcttgctcttcagccgggccttggttgcatcgatggcggcggcgacatcgttgatgaaaccgtccatatcgacgcccgaggcaaggaagctcttcatgtcacgggtgccatcaggctgaagttccggatggtagtacgcatggcaggagacgaagttgacgttgtcaaacgtcttctcaagtacggtttcttcccacttgccgaaggtgtccatcacgtggctggatgaaccacagaccaccagttcaacgttcggatcgatggcgcgcatacctgccgccaccgaggccgccaaggtgccgtaatcctcggcggacttgtgaccggtctgccacgggccatccatctcattgcccaagcaccacatcttgatgccgaacggctgatcggcaccattggcgcgacgctcctcggagagcttggtgccgccgggaatattcgcgtattccaacaggtcgagggcctcttcaagaccacgggtacccagatttacggcttccatcagctcgttgccgccggttttttccagccatttcgccatttcgtgcagaccaaactgattggtctcggtggaatgccatgccaagtccaggcgacgcggccgctcatcacgaggaccaacgccatcctcccagcgatagccggaaacgaaattgccgccaggatagcgaatcgtggtagcgccgagttccttgaccagttcgatgacgtccttgcggaaaccgtcttcatcggcttcggggtggcccggctcatagatgccgtcgtatacgcagcgacccagatgctccacgaacgacccgaacagtctgtcgttgaccggagctacttcaaagtcattatcgacgacgagtcgagattcctccagctcccccggtttattgtcgtgcgaatgctcggacatgtgctctcctttaatcgttgtcttcaataccgcaagacaacgttgtgctaaataccaaaagcaatcggcccatcttcttggttcacctgttttgcggcatcgccaatcagcggtgaatgtgcgttctggatatttaatacaaccttgtacttctgttgatatcgataatacgatggttgtacttagtacgcaagtcccgctgagtacaacgttatccttttcgctattttccacccgacacgccgtatacgatacagcacaggagcgaatacggacgttcgtatcaaaaacaaaaagggttccgggacaaacccggaaccctaaaggcggataaggcgagattcgaactcgcggaggctttcacctcacacgctttcgaggcgtgctccttagaccgctcggacacttatccatgctgccaaaatggcaacttgttcattatgccacattctgccgacctggcaaatcggagtttcgctgagctcgattcggcgtgggataatgcgattttgtgtgagattgcaatgggtcagacgatgagccgattaacagtccgaattgatcaactaccaaaatccgaatgttgcaacgacgaaaatccgaatattggtggtggtagaagcggtgacggggccactctgcattgagtggtctctccctcggtcagccttacggctgacagctcgaacgcaattaaggacagctttccagctgccattttatttgctcactgtcgttcgccttcgcctaaaaacgcctccggcgttttcttcacggctcagctcatcagagggggcttggaattttatttatgccacctgttcgtggacggaggcgttgacccattgggactgctggacgttgtatccagagaagatgccgatgtcgagcatgcagtcgcggtaatcgcggccgtgggcgatggtgatgtagctgtcgtccaccaatcggttatgcgtgggatccagtccgacccatcggccatcctgatacacctcgacccaagcatgggtcgcgccctctccccaagcaaaccggcaatgtagcgcgcggtcaatcccacatgccggcacacggacagcatcacgtgcgcataatcctggcatacgcccttgcgctgagccaaggcctgttcggcggtggtgcgaatcgtggtggaaccgggcgtatacacaaacgccttgtagacctcatccatcacttcggcagcctgctgcaccggagtggcgtcggaaggcagcgccgccaagcgttcgcggcatacggcaatcatcgcctccacgttcgggccgggaatggtgagcgctgaattgaatcggtacagcggtttataggcttccttatggatatgcgcattgtccacgaaggcgataccggtcaccgagtagctgaatatgtcgtgcggctcagggatgaatccggtcatcaccacggagtcaaaggagtcgatggtggtttcgagttcggtttcgggctgaatcttcacttccacgtcaatcacctgttggcgagggccagtggagggaatacagcgaagctggaacctgtgatcggtgaccggtgcgctgaaggacagcctcatctcatagtcgaacacgagttttttcacaacgtctcctgcacttgcacacgagccggcaaccggcatattctcgggataacgacactacagccatggctgaggtatggtccgtgcgctcacagcccacgcatatattccggcaatctgctgatatgcacaggccggcactcgggcgcacggttttttcgccataccaccatagcatttgaacccgtcagggtgtcaggtcgggatcagggacgcttggcgtccatgttcatggagctcagtgagcccatgtctttgatggccagcgcgctgacacggccggagtagtcgtcaaggtacttcttcagcaggtcggcgacttcctgatatccgcgagacggcagctgaccgaccagccagctcagtccgtcggcgaagcagctgggcagcggcatgccgtccaaggtcatcgaataggcggcgagcttcttgagcggcgcttccagatcctccatcgtcaggccgaagcgcgtgtacaggtcgatgcgttccagatatttgccgatgaagatgaacgccttcagcgtggggtcgaccggcgaattctcgatgccgccccagaaagcgagcatgtcatcggtaatatcgcgctgcttgtagatgtcctcggcatcggccgcgtatttggcggcatcggtgatattggtcatcgccaactccacgtactgcagcagacgcgagctcaattccgggcgcagaatcacggcgttgttgaatgcggaagttacggccgaccgcaccgaatcaggattggacccgtcgtacaggaagctgttcacgaacccgtcgaagtcctcgaaatcttcgggcaggtcgagtgcgtgagcgaacggacggaaggcgtccacatcggtgtccatcacacgatcgtagaacgggaagaactggttcagcgtggtgaaggcgcgctcggtgtatcgacccagccaatacaggttgtctgccttggaagcggtaaccagcgacaacgaatggtggcgggactggctcagcaggttcgccacctgcgtttcggcaccgtactcgtgctccacgccggattcgggtgccaacacccacgtatccttaaatccgccaccctgcgacgagttgacaatcatctggccgggcaccgacgagtatcgagtcaagcccgaataccacacgtgcgtattcttgccggtgaccacgaaggcacgcaaatcgcacttgcgcggcgacatctcgccggtcttcgggtccaccacatcgatatcacggaactgaatcacctcttgggcaatgaatcgacgcggctcctccttgatccggttggcgagctcctcacgtgcggcggcatccagcgacgaaccaaacaccacgccgtaaccgccggcttcggccacatccttgatgaccagctcgcccatccgattcaggacttccttgcggtcggcctcgaacatcggcatgtacgtgggcgcgttgttgagaatcggttcctcgccgagatagtacttgatcatctgcggcacgaagtagtagatggccttgtcatcggccgcgccgttgcccggcgcgttgacgatggccacgttgcccgcgcggtaggcggacaggataccgggcacaccgatcaccgaatcaggattgaaggcgaacgggtcgaggaattcgtcggacaggcggcggtagaccacgcccacacggtggcgtttgccggcgtagtcgaggaagtagaccttgttgtccaccacttcgaggtcctcggggaaggccaacgccgcaccggttttctccgccagataggcgtgctcgaagaacgcggaattgtagcggccgggagtcagtaccacggcgatgccctcggtggagacaaagtccatggctttgcgcaacaggcgcgggtattcgcgattatcgcgaatacgaacgtcgcggaacaggcgcggggagatgcggcgctcgatgtcgcgcacgaacagcgggtagctggcacccgagggaatacgcaggttgtcttccagcacccaccatcgtccgtcctcgccttggaccaggtcctcgccggcgatgtgagcaaaaatgccgccgggaggggtcacgccgttgacctgcgggaagtagccggccgaggtgtatacgtattcctccggcaccacgccgtcatggatgatggccttgtcggagtagatgtccttcagataggcgttcagggcgttgacgcgctgcttcaagcccttctccaattcgtcgtattcgtcggattcgataatgcgcggcacagggtcgtacgggaacagccggtcatggtattcgccgttcttgtagatgccgaaacgcacaccgttgcgggacagctctcgattgatcgcttcgcgacggtttaccagttcatgggccagtctgcgtgctgcggattcgatcatcgtgcctgctccttgctgtggcggcttctgtggcttcaagcggttaggcgttttgagcgcacgctgacgccgcaagccgtaaccgggtttgatggtttcaacctaaggcggacccgtttcaacaaacgcgcgagaatgttacaggcaggtcacttcgccggccgcgtgcatcttgacgaccgcactcatctcgccgaccacacgcatcttgccgaccgcacgcatcttgacgaccgcactcgtctcgccgaccgcactcgttacaatgaatggctatgacacgactgcgcattgacttggcctacgacggcggcggattctatggctgggccaaacagcccaatcttcgtacggtgcaaggcaccattgaagatgcgctgcacaaggtgctgcgggtgccggccgatgacgcggccgaaccgttacgcttgacggtggctggacgcaccgacaccggtgtgcacgcctcccaccaagtggcgcatctggatgtatccgatgaggtactgaatcgctgcgtaggtcacatgaccattccggtcaccgaggcgctgactcgcagactcaaggctgtgctgccttcggacatcgtcattcatggcattgccgtagctccggtcggcttcgatgccaggttctccgcattggagcgcacttatgtgtatcgggtcgccgatcgttcgtctgaggtcgacccgcgcctgcgtggatgcgtacttaccgtggatgaagcgctggatctggagcttatgaaccgcgcagcctcattgaccatcggcctgcacgattttggttccttcgccactccgaatccgggaggcactacgatccgtgaagtcaagaccgcctattggcggcgggtgccgatcactcccctagtaccggatgagatggcatcgcatgaagcatatcggactccgtcgctggagtccggcctggtagtgttcacgattgtggcggacgcctttgcccgcaatatggtgcgctccctggtcggctcatgcatcaaagttggttcgggacgcaaatcactggagtggtttgccggcaaaatggccgagccagtacgtgaaggctcaagcgggccgattgcgccgcagggcctgactttggagcatatcgcatatcccgccgatgatcagctggccgcaagagccgaggccattcgggccgtacgtacgttgtagattctatgaaaacaacgcaaaagggctggaacccaaacggattccagccctttcagctagcttagcgaaacgctattcagctcactcggccttctcggcgtcagcggcttcctcagcgggagcctcagcctcagcggcggcggtctcctcgaccggagcctcaacagcctcagcagcctcagtggcctcagcctcaacggccggagcttcttcttcggcaaccttggcggcggcttcagcttccttcacaacagccttcttggcaaccggctcggtgacgagctcgattacagcggccggagcggcatcgccaacgcgcggagcgatcttgacgatacgggtgtagccaccttcacgctgctccatctgctcggcaatctgggtgaacaggatgtgcaccacggacttgttgcggatgacgcgcatcacgcgacggcgggagtgcagatcaccacgcttggcgaaggtgatcaggcgctctgccagcggacgaaggcgcttggccttcggcagcgtggtggtgatgcggccgttctggaacaggctggtcgccatgtttgccagcatgaggcgctcgtgtgcggggctggaagccagacgcgggcccttcttaggtgtaggcattgggtttactccttatatgtccgttcttcaggcaagcaggtgggcatatgcccgaacatctgcttgcctagtgaacgaacgattggtcaaagaggcagatcactcgtcttccggcgagaagaacgtgccaccttcgagattattggtatcgaaggccatcggcgaggacttgaggctcaggcccaaggtctgcagcttctccttgacctcatcgattgacttcataccgaaattgcggatgtcgagcaggtcctgctcggtgtgggagacaagctcaccgatggtgtggatgccctcgcgcttgaggcagttgtaagaacgctgcgtcaggttgaggtcctcaatcggaacggccatctcggggttggtctcctcggccaccggggccggaccgacctcgacgccttcagcctgggcgttgagctcacggcacaggccgaagagctccaccaaggtggaaccggcggaagccaccgcgtcacgcggggagatggcgggcttggtctccacgtccaggatgagcttgtcgaagtccgtgcgctgttccacacgggtggcctcgaccttgtagctcaccttgagtaccggggagtagatggaatcaaccggaatacggccgatctcatcgttgtcctgcttgttcatctgggcaggaacatagccacggccacgctcgacagtgaactcgatctcgagttcgccatcgtcggcgagggtagcgatgtgctgctccgggttggcaatggtgacgccggccggcggggtgatgtccccagccacggcttcgcccttgccgctcttgcgcagatacatgaccacaggctcgtcgtattcgctggtgagcacgatgcccttgatgttcagcaggatctcggtgacgtcttcctggacacccggcagagtggtgaactcatgcagggcaccggaaatacgcacggaggtcacggcagcacccgggatggagctcagcagcgtgcgacgcagcgagttgccgagcgtgtagccgaagccaggctcgagcggctcgatggtgaagcgggagcgctgcggattcagagattcctcggtaagagtcggacgctgtgcaataagcactgtggttatcctttcagcttgaactcggtggtgcactcaccggtcaggcggttttggatggatttggtattgctgagtgctcagacgcgacgacgcttcggaggacgaacgccgttgtgggcttgcggggtgacgtcggtgatggaaccaacctcgaggcccgcagactgcagggaacggatggcggtttcacgaccggaacccgggcccttgacgaacacgtcgaccttcttgacgccgtgttccatcgccttgcgggcggcggactcggcagccataccagcggcgtacggcgtggacttacgggagcccttgaagccgacatcgccaccggacgcccaggacaccacggcgccggacggatcggtgatcgaaatgatcgtgttgttgaaagtggacttgatgtgagcctggccgaccgggaccgacttgcggtcgcgacgacggggcttacgagcggcttgcttaggcgctgccattgaccctcgtttcctagtaacgaactttgttgttgacgttcgggcgatgggatgaaaatcatcccgtggcccgaatcatgccaccgactacttggtggccttcttctttccggcgaccgtgcgcttcgggcccttgcgggtacgagcattggtcttggtgcgctggccgcgcacaggaagtcccttacggtgacgctggccttggtagcagttgatctgaatcttgcgacgaatatctgcatcgacttcacgacgcaggtcaccctcgatcttgtagttggcttcgaggtagtcacgcagcgtaatcagctgctcgtcggtgagatccttgacgcggatgtccggactaataccggtcgcggcaagcgtttccttggcacgagtgcgacccacaccgaaaatgtaggtgagggcgatctcgatgcgcttctcattggggatgtcgactccggcaagacgtgccattgcgattccttcttgttgccgtaggtcttgcacccgctcgcccggttacccggcacgggcctacgtacccgtggttcagtgtcgttcccttgcgggaagcactgtgagagagtgccttatttacttagtgccgctggagaatctgctctcagccctgacgctgcttgtggcgcgggttgacgcagatcaccatgacgcggccgtgacggcggatcacgcggcagttttcgcagatcctcttcacgctagggctgaccttcatggttatccttttcttgtgtacctttacttgtaacggtacgtaatgcgtccgcggttcaggtcgtaagggctcatttcgagcacgacacgatcctgcggcagaatacgaatgtagttcttacgcattttgccggaaatcgtggcgagcacgatgtgcttgttttcgagttcaacgcggaacatcgcgttaggcagtgcttccacgacctgtccttcgacttcaatcacaccgtcttttgccatgtgcctctagtcctattccgttggatgattactatggcatatccgaagacacaccaactgtcaactatatacgcacatacccctgtacgaacactcggcgtgtcgcacaggggtatggaaacgttgatgtggtatttcggcatcactccggcttgttgcccgggctgccgaacctactactcgaggtggctgatgatacggccgctgatctcgtcgatgtcgccgacgccgttgaccacgacgagcaggccacgggcctcgtagatgtcgagcagcggagcggtttccttctcataggtctccaggcgcttggcgatggcctccggagtgtcgtcagcgcggccctgctcggcggcgcgcttcttcatacgctccagcagcacgtcgcgggcggcttcgagggccaccacgtggtcgagcggagtgtcaaggtcggcgagcatctcgtcgagagcgatgacctgggcggcgttacgcgggtagccgtcgaggatccagccgttcttgcagtcttccttggccagacgatccttgacgatcttgttggtcagggagtccggaaccagctcgcccttgtcggtgtagctcatcgcctcaaggccgagttcggtcttgttcttgatgttgtagcggaagatgtcgccggtggagatggtggggatgttgaagtgttcggcgagcagagcagcctgggtgcccttgcccacgccctgggggcccatgatgagcagacgcatggtggtctccttttatgtcggttattaatacggttttggctcccttggttaagggagccattgagttatatgcggaagaaagattgctccgtcgtggaacagtccactggactgttccactcctcgcgcggccgcctgcccattgcgggcggccgctgtcaagcgggcgtcagccctctttgtggtccacgttttcgaacaggaagccggtgtactggaactgttcggtctgggccttggcctggcgcagggtgtcgaggcccacgcccgcgataatcaggatcgtggtgccaccgaacggcagcttggcgttgaggccgagggccatgatcagcacggtcgggatcagggccacgaacagcaggtagacggcgccgacggtgttgagtcggttcatcacgtaggtcaggtagcggctggtggcgttgccggcgcggatgccggggatgaagccgccgtactgcttcatgttgtccgcggtctcgtccgggttgaacgtgatcgaggtgtagaagaagcagaagaacacgatcatcagcgcgtacagggcgatgtaccacacggatgtggtgttcgccaggttggcgttgatccacttgacccacgactggtcggacttgccgaactgggcgatcagggtcgggatggcgaggatcgaggaggcgaagatcggcgggatgacgccggacatgttgatcttcagcggcaagtaggtggaggagccgccgtacatcttacggccgatcatgcggcgcgtgtactggaccggcacgcggcgctggcacagttcgacgaagtcgacgaagatgaggatgaccacgagcacgcccacgacgatgccgaacttcagccagtcgccatcggtgccgtcggtgccgtagccgatctcccacagctgcggcaggaagccggagcagatggacatgaagatcaagatggacatgccctggccgatgcccttgtcggtcacgagctcggccatccacatgatcaggccggtgccgccggtcatgatgaggaccatgaccacgaggttgaacacggaaccgtccgggatgacctggtcgcactggtaattgaacagggcgccggagcgggcggtgaccaggatggtggtggactggagcacggccaggccgatggtcaggtaacgggtgtactgggtgagcttggcctcgccggactggccctccttgtgcagggcctcgaagcgggggatgaccacgcgcagcagctgcaccacgatggacgcggtgatgtacggcatgacgcccagcgcgaagatagacagctggagcatggcgccacccgagaagaggttcaccagtccgatgaagttctcctgggaggcgctgccgatggtggccatgcacttgttcaccacgttgtagtccacgccaggggtcggaatgaacgaaccgatgcggtagacgatgatgatgaacaggacgaagagaatcttcttcctcaactctttggttttcagggcctggattagtgtcctcacctagatttcctcccaatagcgcgccaatcgcgcgaaatacacaaactaacgaacgagcatagtctaaagtgcctacttcggccacttcatgtctcgcgaatgttacctgaattatgctccgtcgtactgaacgggggaagcatactcaaaacgatcattgtgttgagactgcttctctgcactcagaacaacaattttttagaaaagggaacccccgtccacctattggcgggcgggggttgtacagcctattgcgctccccgtaggactaatcagtcctcggaaacggaaccgccggcggcctcgatcttggacttggcggaagccgaagccttaacacccttgagggtgaaagccacggtggtctcgccgtcgcccagaaccttcaccggagcgttgtcacgaacagcgcccttggcgatcaggtcggccacagcaacctcgccgccctcggggaagagctccacgagacgagcgatgttgatgacctggaactcgaccttgaacgggttcttgaagccacggagcttcggcaggcgcatgtacagcggcagctggccgccttcaaagcccggacgcacgtggttgcgcttcgtctggcccttggcgccacgaccggaggtcttacccttggagccttcaccgcggcccacacgggtgcggtccttcttggcacccggggcgggcttcaggtcgtgcatctgcaggatttcgttatctgccataatcagtcaacctcctcaacggtgaccaggtgacgcacggcgttcaccagaccacggttggccggggtgtcctcgcggacaacggtcttaccgatcttgttgaggccgagggtcttgacggtggcgcgctgagccggggtacggttcacgatgccgtggtgcagggtaatcttcaggttcttagccatgagtatcactcaccatccttctcttcggcggccttagcggcagcagcctcttcgcgagccttgcgagcctcggcaatgccggcggcgcgggcgcgcagcagagcatcgggagcgacctcgtcgagcgccaggccacgacgggcggcgatctcctcgggctcttcgagctgcttgagggcgtcgacggtagcgcgcaccacgttaacggcggtggcggagcccatcgacttggtcaggacgtcggtgatgcctgcgcattccatgacggcgcgcacggagccaccggcgattacaccggtacccggggcggccggacgcagcaggacggtgccagcagcgtcgtgaccctgaaccgggtgggtgatggtgccgcggacgcgaggcacagagaacatgtgcttcttggcgtccagctggcccttggcgatggcggccgggacttcacgggacttgccgtagccgacacccacggtgccgttgccgtcgccgaccacaaccagtgcggcgaagctgaaggtacggccacccttgtgggtcttggacacacggttgatggtcaccacgcgatcgagcagctcgtcgccgtggttttcttcacgacggttacgacgctcgccacgacggccttcaccgcgctggccacgacgacccttgcggtcctcgttgttggattcggtcgccacagtgttctgagtttcttcagccacttgggtttccttcgtttcgttgtcgctcacagtgcaagacctccctcgcgggcgccatcagcaacggctgcgacgcgaccggtgtacttgttgccaccgcggtcgaacacgactgcggtgatgccggcagccttggccttctcggcgatcagctcgccgaccttcttggcggcctcagtcttggtgccttcgaagccggcgaagtcggcctgaagagtggaggcggacaccagggtaatgcccttggtatcgtcgaccacctgagcaaccatgtgacggttggagcgggtgaccaccaggcgcggacgctcggggtaccggagatgcgcttgcggatacgcgcgtgacggcgcttgagagctaccttcttgccttttccgagaatagcaacgctcatatcacttaccagcctttccagccttgcgcaggatgcgttcatcggagtacttgatgcccttgcccttgtagggttccggagcgcgcagcttgcggatgttggcggcaacctggcccacgacctgcttgtcggtgccttcgacaaccacgtggttggcgtcggtcaccttcagggtgatgccttcgggcgggttgacggtgatggtgtgggagtagccgaggaagaactcgatgccctggcccttggcgacggcgcggtaaccggtgccgacgatctcaagagtcttggagtagccatcgtgaacacccttgaccatgccggccatgatggaacgagccagaccgtgcttggcacgggtcggacgcaggtcatcagcggcggtcaggacaatctcgttgccttcaacggcagcggtgatgccttccggaaccacgtaggagtcagaacccttagcgcccttggcggagaagttctggccttcaatcttgacttcaacgccagcagggatggcgatggggagcttaccaatatgcgatgccatgtttcagctctcctttctcaccacacgaaggcgacaatttcgccgccaatgcctcggtcgaggcattccttctgagtcagcagtcccgaagaagtcgagatgatggcgatacccaggccaccgagcggcatcggcagggagtcggacttcgcgtaacgacgaaggcccggcttggagatgcgcttgataccctgaatggaacgctcaccgttcggaccgtacttgagggtgacctcaagagtctggccgaccttggcttccttagcggtgaagtccttgatgtagccttcacgcttcaggatctcggcgatgttcgccttgaacttggagtacggcatatccacggtttcgtgcttggccgcgctcgcattacgcagacgcgtaagcatgtctgcgatcggatctgtcattgtcatttgggcttgttgccctttctcgctatggtttccgccgccctcacgcttcttctagaagcgttcgggccgcggaccttcagcgtcgatgtttaccaactggacttcgtaacgccgggcagttcaccgcggtgagccttctcacgaaggcagatgcggcacaggccgaacttgcggtagacggagtggggacgaccgcagacctggcagcgcgtgtaagcgcggaccttgaacttcggcttgccggccgccttgttcttaagagcggtttttgccatatcagttctccttgaaggggaagccgaggtgcttcagcagcgcgtaagcttccttgtcgtccttggtggaggtcaccacagtgatgtccataccgcgcacgtgatcgatcgaatcaggatcgatctcgtggaacatggactgctcggtgagaccaaagttgtagttgccctggccatcgaactggtggccgttgatgccgcggaagtcgcggatacggggcagcgcgagggtcagcagacggtccaggaactcccacatgcggtcgccacgcagggtgacgtacgcaccgatggcctggccttcacgcagatggaactgcgcgacggacttcttggccttggtgatcttcggcttctggccggtgatcagggtgaggtccttgacggcaccttcgatgagcttggagtcgcgggcagcggcaccaacacccatggagacgacgaccttctggacacgggcaacctgcatcgggttggagtacttgaactccttctcgagctcaggaatgatctgctcgttgtacttgaccttcaagcgcggggtggccggcgcttcgacagtagtatcggtcatgccagctcctttccggacttcttggcgacgcgcacgcgcacggtcttcaccttgccgtcacgcgcctcttccttaacggtgatgccaacgcgggtcggctgcttggtctccgggtcgatgaccatcacgttggagcgatggatcggagcctcagtggagacgatgccagcctgctggccctgctgcgttgcacgcacgtgcttcttgacgatctgcacgccttcaacgatcagtcgatcgttggagagcacctgcttgacggtgccttccttgccgcggtccttgccgcggatgaccttgaccaggtcgccgctcttgatcttggctgccatgtcagatcacctccggggcgagggacacgatcttcatgaacttgtgctcacgcagttcacgaccgaccggtccgaagatacgagtgcccttcggttcacggccggagccgagaatgacggcggcgttctcgtcgaacttgatgtaggaaccatccgcacggcgggattccttgacggtacggacgacaacggccttaaccacgtcgcccttcttgaccgacccgccaggaatggcgtccttgacggaggcgacgatcacgtcgccgatgccggcatagcgtcgcttcgatccgccgagcacgcggatggcgaggagttccttcgcacccgtgttgtcggcgacatgaagccgcgtttcctgctgaatcattgattctccttagccgagctggttctccccatttaccggggcatcgtggttgcccataatgccccggtaaatggcgagccttgccgaactttacttacttggcgcgctcgataatggattcgagacgccagcgcttggtcttgctcagaggccgagtttccataatactcacgaggtcgccaatgtgggcgtcgttgtgttcatcatgggccttgaccttgctggtggaacgaacgaccttgccgtacagcgggtgggtcgaacgctgctcgagctcgacggtaatcgtcttgtccatcttgtcggacacgacgtagccgcggcgaaccttacggaagttacgctcttcagccataatcacttctccttggattcggtagcggccggctcctggctgatgccaagctcacgctcgcgaagcacggtgtacatgcgggcgatgtcgctcttgacagccttgagacgggcggtgttctcgagctgaccggtggcgtgctggaagcgcaggttgaacagctcttccttggacttcttcaagaagccttcgatttccgcgttggtcttctcgttgagattcttgatggagtaatcagcggtaccgactgccatcagatatcaccaccttcacgtgcgataatgcggcacttcatcgggagcttgtcgatagcgcggcggagggcttccttagcgatgtcctcggacacaccaccgatttcgaacatcacgcgaccagggcgcacgttcgcaatccagaactccggggcacccttaccggaacccattcgggcaccgagcgggtgcttggtcagcggacgatccgggaagatcgtgatccacacgcggccaccacgcttgatgtagcgggtcatggcgatacgcgcggcttcgatctgacggttggtcacgtaggccggggcgagggactggatggcgaaatcaccgaagttgatctcgttgccgcccttggacatgccagaacgcacagggcggtgctgcttgcggtacttagtcctcttggggataagcattcttgctcactccttcgtttctgcagccggagcggcctcggcgggagcctcagccttgggggcttcggcggcctgcggggcggcggaacggttgccacggcgcgggcggcgatcgccaccacgacggcccggacggttgttctgctgagcctgctgctcttcgaactcggattcggtcatgtcgcccttgtagatccagaccttgacgccgatacggccgtacgtggtcttggcctcgaagaagccgtaatcgatgagggcgcggagggtctgcagcggaacgcggccctcacggtagaactcggaacggctcatttccgcaccgccgaggcggccggagagcttgatgcggatacccttggcaccggcgcgcatggcgtcctgctgggccttacgcatggcacgacggaaggtgacgcggttggtcagctgctcagcgatgccctgagcgacgagctgggcgtccagcgcggcgttcttgacttcgaagatgttgagctggacctgcttgccggtcagcttctcgagcttggcgcggacgcgctcagcctcggcgccacgacgaccgatcacgatgcccggacgggcggtgtgaatgtcgacgcgaacgcggtcgcgggtgcgctcgatgacgatgcgggacacgccagcgcgctcgaggtccttgctcatctccttgcggatctgatcatcctcaagcacgaagtcgcggtagcgttcgccggccttgttggagtcggagaaccacttggagcggtggttctcagtgatgcccagacggtagccaaacggattgatcttctgacccatctttagcgggctccttccttgttagccacgacgaccgtgatgtgggaggtgcgcttgttgatgcgagcagcgcggccctgggcacgagcgcggaagcgcttgagggtcacaccttcgtcaacgtaggtctccttgatgtacaggtcgttctcgcggaacggctcgccggccttgtcggccttcacacgagcgttggcgatggcgctctccagggtcttgcggaccggcagggccgcagcctgaggggcgaacttcaaaatggtgacggcttcggtcgccttcttgccgcggatgaggtcgaccatgcggcgagccttgcgcggcgtcacgcggacgtgacgagcgattgctttagcttccatgttctattccttatccttagcgacgggccttcttgtcgtccttcacgtgacccttgaaggtcttcgtgggggcgaactcacccagcttgtgaccaaccatggcctcggtgacgaacaccgggacatgcttgcgaccatcatgaacggcgaaggtgtgtccgatgaaatcaggggtgatcatcgaacgacgggaccacgtcttgatgacgttcttggtgcccttctcgttctgctcgtcgactttcttctgcaagtgggcgtcgacgaaggggcccttcttgatgctacgagtcatcttctcgatactcccttacttgcggttcttgccggacggacggcgacgaacaatcatcttgttcgaagccttcttcggacgacgagtacgcacctcgcccttgccccacggggagaccggcggcttaccaccgcgggtacgaccgccgtgcgggtggtcgaccgggttcatggactcaccacgggtgatcggacggcggccgatccagcgggcgcggccagccttgccgagctgaatgttggcgtggtcctcgttgccgacctcgccgacggtagcgcggcagcgcgcgtcgacgttgcggatttcgccggacggcatacgcagctgagcgtaggcgccatccttggcgacgagctgaacggcagcaccagcggaacgagcgatcttagcgccgcccagcgggcggagctcgatggcatgaaccacggtaccggtcgggatgttcttcagcggcaggttgttgcccggcttgatatcagcctgagcaccggtctcgatgacgtcgccctgcttgatgcccttcggcgcgatgatgtagcgcttctcgccatctgcgaagtgcaggagggcgatacgggcggagcggttcggatcgtactcgatctcggcaaccttggcgggcacgccgtccttgtcccaacgcttgaaatcgatgagacggtactgacgcttgtggccgccgccgcgatgacgggaggtgatacggccgtaagagttacgaccgccggtcttggacttcttgcgaaccagcgacttctcaggcgtagaacgagtcagctcggagaaatccgagacggacgcgttgcggcggcctgcggtcgtcggcttataaacgcggatagccataatgtagttcttcctttaacttttctcggctaaccttcagttaccaaagatgtcgatcgtctggccctcggcgacggtcacgatcgcacgcttctgggaagcgcgctggccgaaaccggtgcgagtgcgctgcttcttgccagcgcggttgagggtgttgacgttcgtcaccttgaccttgaagatctcttcgattgcctgcttgatctgcaccttgttcgcatccggagccaccacgaaggtgtactggccacggtcggaagcggcgtagctcttctcggagacgacgggcttaagaatcacgtcgtgagcgggcttgtgaatagcgaccatctaaatcaggcctccttcggctcggtcttggcagccacgaaagcctcgaaggcttccttggtgaagaccacgtactgcgaggtaatcacgtcgtacgtgttgagctgatcgacgaaaatcgggtgaacggtcgggatgttgcgcacggagagccactcgttgatgttgtcgcgagtgaagacgaccgtggtgaacttgtccgcggtaatcggggccagagcggcgacagcggccttggtggacggctcggtgataccgaactccaccacggcaacgcgaccggcgttggcgcgatcggacagggcgtagcgcagagctgcggccttcatcttcttgggggtgcgctgagagtagtcacgcggctgcgggccgaacacggtgccgccgtggtaccactgcggtgcacggatggagccctgacgagcacgaccggtgcccttctgcttccacggcttcttgccgccgccggaaaccatgccacgagtcttggtggcgtgggtgccctgacgagcagcagcgagctgagcggtgacaacctggtggatcagcgggatgtgagcctggacatcctcggcggaaacgccgaagagagcctcaggagcttcaacggtgccggtggcctggcccttggcgtcggtgacgttcagagtaacgtttgccatggtttatcaggctcccttcacagccgagcggacgagaacgatgccgcccttggggccaggaatggcgcccttgatggcgaggatgccgttctcgacatcagcggagacgacggtcaggttctgggtagtggcggtcacatgacccatgcggccggccatacgcttgcccttgagaatacggctcggagtggcgcatgcgcccacagaaccgggacggcgctcgttcttgtgagaaccgtgagtacggcggtaggacttgaagccccaacgcttgatggtaccggcgaagcccttacccttggtggtgccggtcacgtcgacctcagcaccctcttcgaacaggtcagcggccagttcctggccggcctcgaactgatcgacgtcgtcggtgcgcacctcgacgaggtggcgacgcggggtgacaccggccttggcaaagtggccagccagcggcttggtcaccttggtgggatcgatggcgccgtagccgagctggacagccttgtagccgtcagattcctcggtcttcacggcggtcaccacgttggtggacacgtcgacaagagtgacgggcacgaagaagccgttctcgtcccacacctgggacatgccgagcttcttgcccagcagagccttgcgattagacataatgcttcctcctcccttacagcttgatttcgatgttgacgtccgcaggcagatcgatgtgcatcagggagtccacggccttgggggtcgggtccacgatgtcgatgaggcgcttgtgagtgcgcatctcgaagtgctcgcgagaatccttgtacttgtgaggagaacggataacacagaagacgttcttctcggtcggcagcggaacggggccaacaacagttgcgcccgcgttcgtcaccgtttcgacgatcttcttcgccgattggtcgatgacctcgtggtcataggacttaagcctgatgcggattttctgtcccgccattgccgtccgccctttctagcgatgttcgttgtactgtttaccaacctgcttctagggcaccggcgcgcatggcctcccttggacatacgtcctctggcggtcatccgacatcagtgcgcggtttccggctgtcacttcacttgaagtggctcccggcccgcgctcgcttttttaattccaatttgcgagcccaaatcaggcaacttgtttattcaagcattgaggtgggacagtggagttcgcgcgtgtcgcgctcatgccgttcgtattacctcgcggcatagccgctcggcgtctgttcgattgtcgcaatgcaggtctcacatctttcttattgagaaccattcgctgcgatatcatgacagatatgacttcccgccgcaagactcttaaacgcgattggttcgacaaccaacctggcgcatgggtaatggttatgctgcccgttgtggctggcttctttatcggcgggcctaatcttgatacgctttggctattggcgacgtgggccgtgtgctattgcgtgcagttcagcgccgcgcactggttcaaagcacacttttcacgccgttatctgccgccgatgctcacttatgccgtagcgctcatcgtcatcggcttgccattcctgattacgcataccggcatactgcgttgggctcccttatatatagtgctggttgcgctgtcgatgctgtcctcgtggctgaggaaggagcgctcgctgtggggcaatgccgtgtcggtgattgccgcgtcggccatggccacggtgatcgcgtcgtttggcagcactgttgagacggcatgtgttatgcccatcaacgcagcacatgcctcgtgcgcagccgctgatgtcaccgccgcacgcgccgcgattcggaatatgccagatttgagccagatattcgaccttcacgcctggtggcccgcgggttcattgcccgtgagcgggctgattgccaccgtgctgtttgcgctgacgcagtatgggtcggttttagtggtcaaaaccatgatccgggaacgcgggaagcgttcgtacgtggcggcttcgtgggtatggcatgtggcgctattgctgctagccgccgtgccggctggacgcagcccgtatctgattgcgatgactgtgctgctgttggcccgcgccgttgcgttgccggtggttacacggcgcacaaccttgaagcccgtggtgaccggcattaccgaggcgtttgccagctttattgcttttggctgcataattgcggcgatttagcgacgcttcagcgattccatggggaggtaattacctcatggggcggtaattggcccatggggcggacggtaaaattttaccttccgcagaatagagccgttttcgtacaccgccccatgggggttttcaccgccccatgggcaagttaccgccccatgagtgggttaccaccccatggaggtgtacctgctggctgagggagcaccacatatgcaaaggagcccggcccctgtaatggggtcgggctccttgtgtcgcgctatgcagccactaagctgcaacaccgcggttggtggctactgatggtgccaccaaccacaaaccgcctgcaatcaacgctcggaggcttcctcagtggcggcctcaccctcgcgctcgatgcgcagcttgtggccttccgcctgggagacaccgtagtaagcaccgacggcgatgtccttcatgtcgttgatcagcgggatgcgcgggttggccggggtacactggtcctcgtaggcgcgcatgccgatctgatcgagcacggaccagaagtagtcctcgtccacaccgcaatcctggaagctcttgttcatgccgagcttgttgtcacggtagtcctcgacggccttcgccaggttctccacggcttcggccggggtcttgccggtgtcgatgccgaggttgcgggcgatgtcctggtagcgctccggggcgatgtacttgttgtacttcggccaagaggtgggctcctcaggaatctggccgttgtagcgaatcacgtacggcagcaggatggagttggtacggccgtgggcgatgtggcacagggcaccgatggtgtgggccatgccgtggcacatgccgaggaacgcggagccgaatgccatgccggccatggtggcggcgttgtgcatcttctcctgagcgttggtcttggccaggccgggctcgccattgacggactcagccaggttgtcccagatgagcttggccgcgtgcagggccatgccgtcggtgaagtcgttcgcgtacacggacacgtaggcttccatcgagtgggtcagggcgtcgaagccggcgtcggaggccagcttgcgcggctgggtgcgagccagcaccgggtccacgatggccacggacggggtcagcgcgtagtcggtgatcgggtacttgtagccggtcttgtgatcggtgatcacggcgaacggggtgacctcggaaccggtgccggaggaggtcgggatgcacaccagcttggccttcttgcccagcggcgggatcttgaaggcgcgcttacggatatcgaagaacttctcgcgcacgtcggagaaggcgatttccgggtgctcgtagagcagccacataatcttggaggcatccatcggggagccgccgccaaccgcgatgatcgtgtccggctcgaactcctcgcgcatcatctcagcgcccttttcgacggtctcgacggagggctccggctcgacgtagtcgatgatgcggaaggtcacacggttggagcgggcgcgcagctggtcgatgatcttgtcaacaatgccgagctgctccatgaccttatcgcacacgatgacggccttctcgatgccgtacatgtcgcgcaggtacttgatggcgttcggctcgaagtaggtcttggccgggatcttgaaccactgcatgttgttgttcctccgagcaatgcgcttgatgttaacgagattcacggcctgcacgttgccggacaccgagttgccgccgtaggagccgcagcccagggtcagcgacggggcgatggcgttgtagatgtcgccgatgccgccaagggaggaaggctggttccagatgatgcggcaggcgtgcatacggacgccgtactcacgcacgagctcctggttgttggtgtggatggcggcggtgtggccggcacccagcttgagcatcttctcgcacatctcgaaggcctgctccttgttgtcggccttgagcacggcctgcaccggagcgagcttctcgtgggtcagaggctcgtcgtcggagacttccttgcactcggcggccagaatggtggcgtcggacggaatctcgaagccagcagccttggcgatgaactgcggggacttgcctggcaccgcggagttcagcacgggcttgacgccggaaccggcagtgcagccgaacatgtactgttccagcttggccttctcttcggcgttgacgaagtaggccttacggaccttgagctccttgatgagctggtcgtagacgtccttgtgggcgatgatggcctgctcggtggcgcagatcatgccgtaatcgaagtgcttggagagcaccagatcgttggcggcgcgcacgatgtcaacatcggtgtcaacgtaggccggggcgttgccggcacccacgccgagggcgggcttgccggaggagtaagcggccttgaccatgcccggaccaccggtggcgaggatcgtggccacgcccggatgcttcatcagggcgcctgtggcctggatggacgggtgctcgatccactggatacagttctcgggagcaccggcttcgatggcggcgtcgcgcacaatcttggcggcctcgacggagcacttctgcgcgccggggtggaagccgaagacgatcgggcaacgggtcttcagggcgatgagggacttgaagatggcggtggaggtcgggttggtgaccggggtgacgccggcgaccacgccgacgggctcggcgacctcatcgatgcccatcacatcgtcttcgcggatgatgccgacggtcttctggccggccaagtagttggtgacgtgctcgcaggcgaagatgttcttggtggccttgtcttccacgagaccacggccggtctcgtcgacagccatcttggcgagaacgaggtgcttgttcagagcggcgatggaggccttggcgacgatacgatcaacttgcttctggtcgaggttctcgaattcgacgagagccttcttggcgcgggcaaccagcgcgtcaacttcggcctcagctgcggcctgcttctcttctggagtcggcttggtagcttcgaccttcttctttgcttctgccacttggggtcctcctcgatcttcttggggtatatggcaaagttctgggccatcgcctcgtcacctcagttgcaccagcgggataccgcctcagtaaccgaaaatgaccggtgatgcgttgtcacattgcatatgtgacctgaggcacaatatactgaacggtccggcgcgatgcatacgcacaaaatcgacggcgtttcacgtgcgatattgaacagtttttgttacgagttgtgcgaaatatcgaacaaatcctcactctatccggcgatttggtactttttgttcactttttaccgaaaatcacatgcctgcaaacaacacaatccgagaacttttttaaagtaagttttcaaaagcaatcattttctccacatttctagaaagttggtttaaaaaagtacccaaaatcgcctacaaatatacgattgttgcctcataacctccgcgtcgaggcacatgaaagccactttcataaagtaaacttgcatatatctcatcgcacaaaggggtaaacatgagggcaatgccatcgaccgcagtgaaagcgcacaaccgcagtgccatggcccagtatctgtatggccatagccatgtcaccaagcaggaactggaacgcgaactcggcctcagcctgcccaccatcacccaaaatctgcacgcactagaagatgacggactcatccgcaaaggcgaactgcaggattccaccggcgggcgcaaggcgcaaaattatgagttcaatcccgatcatcgcactgccatcggggtagtgatgcggtccaacgaactgcgcctgtgcgcgattaacctgtacggcaacgtcatcgaaaaacgcaacgatgccctgccttaccgcaacaccaacgtttactaccagcgtatcggcggcatcatcaacaacttcgccgccgacgtcgaaaagaagcacggcaaggtgctcggcgtctcgttcgccatccaaggcatcctctcccccgacgccaccaccatcatcttcggcaccattatgggcaacactgggctcacgctcgaaaccatcagccaatcggtccattacccgtgcatgatgatccacgattccgatgcctcagccatggccgaactctggttcgactccacgctcaccgatgcggtgtgcgtctatctggagcgacgcccgggcggcgcggtgatcgcggggggcaaactgtatcaaggcccgaaccagtgcaacggcgccatcgaacacatgacgctggtgccgggcggccgcgaatgctactgcggccagcgcggttgcatggacacctactgctcgccggagaccttgcccgaggattacgaaagcattcccggcttcttcagcgtgcttgagcagggcgaacggcatcatcgcgagcgcatggatgagtggctggattacgtggcgcaggccatcgtcaacgcgcgatccatcatcgcgggcgacgtgattgtcggcggtgaagcagcccagcatcttgaagacagcgacatcgaggatctgaagacgcgcgtcatcgcacgcagcccgttcggcaccgaccatttcaatctgcgcaagagctactgcgccgaagatcagaacatcatcggtgccgcgttgcggttcgccgagaattatctcgacggcatctgcggtgctgcggaacgcggcaggaaatcaagggcttccaccaaaagtgacaacacgtctacaatggaggtatgaaaaacccaccgttgcatcgttacgccactcgcccagggctgtacttcactgacgacggtggggctgacgtcgttgttcgttccgaaactgccgatcaggtttggctatgcgtactggagcccattgatgagcccagcgctttcttccaagacgccatccgcctgttcgaggacccgaatatctcctttatccagcagattcatgagttcccggtatgcacacgcattatcgaacatttgtatctgcgcgagaccttgttccgcatgaccgggccgaactacggcctgtggtacgtgcacctgcccaaagcatgggacggcatgcgttatggctaccgcgtggacggcgcatgggacccgaaacacggcgtgcgcttcaatccatacaaattcctgcttgacccgtatggcaagggcatcgacggctccatggagctcacccccgccgccttctcctatgaatgcgatgtcgtggaccgcaaggtaatcggctcggcatacggtgccatgagcaccgtagactcgctcggccatatgccggtgtccgtggccatcgacgatcgcgatacccataagcatgagggcgacccgcagcacccgcatgtgccgtggcgcaaaaccgtcatctatgagatgcacgtcaaaggcttcaccgccaacgcaccgtggctgcccgaatcattgcgcggcacgtacgccggactcgcacaccccaccacgctcgcctatctgcagggtctaggcatcacatccatcgaactgctgccgattatggccaagcaggacgagctcttcctgcaagaacacggccgcaagaactactggggctactccaccctcagctacttcgcccccgaaccctcctacgccactaaagccgcccaggagaagggcgcggccgccgtgcgccaagaagtcatagacatggtgcgcgcactgcacgaggccggcttcgaagtcatcatggacgtggtctacaaccacacatgcgaaggcggcgtcgaaggcccgacggtctgctggcgcggcctcgacgacctggcctactatcgccatcaaaaatccaataccggccgactcgaagacaccaccggttgcggcaatacgctggacttcaccaacacgcatgtggtcacctttgccatcgactcattacgatactgggccaagcgtatcggcatagacggtttccgcttcgaccttggcgtcacgctggcccgcctggaaggcgaattcacccatcatcacccgttcctctacgccctgcgttccgatctgctgctgggcaacctgaagctcattatggagccgtgggatctgggcaacctcggctggcgcaccggccaattctccgtgccgttcgccgaatggaatgaccgcttccgcgatacggcccgcaccttctggcttgaggatgtggacggcggctccgatttcgggcgtatcagtttgcaggagatggccacgcgactctgcggctcggccgatctgttcgccaccgaaccagggcgtggcgctccggcctccatcaatttcgtgtcctgccacgacggtttcacgctgacggacctcaccagataccgctccaagcacaatgaagccaacggcgaaaacaataatgatggctcgtcggtgaaccattccgccaatttcggcgtcgaaggcgtcaccgatgatccagacgtcattgcggcacgcgaacaggcggccatgaacatgatcggcatgctgctgctctcgctgggtacgccgatgatgctcgccggcgacgaattccgcaacacgcaggacggcaacaacaacgcctactgccaagacaacgacatcacgtggctgaagtgggattggatgtattccaccaacaagacgcgcgaaatgcgccgcttggaaaccgtgtctcgactggtggcgctgcgtaaatcactggacctgtatcaccacgaggatttcttcacccgactgacccagatcggcctactcaagccctcaagccgcgtgcagtggttcctgcccgacggtaccacgccgatggagcgtgactggttcgatctgggcgtacgtagcttcaccatgcgattgctgtccaacagtgaggtggacgtgtgcattgtggtcaacggcaccgctgacgaccgcacattccgcctgccgccagacacccactggacgcctaaatggtgctcggccgaaatcaacggccgccgagccgggcatggcactcaggtcgaggaatgcgatttgaacggtgacaccaccgtctggacgcagcatgtaccggacgccagcgagacagtactcaagatggtcgaagaagtggccatgcagcgtacggaatcctcgactgagaatgaagcggataccatcaaattcgcgatgccagtaacagatcacgccgcaaacggcacctcgtccgcgcctcgggatgaggtatcagctgatatgcccgatgcccctgtggatgatacaccggacactcccgtcgacgacaatgtctggaccatgccggcgctgagcatcacgctgatgaagcaggtgtgagtcacactcaagacagcgcgacacaaacacaaaggctctccgcggaattccgcggagagcctttgtatgctcggtacaggacaagcgaaattaacgcttggagaactgcggggcgcgacgtgccttgtgcagaccagccttcttgcgctccacgacgcgagcgtcgcgggtcaggaagccagccttcttcagggcggcgcggttggcatcacgatcgatggcgttcagagcgcgggcaacgccgaggcggatggcgccggcctggccggtggtgccgccgccgtcaacgaggacgatagcgtcgaacttgccttcgagcttgagcagaacgatcggggagttgacctcacgctgcagcagcttggaggggaagtactcctccagagtgcggccgttgatggtccacttgccgtcacccggaaccagacggacacgggcgacagcctccttgcggcgaccggtgccgtagcccggctcaatcgcggaggtgccggtgccagcgccagcgttggtctcggtggtgtagttggtgagctcctcttcggtctcgacaacctgggagtcgttggtgttttcagccatgattcttatctcctctcaggtttcacttggcctgctgcgagacctgggcgatctcgaagacctggggcttctgcggggtgtgcgggtgctcggcgccacggaagatacgcaggcggtcgagctgcaccttggccagacgattcttcggcagcatgcccttgacagcgttcttgatgatgcgctcggggttcttctcgagcagctcggcgtaggagtcacgacgcagaccaccaggacggccggagtgcgagtagagttccttgcccatcttgttgccagtcagagcaatcttgtcggcattgatgatgatcacgtggttgccggaatcggcgtgcggagcgtaggtcggcttgttcttgccgcgcagcaggattgcagcctgggtggcgagacggccgagcaccacgtcggtggcgtcgatgacgtaccagtcatgagtcagatcagctggcttcggagtgaaagttttcactggattaccttttctatattgtgttccgggtctcagctgcttggtgtggcttggtcagggccgcatccaagaggcgtcgaacctcattatccgtgggctccctgaaagtcctcgatggcgagtgggatagcgctttgaaggaccccttagggaaacacaacaatccactagtatatcgccgggcttgacatagggcaactggggacactccattgggtttatggcttctcttcccctatttatggtttctctcccacccacttcggctaaccgactcacctacggtgaggcaattccctgccttctctcagctatcgcttctttcaggcctcgtctacggacagtccactggactgtccgcttaacgactcggctcgtcagagggaggtaaagcgggtcaggaattgaagatttgggcgaagcgttgggcaccggggtgtcgaagagggtttcgagcggtaccacgttgcccttggcgtcggccagtgggatgcgccagttcgggtattcgttgttggtgcccggctggttctgcgcacgcttctcccccaccgcgtcggtgatcgaggcggcgagcagcttgcacggcgaacccttcagtgcgtggtacagcgcgtcgacgatatccgcctcgtgatcctcacgatgttcggcaaagtcggcatcaagataaccctgctcgaccagcatggccagcatcgcatcctgctcggccttggcggaggcttcgaattcctcggccgggccggtcagcaagcccagacgctcacgaatcttgacgtgctcgtattccaggtaaccggcggccggcggcaaatcgtgcgtattcacggaggccaatgcatacggacgccactgggagggggcgcggaacacgccgtcgcactgctcgaaccattcaacggcgcaaccgagaataccgtggctcgacagggaatcggccacatggtccggcaccacgccgaggtcctcacctacgaccacgccgccggcacgagaggcctcgatggccagaacgcccagcatgatgtctgagtcgtagtacacgtaagcgccatccatagccgaacggttctcgggaatccaccacaggcggaacagaccaaggatgtgatcgatgcgcaccgcaccggcacgggcgaacatgccatgcaccatattgcggtaggcctcgtagccggtggtctccagattgatcgggctcagcggcggctggctccagttctggccttgctggttgaacatgtccggcggtgcgccgaccgtggctcccttggcgaagcgctcgggattccaccacacgtcagcgccggaggggtgcacgccgacggccatatcggacatgatgccgatatgcatgccggcgtccttggctgcctgttgggcggaggacagctgctcggcggcaatccattccagccagcggtagaagtccaaagtgtccgggtactgcttgcgcagattggcgatttccggggagttgcgattgaacttgcgctcccagttgccctcctcgccgttgggcgccccccacttgtcgtagcacaggcaccacgtggcatacgcctccaagtcggaaccacagtccgccttgaattggtcgaatacgctttggcgttcggcggtacggccggccttgaagataatccacagggcgtgcatcttgctgcgccacatggcgtcacggtcgatgagctgggaatcaccgttcagcggttcggtgtcggcatgcagtccgtcgacggcattcttgtcgccctcgctgagcgtggcatattcggcgatcgcctcaggacggatgtacgtgaagttgatcaggcgacggcttaccggcagatacggcgacggggtgagcggggacaccggctcggcggcatgcaccggattgatgagcacgaagtcggcaccggtcttctgcttggcgtccaccagcatggtcttcagatcctcgtaatcgcccacgccccaggagttggaggagcgaatcgagtacagctgggccatccagccccacagactgccgcccttcatcgggtcaagcagatcgacgcgatcaggtgcactgatcaaagtggcgtcttgcacacggtcggcgaccttgacgtgcagcgtatggtaaccaatcggcagatcggcgggaatgaccacagccgcattcgaaatgaacgtaccatccaagtcgtaggcctgggatccatctccaggaccaacttcaatggtgccttgatatggctcgccattctccagcgtgatgctcgccgaaggcacgtccagaataccggtgttcaccagcacccggtcctcgctaccggcgatatgcagcacggtgggtgccaccaatcgggcgtaacgctcgttcagaatgcgtcggatggcgatgagttgggcgctctcgctggaggcgtcgatgcccagcgctgccagcacctcgatcaggacgtcatcgtctatctcgtggtagtcatggctcatgcccaaataactcgtgccgacaccgaccaacttggccagtcgaatcaacggacgggccagacgctcttcactctcggtaatctcactcatagccccagtctaacgccgtttgattgcgccacaccgtaagaaaaatgccatgattccgccaaattatgtactttttaccctcacatagtgagatgtgagcgctcacaatggtggacagggggtgattgccggccaaatttgcgcggcaaaacacagcaatagtgtgcttagcggcggctttccacggcgtgccgcacctcggccgaggggtcgttggccaatttggcaagcatcgcttcggacgtattggggttcagtgccacggcacggcggaccatcgaagaaagcaccgccggtgctccctcttcggattcggtgccaagtacgcccaagaaatccaatgtctccgcatccgcagtggggtcctgcgcaccctcaagccgcatcttccagctggtgcgcttgtttttcaacgccgtatcccggaccgcaggcaccgggtccttggtcagacggccgaccagccaattcttgtcgtccccgttggcggccacggcttgacgcacggacggttcggggtcttcggagagtttgaccaatacgttcgggaacggcatggtgtcggcgaggaacacacgatcggccaccggggtgtgcgggttgccggccacagcctccaaaagtgcggtggcgcgggagaacgccgcctgatcggcacggtcaggcaacggccgacgggcgaattcggacagttcggccgggtcggtggaatggcgcagacgctcgtatgtagcggtcagcggttcgaaatccaccggagcggcggactcggctgcggactgcgcgccttggtcctgctgctgggcgtccgtgtcggttgcagtctcggccgcggcctcggttgcggcctcggtgggctgggtctgctggctggtggtgttctcgtcggtcatgatgcccagcttagtcatacaggcgtcacgcgagcggaaccggaatgttgaccatgtcaatcggagccggcaccacagcggcattgaacgcttcccgcacacgctcctcgaatcgcgcgcaatcatcctgcggcaccaccgcggtcaactcgacgttcaccgcatacgattcatcctcctgactgccaccaagctgcgccaggatctgctggaatcgggccaactgcgggtattcgaggcgaacccggtatcgcttggcggtcatgatgcgggcggcgcgggcggctttcatcgccaatgatgcggcggatgagtacgcgcggaccagcccaccggagcccagcagaataccaccgaaatatctggtgacggcaaccacgcaatcggtggtgcccgactgcttgagtacgtcgagaatcggcttgccggcggtaccggacggctcgccgtcatcgctcatgcgttcggacagtcgcccatccgcgcctccgcacacggcggcatacgccacgtgtcgggctttcggatgctgctcacggatcgcagccacgaacgcgagcgcctcgtcgagcgtatcgacatgggcggcgtcgccgataaattcggactttttttcgacgagcgaatcgtgggcaggatcgtcgggcgtgttgagaatcgtctgcatgagcgtgttccggtggtcgactggctgggtgttcgattgagcgcgaggctaggcagggctatcagcgttcggagacgacgacgttatagtcttcgccggcgaagtaggcggtcaggcaggcgatcatctggcgggtgagctccttgaacgcgccgtcggcacgccagccgacgtgcggggtcaggacgatgccgggcacatggcagatggcgtcgtcggcggtcagcggctcatggtcgaacacgtcgagtgcggcgggaacatcgcccttttgcagtcgggcaagcagcgcaccggattcgatgacttcggagcgggcggtgttgatgaacagggtgccgggcttcacatgcgcaaggttctcggcggtgacgatgccgcgcgtggcgttgttcagcggcagatggacggagatgacgtcgctggtttcgatgagcttgttgagatcgtcgaccggagtggcaccggagcgttcgaaatgctcgggcggcacatgcgaattccatgcggcgacctccatgccgagggcgcgggcgatgccggccacggtggagccgatgccgcccagtccgatgatgcccatgcgacggccggcgagttgcagtccatcgccgctggcccacgcccagttgccggccttgacgtccttatcgagttggccaacgcggcggatgagctcgaacagaagggcgaaggtgtgctcggccacggcgtgatcgccataatgttcggcgttgcagacgcggatcttcagctcgcgcgccttatcgagattgaggtagctggcgacgccggtaccgcagaacacgatgcacttgacgtgcccctgcccgctgatggtgcgcagcagatcgtccgaaatgtggtagccgcccaccagcagggcgtcggcatccttcagacgctcggctatggtcgcctcgtcggacgtgaattcctcgaacatacgcacgcgggcaacgtcgtggagcgcggggaactgggccttgatgggctcgatcatcgagtcaagcacggacggcatcacgacgaggggcagatcggtgcgttcgctttgggtttcgtaaatctcggtcatgggctccacattaggaggccggcgggaaaagcgtcaccttgcggcttcccctccttgagaccaagccgagcaactattgctttgccgcctgctcctgcgtgatgttccattccttgacgacgttctggtccgcgcccatcgaatagatgacatcccagatgcgttggcgtatctgagcgtcgtaggcttcgtcccaacatgtgactatgggatggtcgctggatatcgggcaccattggtagttgccttgatgcacgttggcggtgggcacccagtcgatgcggttgacgcgccacgaccccttgacgcccttcttgccggcgaactggatgcgtgcggtcacaccctggttgttgaccaaggtttccggcgtgttcgccgactcggtgacggcgttgcccagaccgtagataatccacgtgccgttatagttctcgatgggctgcgcacaatggcagccggcaccgtagataacgtcgaaggcaccagtgtcggcaagctcatgggcttccgaaatctgccaggaatcggcgtaatcaaggtattcctgcaccgagtgcatggcgatggccaccacatcggcaccttgctcgcgggccttgttggccttgtctaccgcgcgctggatgtcgctgccgtgattcgggtcgccgtcttcgcgcagacgatccacctgccagtcctcgtcggcggtcatgccgttgagggagaccgtgccggtgaccagacccagcttgccgccgccggtcggggaatcgatgactaacggtttggtggagtcggcttcggttttgtacgagccggtctgggcgatgccatcggcctcaagcgtgtcccacagacgggcgatgccatccgccccctgatcccaggaatggttggtggcgtgtgtgcaggcgttgtatcccacgttgcgggcggcatccgccacttccggcggaatgttgaagatcgggtacgcggcatatgggccgccgcgctgggcgatcggggtttcgaattcgcacacggcgatgtccgaagcctgaatgtactgcttcatcggcgcgaacagcgggtcgaagttgaaggcggtgccatccgtggcgttggggttcaggccttggaaatggctccacaatccctcatggaacaacaaatcgccgttgaccagcatggcgatgcagtccgtatccgggcaatccggtgaattgccgtgatgttcggtcaccggtttgggcgtgttcttcgctttattcaacgcgacgtccgacactccggcgcgtgcggggccattgccgtccgtgcgatgggttgcgaaccatgcgccgatgcccagcgtaacggcgagcgcgatcacgaacacgataatcagcgccgcacggttggttcgtgtcgagttggagcgatgttgcccctgcccagcgatatggctcatctttgcccacccttcggaactcttcttctctctctagggtaccgcccatctcagtcaaacactgcggggaggaaggcgatgggcaagcgattggacaagcgacataaaccggttaatcttcaatcaccattcacgaacaccacgcaaaagtctcacttagtggacatttttctttcgtcgctcggacttttcccgacgtgccgcactcgttcgcccactaaaatggcggtttggaggcggacggacaatggcgtacctccgactccgcttaccacaagcggagaccgcccgtcctcggttatttcaggagttacttaacccggagtttccggaaaacaaaaaagttccgagctttcacccggaaccttaatcggcggagtcagagggattcgaaccctcgagccgtttacacgactaacaccttagcagggtgcccctatcggccactcaggcatgactccacgttacgcaataatgcgcaacagcaaattactgtaccacgtcctgcggatacggcgtgccgaacgacacattattgaacgtccgcgggtgcggcgtcgccggagaacgtaacgataaccgcgcaaatcaccaacgccacaccgacgatttcaccaacgctgggaatctcgccgaacgccagtcccacggccaccgccatggcgggattgatggattgcattaccgaaaatgcgccggatgtggtgcgtcgcagcgtgatctgctccaccacatagggaatgaacgaggccatcagggaaatcacaaacagcagagccagcagcttcagcgagccgccgggctcaagcgcccacgtggcatcggccttggggtgaaccacatgagccacagccggcacgccaaggaacagggactggaccagccagccgatggtcacggcgatgcacagattatccagcgaattgccgccagccgccacgcgccggccggtgatgatatacatgccccacatcgacccgccgatcaaaatcgcaatcagaccatacaaaaacgtgccattgccggacggattggccaatgatatgccagctaacagcaccacaccgaccgccgcgataccgataccgacccgctcgcgccagcttttgccggtaatcaccgccaccgaaagcggtcccaaaaattcgatagacacggcaatgcccatatccatattgctgatggccacataaaacagggtattcatcagcaccagcgagcagccgagcagtacgaccagcccccagctgcgggcgtcgcggtgaaacagttgcgctcgcttcgccttgttccagggcctgcgccacagcagcaacagcaccgccatgaatcccacgcgataccacaccgagtacagcggatcgagctgggtgaacgcaagtttggcgacggccgtagccaaataaatcaccagtgcctcaccaatcacgataagaaccacgggaacacggttgaggataccgaccactgccttcttcatgaggtttacgctactcggagagccgggacagcgcgcattgacttggaaggcgttacggacagtgacgcaatgtggacgattccgtggaatcgcacccaccatgcgaaacagccgcacagtgcgtaaacccttggaattccggcgatattcggcattatgacaatgagcgccgcgtcatgcgcgccacatagtgagcatgacctcgttcggcattcctacaatggtggcatgagcaccgcaccgagacttgaggccgccaaacgcgattggggccacgacgagaccggatgcaccgtgctgcatatcgacatggatgccttctatgcctcattggaggtggcgcgcaaccccgggctcaaaggcaagccggtaatcatcggcaccgggccgcgcgcggtggtgtccgccgcgagctacgaagcccggaaatacggcatcaattcggcgatgccggccgcgcgcgcccatcggttgtgcccgaacggcatttttctgccagtggatatggcgtattaccgcatgatgtcgcaccgaatcatgcatgaggtgtttttgaccgtcaccgaccggttcgagcaggtttcggtggacgagggctatatggatgtgtccgccgcactgctggagtgggggcggccgagcgcgatcggcgcgtggattcgcgctcaggtggccgagcgcttccacgtgacgtgttcagtgggtatcgcctgtaacaaactggtgtccaaaatggcctcgaccaatgccaagccggacggcatgctgctgattcccgcggcccgctcggccgaattcgtgcagatgatgccattgcgtggtattccgggaatcgggccgtctttggagaagcggcttaatgcttggggcgtgcattcggtggctgaattggctcagctggatgaggctgcattgactcgtgccactggctccccggctgcggcacgtggattatgggcggcctcgcacgggttggattcccgcgaaattaccacggtacgcgaggagaaatccattgggtccgaggaaaccttggccgaggatacacgcgatatgcgcgtggtgtgtgggctactgcgttcggcctgcgacgaagtaaccagcacgctgcggcgcaaggggctggtggcgcgcacgctgacggtgaagttgcggttcgccgacctgagctatcagacccggtcttttacgatggagcggccgaccgatacggccggcgtgctgtacccggaatgcgtgcggcagctgaaagtcatgctggggctaccggcctcggcggagtctgccactcccctgcccaaaactattcgcttggccggtatgagcacgtcttcgctcagtaaggcggcggctacggccgtgcagccttcactggatgacatgctcgaagaggccgacaatgcccgcggccagacctcacaggcgcgtttgcatgatgccgaggccgcactggacgctgtgcgccgcaaattcggcaacaaggccgcccagtttggggcgtgaacggctcaacgccacttacgatctcattacgccgtgagacgttcgcaggcggaacggatggcctcgtcggtggcggtggcggagaaacgcaggtaggcgggagcgccgtagaattcgccggggctggggatgatgccgatcttggcgagctcggccatatcggcccagcagtcgccggacttggccttgacccatacgtacagcgcgccggagggcatttgtgccgaatagccatatgccttcagtgcgtcaaccagcgcggataggcggcgacggtaacgcctccattgctcgtgcacagcggctgtgtccttcaggcctgcggccatggcggcctgcactgggccagggataatctggccgatctgcttgcggtattcggccatttccttgaccagccggtaatcgccggcaattagagccgtacggtagccggccatgttggactgcttggacagcgagtagagcaccaggatgccagctgccgaaccttcacacacatgtggattcagggcacatggcgtggcggagagactgaatgcggtatcggaggcgggctcgttggattcggccaccggtgcggcaggcacagacgcagcagatgcagacgcggcaggcgcagaggacgcggctgtattgcggcgcaccgaacgccagtccattaacgcatagcattcgtcggagagcaccacggcaccgatgcgacgggcagcagccacgatgtcggtcagccagtcagcggagatgacctcgccggagggattacacggcgagttgatccagatggccttgacgttcggaatattcacccaggaatcgacgtcggtcacatcatcgactttgaccacggtggcgccggcaagttgggtaccgatttcgtaagtcgggtaggagacagccggttggacgaccacatcgccttcgccaaggtgcagcaggctggccatcagcgccacggcctccttggaacccacggtgggtacggcggcagcgttgatggatttcagatccaccccgcgcagttcgcggaaccatgtatcgatagcggccttaaggtcggcggtgccggcggtgaccgggtatccatgggcgttgggggcgtctgcgccggcaaccagcgcctgctggacactgctcggcaccgggtccacaggcgagcctacggacaggtcgatcatgccacccggcacggttttggcggtggctttgaagccggcgatacgagaccagtcgtatggcgacgaatatgcgtggaagcccatgagaacccctttcttggacggtatgttcctaagatacgacgaaccctcggccgtgatagaccgagggttcaatccgaactatgcgctgtgtgcagcgcttatccgcaaatcagcttactggttctgcggcggcagcgcggcgacctgttccgggtctttgccgattggaccattggcggaagcgccgcccaaatcgccgacttcagcgaagaagttgacagcggcatccttgtaccaagcccactcgtccggcagatcatcctcatagaagatggcctcggtgggacacaccggttcgcatgcaccgcagtcgacgcactcgttggggttgatgtacagcgagcgggaaccctcgtaaatgcagtcgacggggcactcgtccacgcaagccttgtccttgacatccacgcaaggctgagcgattacatatggcatggaatcctccttaacaaatactgatacaagggtacgcgcctgttgggacgctcctcgctctcagccgttaacggccttatcggtttcggcggacagcgtttcggtcaggtcgcccttgccgaggcgcgcatgccagtagccgtagccgaagtagatggcgaagccgaccacgagccacaccacgaaacgaatccaggtgagcacggacaggttgagcatcaaccagaagttggccacggcgatgaggatcggaatccacgggctgccgggcatcttgaaggcgcgcggcaggtcggggcgcttcttgcgcataatcgggatggagatggccaccagcgtgaaggcggacagggtgccgatgttgaccatgtcggagagcacgccgatgtcgaagaaggcggccacgagcgccaccaccgcgccgacgacgatctgcagagcggccggggtgccatgcttgccggtcttggacaggccgcgcggcagcagaccatcgcggctcatggcgaagacgatacgggtcaggccgagcaacagcaccataaccacggtggccaggcccagcacgatgccgaagctgatgatcttggcggcccagtcggcgcccaccagttcgaaggcggtggccagcgaggggctgtcttgcttggcgagatcggcataggagaccatgccggtggtcaccacggccacgagcatgtacatgacaatgatgagcagcatgcccacgccgatgccgagcggcacgttcttgtgcgggttcttggtctcctcagaggcggtggccaccacgtcgaatccgatgaacgcgaagaacacgagcgccgcgcccgagaggatgccaggaacgccgtacacggatggggtcatgccggtggcgaactgccacaacggctgggtcatcacgccggtgacggcggaggagccttccacggtggaggccggctggctcggcggaatgaacggggtgaagttggaggccttgacgtagaagaagccgacgatcaccacaaagaacacgatggcgatcttgagcacggtcatagcaccgtccacgcgggcgccgatcttggtgccgaatacgagcagcgtggtaaagaacgccacgatgataatcggggcgatatcgatgtggaaggagccgaacgtcaggttggtgttggcgttccagcccatcaggcgcatgaaatcgttgaggtatacgccccaatatttggaaatcacggagccggccatcagcatttccaggatcagatcccagccgatgatccaggccatgatctcgccgaccgtggtgtaggtgaaggtgtaggcggagccggccaccggaatcatcgaagcgaattcggcgtagcacatcacggctgcgccgcacacgatgccggcgatcaggaagctgatgatcacggccgggccggcgtggaaggcggcggcctgcgcgcccaccgagaagatgccggcgcccacggctacggccacacccatgattgacagatcccaccaagtcaggttgcgcttgagcttgcggccctcttcaccggtttcggcaatggtctgttcgacggattttgtacggaacagttgcatagtgctcttcttttttctctgttgtttgcgcaccgaatgcgcacaataccgacaatcgagtatagaagagcccgcgtgtcttgtctattaataagactcagagtccgcaatatatgggattaataacccactccatcaatcaatagcgcgattacagcacaccgacgcagaccggttcgggcaccaagtccactccgaacgcgctcttgactgcctgctgaaccgcacgcgccaaagctgcgatatcggccgcgctcgctcccccacgattggtcaaggccagcgtgtgctgcgtggatagactggccggcgcgtccgcatcgaccttatatcccttatggcagccggcatggtcgatgagccaggcggcggacgtcttggtgccgggagtgccgtcaggcagagtcgcgtcgaacttcggcgcatcttcgggcagggccgccgcttggtcggcggtcagaatcggattcataaagaacgagccgcagctgtggcgattgtagtcgggagcaggcagaccgtcatcgccaacgggaatgccggcggcctcattgagggaggccagacgctccagatcggtcaggatattggcctcgcgcttggcggtggccatgtcaggcaaggcgtagcgagtagggtcctcgagcatgcccttggcggcacgtactgcgagcacggctttgcggatgtcggcggtggccatacggtcgcccacttcgacgccaagcgctttggcaagctgtccgtaacctaccgtgccttcggccgagtgggtcagggcaaaggtgacggaaagcaccacgtaacgtggcgtcgggaagaatcggccggccggccggccggggccggcgtacatgctggtcttcagtgcggagtatcgatagccgaatcgaagatcggcgggtgtgaggtcgcgcgttgttttggtgtctcgatcccagacttccaccgattcgaccgaagtggcgacttcctgcccgtaggcaccgatgttctgcaccacggaagcgccgactgtgccgggaatgccggacagtccctcgacgccctcgagcccgagctctacggtgaaggccacgaaatcatcccaattggcaccggcctcggcattgacatgcacggtgcgatcctcgccctctaccggtgcagcctcgtccggcacagtgatgaggcgtcgggcgtctcgaaccaccacgccgtcaaaaggcttatcggaaacaagcaggttggagccgccaccgacgacgaccaagggcaggcctttggaatcggcttcctccacggcttcgatgagtcccacgcgcgtggtcggctcgatgaaatgggcgatggggccgcccacgcccatggtggtgatgtctgcaaagcttgtcatggcttactatcttagtggcgcaggtgcgatatcgaggcaatcatcggctgaaacggcagaacgcccgcgtctgaacgaaggtggcgcgggatttctgccgttttggcggcccgaaacgacagaacgcccgcgaggggttcgttcagacgcgggatttctgccgtttctcacgcgatgcggatactgattccgcaccctgccactcgcctccggaggcaatacgcaaaaacccggccgaatgggccgggttttgtaaagctgtgatacttgcgatcaacgagtctcgcggtgcacggtctgcttgccgcagcgcgggcagaacttcttgagctcaagacggtcgggcgtgttacgacggttcttagtcgtaatgtagttacgctccttgcactcggtgcaggccagcgtgatgcccggacggatgtcggcgctcttagccattgtcattcacctctgtgttcttaggtatagtgcgcgcccaccggttagcgggcgcgatttgtagcgaggaagaggctcgaactcttgaccttacgattatgagtcgtacgctctagccagctgagctaccccgccagagagccccgagtgagaattggactcacgacctcttccttaccaaggaagtgctctaccactgagctatcggggcgtggcggatagtggattcgaaccactgaagcacgaagcggctgatttacagtcagctccctttgaccgcttgggaaatccgccagtctgtttcccgccgcggtgtttgacctcaacaggcaacttggctatataaccacagattttccaggtatgcaaatcggcccctacgcgaaccttgttttaccgcggaattctgcggttttatcggcgtgtctcacagcgtgttttcagggcccgcttcggccctgcaaacagccccgaccaaggctgcaccccgcacttcacccaatcattttttcttatatggtgctctagaaccttgcaatggcgcggttttcaagcgatgtcgcctgtttgcgcggcacggcgcatgctggcatgctgggcgcatggcttctgatcttgtacatcacggacaatcattcgacgaccagccgctcggattcggcacgctggccattcacctcggtaacggggtcgacgccgaaaccggcgcgatccgtcgccccatcacgctggcgaacgcctacgcgctgccctacgacgcctcggccttggcgattgccaagcatctcgaatcgctggatgtggtgcgtttcgtggcgtaccccggtctggaatcgcatctgcaccacaaggtggcggccagccagctggcccgcccggactccgggttcggcggcgtgctgtcgtttggcctcgacaccgaccacgacgggcacacccgattcgtttccaagctcaatgtgattacgtctgccgtctcgctcggccatgactaatcgctgatcgtgttcctcggtgaggatgacgagcgccagtacctgtacccgcctgagttccaccgcggcttcttccgtctggccgtgggtctggaggatacggacgatttgattcgcgacatcgatcacgcgctggtggaggccggattcgaggtgtgagaccgcaccgcgcgcatgatttcggcctcttccgccctgctgccgccgtcagtgagtcacaagatggctcggtgacgacgatggcagggctttttacgtcagcacagggacaatacctggcggtctgccgacgatgacggcacttatcgtcggcagaccgccagtttttggaccgtcgccgacacaaaacgccgatttgccgtcggcaatggtccaaaaactggccctataacgacgccaacgcggctcagcatcggcgcatcgccatttcgtggcccactgccgacgctggcctcatgccacggcactcagcgtcggtagagagacaaccattggcacagcgacgacaccacgaacctgcgacacggaaaaaaacaacataccgtcgacctactgccgtcttgtgcaaaatgtcttaagccgctcggccaagtcgccaactgagcctcttccatagggaccccaatccgttacccagtgtagatgcggtgcaacgccgaactcaactacgttgcgcgcatgcacctttatgcatagcaggcatggctgggcgtttggtgggagcagctttcggctcccctctctgagggggagcccctttccgcctagcaagagaaaaccccgactatccgcgggaacagtcggggttgttgaagttcgctaggcgactaatcagccgaggatggcgagaatgtcgcgggcgccgacgatgaggtagtcctcaccctcgtaatggacttcggtgccgccgtacttggagtacagcaccttgtcgccgaccttgacatccatcgggatgcgctcgcccttgtcgtcacgacggcccgggccaacggccaggacttcaccctgctgaggcttctccttggcattgtccggaatgtacagaccggaagcggtctgggtctgggcctcggcctgcttgacgatgatcttgtcttccaacggtgtgagcttaatcgacactgtgggtcacctcgtatctacttgtagttcgataatgccgcgccagaacgcctcaagaggctgacgatcacttgcgttgtccctttgcgctaggacacatcgtagcgcgattattagcactctgccaactcgagtgctaacgctgtgagagaaaatcgtcgaatcgcaacgctcagttgccgcggcgggcaagaatggagtccaggcctgcgcccaacgaatcggtggtcgccgctggcgcttcgacgtcggcacgctcctcggattcgtggaatgcggctcgctgggcggcgtttgcagcctcgtcatcggcgtccgtatcggcatcatcgcgctgctccggctcagtgtctacagcgtttccggcgctgacagccttggcgtcgtccgcggccttgacggctcgggcctcgtcaatcaacttttccgccactgcgggttcgacaggttccgccttggacacctgacgggtcgacttgatctccaagctttccggagcgttgtcggcgttatgttccccacccaaagtgaaggagatgagatcctgcgaggtggacatatcgaagacgtccagtgctcgggcagggcgtacgctgaccagttccgacgtggcatcggcagcggcagcggcatcgtcgcgctcatcgcgctcgtcacgcaccgtaagcgatggttcaactcgaggggcgacggacttgtccgactcaatcgacttgtctgtgcgaacggaggcatcaggtgtggcggaagattcgctggtttcggcagcggacttacggtcggcggattcatcgaccatagcagacggctcggcggcaggcttatcggcggcggactgtgcaatatcagacttctcagactgtttggcgtgctcttccgcggcctgatatgcggcggcggactgacgcaacgccttggccttggcctgctcaatctcggcatcgcgtaacgcgcggcgaatctgccgctgttccatgacctcggtggcagcatcctcaatctgctcggcaggcttctcggcaggcgcagttacggccgcaaccggttcggccttgttcacacgcttgctgtccttggactcggcagacggtttcttggaccagcccgtaccgctatgagcccgctcgtagcggaccaccttgcgctcccattgccgggcctggcgtgaggcattggctcccagcaccagcaccagcagcaacagcacgaacggaataagagcaagcagcggactgaaatgcagggggaacgatacggcaaacaccaacacggttatggcaagcaggcatacggcgagaatctgccggcggcggatggccgcgcggcgcagttcccgcacatgggcgatgtgctcagatgtcagcctcgctgacggtgttgatgctggcattgctgcccctttcgccttatgcggcttgatgtctccgaatcgtctgccgttctctgcatcaacgatatgcagggaaggcgaataacgatcctgccggtgctcgtccacacgtttcatgccgttggccgtacgtacgggcagccatacaacgataataatcgccacaatcaccagcacgacgacagtgctcagtgactcataacccatagagtcaaggataggagacgtgccgacgaactggggctttccgtccgggcgtgtcggagcggaattcttccggtcgacgcttatctggaaccggcggcggcgagtctagcggcgaacccttgccccatatcttcagccaacagcgcaaacgttacgtggtcacgccactggccattgacatacatataccgctcgcgcagtccctcatgatgggctccgaccttacgcaccacagccaaagaacgcgcattatccggcagaatggcgatttccagccgatgcaacgcgggcccgaatgggtctccgagcgcccaatcggcaagcatggccagtgccattggcgcgaatccgcggccggcgcaccgttgatcgacccaataaccaaccacgccggtacgcatggcaccatacacgatggctcccaacgaaatctggccgacgatacgcatctggtattcgatggcgaagatcacgccgacgccatgctgctcgttacggcgctgccgctgcacccattgattgaatgtgatggagccgccatgcatcgggtcaccggattcccaaggtgccagccagtcgttgttgcgccagcgcacttcgttccagccgtcctcatcatccatggtcaggggcgcaggactatcggaaaaccgggatgggtgagacgtggcgggcggatctggtggtccagcttgaacgcctctttaatcgactggaaaactgacacggcctttattgtagccatatgaaggtcttgcgccgctaccgtggccactttcgttttacgatggaaacactagattgtgcggtatgagcgaagtgggcagtggcatgaatatcggcagcgactacagcggcacagagaaaacagagaagacggataaagcgacgctgcgccaccatatactgtctcggcgcaagcgcgttccagcggaagaacgcggagcggccggtgaattgctggtgcgacggttcccagcacacatgattcaggatggtcccacagtggcggcatatgtgtcgatgggttcggaaatcgaaacccggccactgttgcgatggctgcgggctcatggctgccacgtgttggtgccaaggttggggtctgggttggaaattggctggagtgtgctggattcattggaatcattgcgctcgatggatgcagtgggtggcgcgaacaatgccggtagctgcagctctcccagcaccgtccatcacagacccgatgagccaactggcgcagttctaccgcccgaagcgttggagaaggccgatctggtcatcgctccggctttggcagtggacccgcagggcaatcgtctggggcgtggagccggctggtatgaccgggccttggctcgccgcaagcccgcatgtcccctgattgcggtgtgctggccgtgggaggtgttggacattgatttgccggccgaaccacatgatgtgccggccgacggagtgctgacgccggagggataccggcggcttagctcatcgggcctgttgagctggccggccggccaagatactcggcgcaagccagactgaccaaccagccacgcacactggccgatggaaccagagtggcaacagcaagctggctagtaagaccgtaacgccaatgtgtcagggcggcgactaggatatgaacggttgcgtggcatggcgtttgggccatccgcgagaaatatgactttgttggaggaatccgttgcctacctatcattaccgttgcaagaactgcggctatgacttcaccgaacagcagtcgttcaatgacgacccgattaccgtgtgccccaagtgctcgcaggagcaggtgcgcaaggtgtattccgccgtgccgattgagttcaagggtcacggcttctaccgcaccgacaaatccggcaagtaaggtctgtacacccgcttttcctctgtaaacgacggtgtcgacggcggtatgccgcggatattggcactacgggcactgtctgttgcacgggtttgaagcgttgtggataacttggcaagctagaaccacataggtcgatttggcttgcgcttacgaaaaacttcaggtcaccatggttgcatggtgaccttttcgtttattaagccgcctgcgcgcggctcattgcggcgacggcgcatggcggatgccttgcgccgactcactgctgcgttgtgcgtgggactcgcagtgctgtttgggattgaagccgtattggccgtggtggagaccgagccgatggtggtggccgcccgctcgattcgacggggtgacattattctggccgccgacgttcagttggctgatatgccggtatctgcggcaggcccgtcttggacaggcaatattgaggatgtggtgggcaaggtagcgcaaatcgatatcgaagcagccgatcccatttccacgcatatggccagagatgcgcccgtagcaccgaccggcactacggtgattgaagtccgcttggccagtagcgtcgacgatgtattggccggcgatcaggtgagactggtttccgccgtcggttgcgaaggcgctgattgcacgctggccgagaacgccacggtgatgaatgtcggcaaaccggatgcgattggtgcattgggaggcaacgaccgactggtgtcgttcgcaatgccgccggaggccgcggccaaggttatggagctgcaacaggccggagcgattatggccgttgtgcggtaggaagcggaatcggccttcggccgatactgtgttttccgcagccgacaggctgcggaaaacacagtgttggggcgcacagagtgcgccccaactcctactcgcgctcgttaaaaacggcccaatgcggcggcagttcgccgaggatgcgtttgtcgtcgtcggattgccgttgttggtcggtctgcatgtctccgggctcgagtttgacaccgtcagcgtcaaactgctcagtgcccttcatcaccacgcgcttgtgcttgcgcggtgtgcgccgtgtagccgagtattccgccatggttattcaacctcgcgatagatctcaccgatacggctgacgatacggtcgacttccttatcggggtttacgaaggcggcgacactccagacggtcatcacattccagcccaaggaaatgagatcctgtgccgacaaacgatgacgcctacgcgtggattgcacggacataaagttcgcgtcatcggtctgcacggccaaggcaaacggcttgtccttcaatcccaccacgagcggaatcttcacgcccttgtcgaatccataatcaacagcagcgttcagtcctcgcgcgcgcaacctgtcggcgatatcgtcgaacagcacgttgccgcctgccgcatcacgcaacggaagcaccggacggtcgtcaagctgttcggcccacgtcaacatggtcttcaggaaccgaggaccggactggtgcagtcgttcttcatccaaatcttcggaaccaaaggccgacacaatatccaagctgtggtccgccaatgccagggcatccagcaacagtccgcgaccgcctgtgctttcgagcggaccgaactgctgaagcagacgtccgtgcgtggttttcgcatagcacatcgacagaatcacgtcagtggcacgacctccggccacgtcacgcaaggaaaccaaccgcacatggcgcaggaatcggcccatcgccttggatttgcctgccaacgacttcaattcggcacccaagcgtgtgcggaatgcgtcggtcaacatcacgaccacaagtcgatagctggaaggaaccacggcaaaaccggcggcacgttgcgtaatcagacgcaccacttcatcaatctccggctggctggattccaccagaccagaagacataaccggcacaccgctcgcttccacacggtggaatcgcacctcaccggcagccggctcggtggccacatcatagcgaacaggaccatatccctcggattcaaggaatgcggacaggcgcggcgcacggcgagacggggcagcatccacctcgatatgaggcaacgtgtcgatcagctgcttgacgctttcgctggttaccgtcgcgcagtgggcgatcaccaccacctgctgcacgcggccgatgatggacagcaactcgatagcgggaatgtgcgcgcacgcatcgagaatcgccacatcagccagcacacccggctcggtgagtgcggcgagcgtacccggcgcggccaccagaatcggcttggccgcggccagaatctccggatgatcacggcgaatcctgctcagcgacacactggcgcgccctgccagcacggtgtgcatctggttggcttcctgagtgcgggagaacagcatgtcgcacaggcggcgcatggattcctgcgacaccatcggtccgatggagcgcacgtgctccacatcgacctgcgcaaagcggtcggatgcggcctgcagcgcggcaccatcctggttggagatgatggcggacgaacgcacaatgtcctcaaacacggtggtccaccaggccagctgcacttcgccgcgcacctgctccacgctcactcggcgagcgttgagatcggcgaccagttcgttcagtccggcagaggcgaattcctgctccagcaggcaacgctccggcaaggtgtccagtgccttgcgatcatccagcagtgctttcaggcgtgcttccaccttctcgaaatcggcggtttccagattgccaccagcgggtgtggtggaaagcacggtatccagcgcggtcatattgctgaccagcgcctcttgggtggagatgatctcgtcgagcttgctgggcagcaccggccaaccgccgtgaggcacgaactgatgccactgctccccttgcttggcgactaccttcaacgcttcgtgcaagtcctcgacctgcgcgccgacgcgcagcagatccttggcttccttgatgtggcggcggcgctcccagaatcccatcgacgtgccctcggccttgcgctggctcttcggcttggtggcctcgatcatggagctgatgtctcgctcgaaaatctccggctggaacacgtcaagcactcgtcgcagattcttcaaaaccgtaacctgacgctcccactcgcgggtggtgggaggaaccgggaatccgcaggtctgcacggtgcgtgccacctgctcacgggtggcgggcaggaagcgacgcagcaaatcgtccacgcgctggtaggcggttactgcctgttcttcagtggtgatggacgccttgtaccatgcggtgtcttccgggccgatggtgtattcgccgagctcgccggcgcgttccatcttgccgatccatgtgtcaatatcgttggcgatgctcagggcacttgactcgtcaagtcgaacgtgggtggcagggtgcgtcgggagcacggagatacgggccagattctgaatggtctcgtatgcggacacattccacttatcattgcccccgtgcaggtcgcccagatagcgggtcaagcgcgagcgcacgcccacgagttcgtcggccaactggtcgaatcgctgggtggcgactcccggttggaatccgactgcggcaatcagctgcttatcaagcgcggcgttggcgtgttcatcggatacatccagtacctgcgccttcatctcattggcggaagccgtctggatgaacagacgcttctgctcggccacgccgggcacgtacagcacggaacgaccattcatcaggcagcgcgatgcgatggccacagcctgctccgcggtgcccttcgggaaggtgccgtcgaccacgatgctatggccattggcagcaagtgacgcggcatatcgcaccgtattgtccacatcgccgacttcgtactcggcatgcgggtctacgtcgaaaggactgtattgcggaatattggcatctttgagcgcggtgcgggcggattcgtcgccggcaagcgcgtccaacagcacattgccggtggggccgttctccagctggtcgatgaactgtcggctttcgctgatcatctgcgacgaggggtccatgaagcatccgagcacaatctggcgctcgatggcgaagtcggagatacgctccgacgcttcggacgaaatacgggcgaacatcgcggaagtttcgggagtgccactgtcatagctggcaccgtcaaacagggaatcctcatccaggaacaccccctgctcacgcaatgtattgacgaacgcgacgttcagggccacgcgaccggtgaatcgaatggtggtcgacaagccatcatcctcgatcgtgacgctcaccgggtacaacagcaccggcagcgcgttgcccttccatgtggccacgccgaccacgagcgacaactccgccacgccggaaatcctgcgtttggcggcctggtcatccagcacgcgcccaatatggcgttcggcggccttaagcacacccgtgtcgcggaacaacgaatccaaccggacatggccggaagcgaacagctgggcgatgccggagggatgggcatgggtcatctccagcttcgcggccagttgattcacatcctcgagcggcgatggcggctgcatgctgcggtattggtcacgccagcgacggatgcgattcagaccttccgtgagattctggttctgagtctggctctgggtcatctctcgactcactttccaaccgcttcgcggtattcctgatagcccttgttgtgagacagggcttcgtcaatatcggcctcgccacgggcggcgagccaagaatacatgtcgtcgtacaggtacggattcatggcgaggaacgccagcaattcgggatgacgggcgacttcgaattgaacattgaaatcttgcgtggtttttgcctcgtcagaggtcaggccatcgacttcgactgccggctcctgtgctttcagctcgcccttggccacacgctcgaacaccgagccgggctcgaagaccggagtgtgtacgcccgtggagtcgatatcatatgcttcggataccgactgctgggcggtttcggcagccggctgctggtctgctacgcctgctgcggtggcttcttgatatgcttcggctgcggtccgctgctgatcgtccggtacgtcagctgccggctggtcggtttcagactgggcggttgccggctgagcggtctcaggctgggtgttttcagattgagcggcttcggcttcccgggcggcttcaggctgggcaacttcagcatgctgttcgacagtgtccgccggctgagaatcgccggcattcctggtattcggagcggactgaacgttttcggctgacttgcttgcgccagccaccacatcggattcaacaaccgccgccgacgccactgccggctcgcttgtgctgggagcgtgcttaacaacggcatgggcgatggcatctactggaacaataccggagatcctgctgtgcttggatgcaggcgttacaatcgtcgactcaggttcggtctgctgcttcggcagtgccacggagttcatggcctgctggtttttgcgttcggtctcctgctcggcatgctgggccaacgcatccgcgaacagatcacggggtatggccggctcatcgtttttcgtcactggctgcgtgatattcagcgagccaagttcaagctcgtcgaccttgcgtcgaacattatccgcgctgaagatggcggtcggctcgccggcccgtaaatcaagaatatcgtcgacggacatatccgccgcatccggctcctgcggtgcttcgtgaaccgcatagccaaacaaatcaggcaccttgaggtcgagcggctttgccactggatcgtcgacacgaatgaagtccgcaggcacatcgccgaactgcatgcgcatgggagacgtcggcaacaggaactcggcattggccggcaagcgcaacaaatcgccattttcccgcaccacatacgatccattggtcgatccaagatcacggaccgaggccgtgccattgctttttaccgtgaacatggcgtgccgtttggacatcgatttggtttgatcggcgacgtcaaggcgggtgttgccatcatcggcaaggggcgtaacggcttacggccgatttccacgcactcccccggcttgacgctgatccggtcgacaccgttgatcttcaccgtccactcgctcaccgtgaccgccttcctggacacactatttgaccacactacgtgccattgtgtcatcttttaccggcttttggcggattactgggcacagaattgacaactttcgctcattgccagctttgtgtttccacgccggatcgcgttctccgcctcgtcctcgtcaactagtctactcagtatgcggaaaccccgcagcctgaaacacaggtgcggggttcctcgaaaagctgtgattgcggcttatgccgcacaaatcacttgagctcgacgctggcgccagcctcttccagctgagccttggccttctcggcatcttccttcttggccttctcgaggacggccttcggagcgccgtcgacaagagccttggcctcggccaggccgaggttggtgatggcgcggacagccttgatgacctggatcttcttgtcgccgacggcggagaggatgacgtcgaactcatccttctcttcctcagccggagcagcagcgccagcaacagcggcaacagcggcaaccggagcggcagcctcgacgtcgaacttctcctcgaaggccttcacgaactcggagagctcgaccagggtcatctcgccgaaggcttccagcagctcatcgttggtgtacttagccattatggcttcctttcaatcttggcggcggacgaagtggtagatccgctgcctaataaaccttattgtttaaattatcgaagcgactgattcatgccgtgagggcgtaaatcaggcagccttctcctgcttttcgcgcagggcgtcgatcgtgcgcacagccttggtaggcagagcgttgaacaggtacgcggccttggccatcgatgccttgatgtcgccggcgaattcggcaagcagctgcgggcgggacttgaggtctgccagcttcttggcgccctcggcatcgtagacagtgccgtcagcggcggcacccttgatgacaagagccttgttgtccttggcgaagtcacggatgaccttcgcagcctcgatgaagtcgcccttcacgaaggtgatggcggtcgggccggagagaatctcgtcgagaccctcaatgcccgcttccttggcggcgatgcgtgccagcgtgttctttgccacggtgtaggaagtatcgcggcctagcttttcacgcagatcggaaatctgcggaacggtaagcccgcggtactcggtcaggtagacggcgtcagcgttacggaattcttccgtaagctgagcgactaccgcttccttttcgggcctcttcatggcgttccttcctaagtcggccgttgacttggagttcggaactttcggccgggcaacaaaaaagccctgcgcacaggcagagcaatataatctcgcgaagcgaccttcgccggcccttgacgggcttatatctctcaacctgcgctggcttggcgaaccaaacttcggaaatgcactcgcgcgcacttcaaccaacggtctgtggtttacggatgattagattacggatggtcagcgacattgcagaattcgggcgtgtcgcggggcattacagcgtggcggcgtactgggctacggacgcggtgacttccttcagatagtcgagcgagcgacgccagtggccgggcacctcgatcgaatggttggcatccgggtattcgtgcacgtgcggggtgagcgcgttggcgcgggcttgatcgtagaacgggtcggcggtgccggcgcagatcagcggtgccgggccggagtatcgggagctggcggcgtgcgactggccggcctgttccgcgcggatgatcgcccttgcttcggccacgctcggggcctcggattcggcgacgatatcatcgccgacagccggcaccggaatcacccgggcggatggatcgaagtcggcgtgatgcagcaccggggtcagcagcacgaacggcagaccgtagtgtgaggccacatgtgggtaggtcatcgtcgtcagcgacttgccgatcagcaacaggcgagggccggacggggtgtcggaatcacggttcggcgagccagctgcgccatcggccagcacggtagcagaatcatcggcggcaacgccatccccggaatcaccggctttacccgcgccggactcgcgcgcggcggccacccagccgtcaatcgcctgattgaggaccggaatcaccgtggacaggtcgtcggaagcgttgcgtacgttcatgcggtcgattcgccagccggcctcgaccagagcctgggccgaccagtagagcagcggacggtcgcagttgtagccggtgccgggcatcagcagtacgcggccgtactcctgaccgggcttgacgacattcttcttccaagaggtgatgctgacttcgacggccggtttcatcgcgcgccttccttccacgggtgtgtcctgcgtgtccccctgagttgttccgaattattctggcagtcagtctactcccggacccgttcacgttgcctccacaagctataatcggccacggttctgattgggtgcgcagcgcctgacgcgcgttgggcaggccgatcagggcgagtcgcaattctcgccggggccagccgcagcattatgcacgcggtgcgcagccccgcataaacccaaggaagtagagagtaaatggagaagttcttccatttgaaggaaaacggcacgaccgtctcgactgagattctggccggcctgaccacgttcttcgcgatggcttacatcatcgtcgtcaacccgcagatcctgtcgcagacgggtatgccgtggggcggcgtgttcctggccaccatcatcgcggccatcatcggcaccctggtcatgggcctgttcgccaacgtgccgtacgcccaggccgccggcatgggcctcaacgcgttcttcacctacaccgtgtgcttcggcctcggcttcagctggcagcagaccatgtgcatggtgttcctgtgcggcctgatcaacatcctcatcaccgtcaccaagatccgcaagatgatcatcctggccatcccggagtccctgcaacacgccatcggcggcggcatcggcctgttcgtggcctacgtgggcatgctgaacgtcggcctgatcaagttcactcccggcgatccgaaggccgccgccaagggcggtgccgttgcggctaccccgggtctggccaacttcaacgacaaggtgctgtgggtcttcctgatcggcctcgtactggccattgtgttcaccgtgatgaaggttaagggcggcatgctgctggccatcgccatcaccaccgtaatcggcatcccgttcggcgtgaccacctggtccaactcgcagtccatcagcgagaccttctcccagctgccgcagaccttcggcgcgatcttctccgccgagggcttcccggcactgttctctgatccgaccaagctgccgctggtcatcgtgaccatcttcgccttctccatgtccgatacgttcgacaccctgggcactttcatcggcaccggccgccgcaccggcatcttctccgccgaggatgagaaggctctggagaacggccacggcttctcctccaagatggacaaggccctgttcgccgactccatcgccacctccatcggcgccatctgcggcacctcgaacaccaccacctacgtcgagtcttccgccggcatcgccgcaggcggccgaaccggcctgacctccgtggttgtggcgatctgcttcgccttgtccgcgttcctggccccggtcgtctccgccgtgccgtccgccgcaaccgccggcgtgctggtgatcgtcggctgcatgatggccgcttccctgaaggaagtcaagtgggacgacatcgccgaagccattccggcgttcttcgccgccgtgttcatggccttctcctactccatctcctacggcatcgccggaggcttcatcatgtactgcatcgtgaagacctgcaagggcaaggccaaggaggttcacccgatcatctggactgtggccgcgctgttcattctggacttcgtgtgcatggcgattctgtaacgctgattgacaacggattagcctttaaggattaatccgccgccatacggcataaaggccgggctctcacaagggcccggcctttgttgttgccacagtgatcaacgcccatgagtaccttcgatgatcatccgccattcttgatgcatgggaatagttgtcaaccgacaactaaacgtacatggcggcagcacgagtgccttattcaacatcgaaatatgcagcgcgaagaagccgaaaaaccaaaaaggcttctataccgaatgaaacggtatagaagccttttggtttgcgatcaagcccttctcgcccgagagaagctagagaacgatcagtcctcgaatgccgaaccgttaagcgggaagccctacgggcttcccgtaggtgagggagcggctatgccgcgaccgatccgtgagagggctttagtcctcgaacggatcaaagtcgcgacggacgcggcgacgcgggcgctcagtacgctcttcgcggtcggcgcggtagtcgtcgtagttgtcgtcggtggcgtagcgcgggttacggtccgagccacggccacggccacgggaaccgccacggcggtcatcacgatcgccacggtcatcgcgatcggaagagcgacggcgacgcggacgatcatcatcacgggagtcgcgagcatcacggtcatcgcgatcgtcgaagtcacggtcggcagaacgacggcgacgcggacgatcatcatcgcgatcatcgcgatcgaagtcacggtcatcggagcgacggcgacgcggacggtcgtcgtaatcatcctcgaagtcatcggagcgacggcgacgcggacggtcgtcacgatcgtcgaagtcacggtcatcgcgatcggagcgacggccacggccgccacggcgatcgtcacggtcaccacggccacggccgccacggcggtcatcgcgatcgccacggctcgggcgggcgttgttctcctgatcctcgaaaccaggaatggccagggagatcttgccgcgatcatcgacaccctgaacgatcacctcaacggtgtcgccttccttgagcacgtcttcgacagcgtcaatacgctcgccgttggccaggttgcggatctgggagatgtgcagcaggccgtcagtgccgggggtgaggttcacgaaagcgccgaacgacgtggtcttgacgaccttgccgttgtaggtttcgccggcctcgggcacgtgcgggttggcgatggaatcgatgatggacttggccttcttagcggcctcgccaccctcggaggagatgaagacggtaccgtcatcctcgatggcaatttcagcgccggtatcttcctgaatctggttgatcatcttgcccttcgggccgatgacctcgccgatcttctcgaccggaacggtggtggtgatgatgcgcggagcgaactcgctcatctcagccgggccgtcgatgcactcgttaatgacctcgagaatcgtggcgcgggcttccttggcctgctgcaaagcggcggccaggatgtcggcggggatgccgtcgagcttggtgtcgagctgcagggcagtgatgaactcggaagtaccggccaccttgaagtccatgtcgccgaaggcatcctcggcacccaggatatcggtgagggtcttgaagatgtgcttgccatcaacgtcgccggacacgaggcccatggcgatgccggcaaccggggccttcagcggcacgccggcagccaaaaggctcagcgtggaggcgcacacggaacccatcgaagtggaaccgttggaaccgatggcctcggagacctggcggatggcgtaggggaactcttcacggctcggcagcaccggcacgagagccttctcggcgagggcgccgtggccgatctcacgacgcttcggggagccgacgcggccggtctcgccagtggagtacggcggcatctcgtagttgtgcatgtagcgcttggactgcggaccggacagcgcgtcgatctgctgctccatcttgagcatgttcagggtggtgacgcccagaatctgggtctcgccacgctggaacagggcggagccgtgcacgcgaggcacaatgtccacctcggcggacagggtgcggatgtcgcgcaggccacggccgtcgatgcggtagtcctcggtcaggatgcggcggcgcacgatctggcgctgcagctccttgaaggcgttgcccagctccttgtccttctcggcgtcgtccatatcggtgaactcgttcgcgagcacctcgcgcacgtgctccttgatctcatggatgcgatcctgacgcggcagcttctcggcgatggagagcgcctcgtccagatccttgtgagcgatctcgtcgatacgggcatacagctcgtcggtgtactccgggaagagctggaattccttggtctccttggcggcgatcttcttgagctcatcctgagcctcgcagatcaccttgatgaacggcttggcggcttcaagaccaccggccacgacctcctcatcgggcttggtctgaccctcgtcatagatgaggtgccaggcgttcttgccggcacccgcctcgatcatggcgatggcaacatcaccgttctcgatcacgcggccagcgaccacaatctcgaacacggcgcgctcacgctcactccaacgcgggaaggcgacccactggccgtcgatcagcgccagacgcacaccggagaccgggccttcgaacggcaggccggagatcatagtggaggcggaagcggcgttcagggcgatgacatcgtaagcgtcatcagggttcacggcgagcacggtctcgacgacctgcacttcgttgcgcagggtgtgcgggaacagcgggcgcagcgggcggtcgatgatgcggcaggcgaggatggcctcggagctcgggcggccttcacggcggaagaacgagcccggaatcttgccggcagcgtacatcttctcttcaacatcaacggtcagcgggaagaagtcgtagttctccttcgggctggaaccggcggtggtggtggacagaatcatggaatcgtcgtcgaggtaggcggccacagcgccatcggcctgctgggcgaggcggccggtctcgaagcgcagcgtgcgcttgccaaacgatccattgtcgattacggcctcaacggccttgatttcgggaccctccatagggttcctccttctttaattttctaattattcctacatactgtgctgcggttcggcgactcgcttgaaccgcaactgtcctcttcagcggacgtcacataccttgtttcgactgaccccttggccgtcgttcctcgtgtcaacccttcattcgggttctcctgtcggccttacctgctggcctatcctctaaccctcttgccgttgttgccgttggctggcgatatgtaaaacgcccgagcaccatcctaggtactcgggcggaagtcttcaattatcgacgcagacccagacgctcgatgagggaacggtaacggttgatgtcaacgcgcttgaggtagtcaagcaggcgacgacggtcaccgatcatcagctgcataccacgacgggagtggtggtcgtgcttgtgctccttgaggtgctcggtcagatcagcgatacgcttgctcagcagagcaacctggacctccggagagccggtgtcaccttcatgggtcgcgtacttagcgatgatttcctgcttttcttcagccgtcagtgccacggcatcctccttatattgctgcgcggtgctaccggcccgatgccggcgcgctctctatccgcgggcgaaatacgccaagggtcaattatacaggagcaccagacaccacgaatcagaccaacgtcagcaggccgccaaacatcacaacaagcaaagcaatcgtctcaatcacaaaaaaaagataaacgacgcccaactgcgcgtcagcacattcaacggcgactcttttttaatcgtcaccaacaatcccacccacagcaccgcgaaaacggcaacgccaataccaactgaaataatgccaagattcgccgcattcgccaatgccgacgactctccgtacaccacatatgtcgcataccaaaaatcaattttcagaatgcgcaggccggcaatgagttgctccgccgccaagccaatcacaaaaaccgcgccccacaagcgccgatgggcgtcaacaaccagcagaccaaggccggaaacggcaatcagcgtcaccgtccaggcaacaaacgcggcgccgcgcggctcaagcgcgctcaaattatcaagcagccactgcgtatcgttcaccgcaatcgcacgcccccaccaatacggcaccacaatggccgcaatcaccagcagcgcataagccagccacaatgcaggatgcgagcgcttacgctcaatatcggccagcgacagcgtcgattcgggaatggacgccaccggatgcttggaaacatcgttatgtttggaaacatcgttgggcatgggcgaaacaccatcggaccgcgtatcgatttcagcctgcacctcaccgctcgcctgctggtcgaccggctgtttctccacgctggaattcaccgccatctacgtttacctcgcgttcgttgttcgacgccacacctgtctgcacaatgcgtcgtctcatgccgcgacgcccatgctaggacggtattgtatcgtgagtgcgccatacgataatgacatggcgccggacataacgccgcaatacctgattttcgctaatcgcaaccatgcttcggcggacgacataagccatacatatgttcataagggcgaaccatatccgaattactcactccgctaacatcaccacataacggcaacatagatacacagccatacttgatatcaggagaacgccgtcgattcgaaatgaaaactgccagccgcccacacaccagctcctttgtttccaaaatcgcacattctacgccgatgtcatgctccaccatgtctcacgccgcggtctcaacataacaggatgggttgtacgaatccacgttgccgagcattcgcacaacccaccattgcgacacatcactgattccgcacattcaatcgctgcaaccaacaggctgcggcgatatttcagcgcgaagagcggcgtatccgaatgacactgatgccagccagcatcagggcaattgcagacagcaccatcggtgttacggacgaaccagttgatgacagttcagatgaattatcatcagcagtagaagactgttgctggccgccatcaccggtctgatcgccgttacccgactggttaccgtcaccggtctgatcaccaccaccaggatttccgccatcaccagactgacggtcaaccgccaattgcgcgagctgcaaactcagtgcacgctgcggggcatccacctcattttgcgtggaaggatcggatgccaacgcctgctttgccttatcaagtagcgtgagcatcttatcccactcatccataggatattccgcagactgcagagagtcagcctgatcaatggccgaacgcagcttagacgtatccacagctttgccgtcagaagtcaacacgtcgctcaagtcatagtaatcaaaatcgacataaccacccgtattctccttggcgtaattgaacaagccgattcgataccccttaaagtgcgacaagctccaatcgtaagtcagcggcccctgctcgtcgccaagcttggaccattgcttaccgtccagactgtaccaatactgaatcgtcaacttaccactcgcattatccagtgtgttgtccgacttgatccacacattggtcgcatcatctggcaatgtcactgtgccgcccgatacaaaggcctcttcagcgtcacgatcaatcgtatcgtcaacgatattaccgtccgcgtccttcacgccattgtcgtagacacgcttgaccacgcccaacgttcgctgtccattttcttgacgcacagcggcataggcaaaactacgggtatatgtagcgaggcctgcggtgtctccatccttcatatgactgacatccatgtgggtttccacagacatggatccgccaaaggtacgctgcgacaaaacgttacgggcggtttcaaaatatgtcaggtcgccataagtgcctttcatatatttggccgtggcggaaaccttgtgcccattggtcaaacgcaaccagccttcacgatcagtgagagaccaatatcggttatctggattatgtccccattcccataccaaatcaagattcgaaccattgggttggtattcttcggcgaccggatattccttctcatcagcaagaccgatcagggaaatatcgtcgatgacgtaatccatgcacgtgccttccgcaccccacgcggtttcgacaatgagtttggaaccttccacattagcgtcggatgggatggagaactcacctgtgatagtagtcgtctccccacgtttcactgttcctgtggccacacgattaattgtgccgtctgcatattgaatcgccacataaaacaggtgggaagtcacagccgatgaatcgacgccgtccatctcatggtcgtatcgaatcgttgcactggcacgatatgtcacgccctgctgcaattttccatccatagattgacccgggccagcgccattgtattcgccacgattcgtcacagcaagactcgtggttccagaaagagaaccatccgtaatcgcggtaagcgtaccattccactgaggggtccacgattcagtcccgttttcgaaatcgccattgtccaccagctcgattccaatcagagaatcgtcaacctgaggaggctcctccagagtccaccaatcctgatcctgataagactgatgaggcgcgtcattatcaaaatcgtccgaattgaccagggaacgctggcgaaccagattctccaaatcagcaggcaaatcaatcagtttgtcgtaggtgtccgacgcgcttacctgattattgtccccaaacacaggccatccgtcatcaccccacgttgcaggaatcaaaccgggaatacgtccggtcggatatgtgtctcggaagaagaatccatgccaagacgtcgtgccatcaccgttgtcgacttcaacaaggctaccttgtgcgaaagcacctagataatactttttggcttcgtatttggagccatcaagcaaatcagtggtgcgcagcagcatcaccatacgaccgtctttgccccagtaaatcgttggagtatagaaataatcaccgattttgaaagtctgagatccttcaaatccggtaggagtctcaccaagatcatcagtgaactgttcggcagagatgatattctcatggctctccaccaccgtggttaaatcatcggacagcctatattggttgacgccggagataatccaaggactcccttgctcatcaaaatacaatgacggatcatggaatccccgattaagggcaatcttcgtccaaggaccattctcaatatcatcggtgtagtagatataagcgccattaaggttgttcgtattgaataacacgtagaagcggccattgtgatagcgcagcgacggagcccactcgccttcgccatacgagctagctccattgcgcaaggatgaagcatcgctcatagaaatgcgatcatacacgtacgtgactatccaccaattgaccagatcataggatttcataattggagatccgggactgagctccatagtggtactcaccatgtaatacacatcacgaccgtctttgttattcggatcgtccttcgacacacgaataacactgatatccggaacatccgtgttcaacatgggaatggaatacgtgccatcaccgctatcagtcgtggtgtaactgccatccgatggcgttgaagatggcgttgaatcatccgcaaagaccggcattggcgccaaaatcaacccacaagtcgacaacaccgcgatagcactagccgaaattttttgtcgtaaataattcataagtcttttaaactttcatgataagcactcaacatcgagtgcgtattccaatagcatgtccgcacaaatcagcaatgaatgacgataagacattcccgcatatggataagtgatggacattaccactgccaaaacttacgcttgaacaagtaccagttctaggtttcatgtgcggtcatcccgaggctgccgctacgggatgaccgcattaccaagaggtaactagcgcatctcgcgacgcactcgcgctacgatcacaccagtgagagccaagcaagcgacaatcacagcaccaggcaagacagaggaaccggtttgtgccaaatccacgccatccgtgtcatcaacggcatcggaagcattgtcattggagccgtcggcattgccatcagtggaatcatcagccagcttcagaccggcacgtgcactattcaatgcagcaagcgcatcttgaacctgctgttcagtagcggattcatcctgcaataccgcctgagccttctgcaatgcgtcagcaaacaccttccagctctcttccgtgtaatcggaagcgttcaggctggaattctcattcactgcgctctgcaaatcagacttgtccaccggagtcgaaggagtttcatcctgcgactccgtgaaagtgtacgtagtgatgtcgtacagctcatcctgagcattcgcaccaccatcggatttgaaggagaacaccacatgatgcacccctgtcacaccctcaagggtggtcgtgtaatcggcgtactcggatccatcaccggcaggaatcgaaatagaagccacaggttcggaatccggatcatcaagacgaatctcaaggatgcctccggctttgccagctgcagtcacagtcagcgaagaggcgccgttattcccgaaatcgacattcgccaaagacgtccactcaccattattaatattgctgagcttctgaccttcggaattgtctgtagtcatatcgaccacgcgcacaccagaagtcaggtcatatgcgttctgaatgccggaatcccatgcaatggtggaagctggaatgcctccatcttgatacgcgtccagattcttcaccgaagagagaccctcatatgtcattgcaatatcggcaatggaaccatcctcgttaaccgtaatcggatcgagatgagtatttcggtagccatgcgccgcgtcaagattaccgccgttcatcaattcctttgccaccgtttgcgcatggtaggtcatataccactggtcgccaagttgaaccatcgcgtgatgattgttgccgccaacaccgaaatacgtgctcggattcttcagaatctcaccctgataagtgaacggccccatcgggttgtctgaagtcatatacgcgatattgccgtaaccgaccgtgttaccatcaattacgttgtcatggctgaaattagtgcaatacgagtagtaataagtaccacctatcttggcaatcccggagtcctcaaacatggcaggtgcgtctatggcctgagcctcaccttcggtatgcagcatgtcatcggacagtttaataacgcgagccgtgttcggatgttcttcctcgcctgtcggaacaccacctccgtaatacaggtagccctgcccgtcatcatccacgaacaccgcgggatcaaacagccagaccacaccagcggattcaggagtaccgcccttaatcaacagctcaccggtttcgtccttccacggaccaacaggagaatccgaggtcagcacaccgataccgctgccgccattggcgaaatacaggaagaacttctctttaccgttgatggtcttatgagcgacggcaggagcccaggaattgctggcccaggtggccaccccctgttctccagccacacgaatgtaaccctcattacgccaattgaccatgtcatcactggacagaacattgatggtctttacttgagcgaacgaattgtccttgatctgcccagtactgtcatattcatagtcataattcaacgagccatcagcattcacagaagtgccatcacccgtagtgtagatatatacgcgtccgttgtattccatagcccacggatcggcgccataccaataatcgataatcgggtttgaatagtcgccgaaagccttggctgccgttgccgtacccgtagtcggcggcacgaatgaggaaccagaatccgaaccggttacggaaatgtcgtcgacaatgaagtcggcattgctcgtgccatacttgttttcaatcaccagcgagggactggtgaaatcaccactaccacctaacgttccagtacctgaaatttgtgtccactcacccgctttcgccgttccggtcgcaatctggtcacatccggaaccattacccgaacaaacagtgatattgaattcaccgtcttccgtggccttgacccacatacttccggtatatgtctgtcctttttccaccttgccatcaagagactggattgcaccagcatcagaggatgtacgatcagtaacgctcaaggcgccactgccaccatgcacatcatccgcagtgacggcaatggacgatgcggagctattccacaccgttccagacttccaaccattaagatcgtcttcgaatccgccgttgacgaccaattcgacgggttcatcggccgacgccgcagtcactccgatagtcgctggaaatacagcccccatgcaacacagcacggatgcagccgcagcagcaaccacacgaccggttttccttgtttgcaatatgtgaatgttataaaccattcagttccctttcctgaatgatggagggcgactcccccccccatcattttttcttcgccgcacaatcgaatcccacgttggttacgaccacatcgcggctcattgcaaagccatgccagaggaacgtccctcaagggcagccatgcaacagccattgtataaatgagcgcatttcactcgcgatcgtccttgataacaaattgataacgatatgcacaatgaaaataagttcacataaacgcaacgcaacacatcaaatatgacagtttcatatgccaattacacactttgcataacatatttcaacaaagaatggagacgtacaagcgaactcatctgatgccaccactcatcgcctataaagctggcgtgtcgcgccacaataacatcacagccgataaaacgacaccccgaagttgagactcattcaacaatgcggccagcttagacacacaaccaacgcttcgcttcatagcaccgaacattgattccagcacagtcacgaccatcttctttgaaggcaatcgtgtttacgccccgggttctaaatagaagtgcaacaccttgtctagggttggaagtgttcgaagtttctaacttaagaaggtgttgcactcatgggtcaacagtattcgcacctgtcgtccgaggagaggatcctgatcgagaagctgcattgcgaacagcatctgagcgtccggaagatcgcggaggaaatcggtcgggacaagtccacggtgtcacgcgagctgaggcgcggcctgtggttcgcgtccaacgagaacgggtcgtaccgtccctaccggccgaaacggctgaagaccgggccgtggacctcgggtccgttctattcggcgctggccgcgcagaggaaggcggacctgcgccggcgcggatcccgcaagccgcgtcgcatggactcggaccggcttcgcgcctgggtgctggactcgctgcgcagggggtggagcccggaactgatcgagggacggttgaaggcccagtacgccggcgacccgtcgatgcggatcagccacgagtgcctctgccagtggatctacgccaagccgcagcgggcgctggacctgcgccagtacctggcgcgcggcaggaaacgccggacgaggaaaaagggcaggaaggcgaaagggccgcgcatcccgatgcgcgtgcccatcgcggaccggcccgaggcggtcggatccaggaaggggttcggccatttcgagtcggacacggtggtcggcgccgcgccgtcgaggcgctgcatgaacacgcaggtggagcgcaggagccgcaggctgttcgcccggctcgtcgacgacaagagcgcgtccgccacggccagggccgaatacgagatcttcaaggacatcccgccggccgcgcgcgtcgaccgcacgtgggacaacggcacggaggcgagcctgcacatgctggtggacgaggcgctgggcatgctcacgtacttcgccgacccgtacagttcctggcagcgtggcagcaacgagaacaggaacggcaggatccgccgctatctgcccaaaggaaccgggttcgaggacttggcccaggaggacctcgacgcgatcgtcggggagatcaacgacaccccatgaagctcctcggctacaaaacgcccaacgaggtatgggacgaggagatcgccaagctacaatcgaaggcagccagcccgaacacaagcgttgcgcttacaaattgaatccgggggcctcatgagccgagggtgtaagggataaggtgtaaagggtaagggtttaaaggcgtaagggtgtaaggggacactcactcctgccggtacagccgcgaatacaatccgccggcctgcagcagttcgtcatgcgtaccggattcgacgatctgcccatgatccatgacatggatgcggtcgaaatcccgaatcgatgcgagtctgtgcgccacgacgatgcacgcattgtcggagtcgagcaacgccgtcatgacatgtcgctcggtatcgttgtccagagcactggtgggttcgtccataagtaggaagtccggtcttccgacgaccggatccatcatcccctcgttgatgccggcaacctcgcacgccctgacgatgtcgtcatccgtcagccacggacggtgcagcgtgatattgtcgcgcaaggtttcgttgaacaccgtggattcctgatgcacatacgccagcctgtcggccttccatcggctgtccgcgtcgtaaatccggcatccgccgtcgttgatggtcaccgtgccacagacgggttcgatgagtccggcgagcagtttcagcagcgtgcttttgcccgagccagtggggccgacgatggcgatcttgtcgccttcaccggcgggaatcatctcgcaaatcttgcgcatataggtggcgaacgccatgatctggctgatgacgccgacgatgccggagaaggtttcgatgaaggcgcgttgcacgtcagcctgcgcgacggtcgcacgctcgaccagcgtcctgttgcgcagggaataaatgacggatacgacgagcaccgccgcgcacaccgtcagggtcagcatcgtcaatggcgctgaataggcgatcatcatgatcaggtagaccacgaggaacaccatcgacacgaccgtcgacggcagactgccggtcacgatctgttcgacgaccatgaccaggttcgcgcggtagatcaggtcaccactggaacggttcacgaagaacgggaactcccgatcgagcacgccggtcatgtatcggcgggacaggtatcgtccgaatcgcacctgcacgcgggtgagcatcatggtgttcaacgcgccgaccgccatcgccgtgaacgccgggcgcgctgccttccacgcggccacgggaggcgtcgcaggcgtggcggcgggaggacgtcgcgtttcccgattcccggacgggttcccatctccgagcgtccgccggaggccggcgaccgcagcggtttcggccattgggaggccgacggcgtgatcggcgccggatgcgacctgcacactgaggtcgagaggaagaccaggttcctcatggccgggatcgtgcccggcaggaccgccggggaaagcgtcggggtgcggctggcgatgttctcgccgctgccggccggcgcgcgcgtcagcgtcacgcacgacaacggcgccgggttcgcccgccacacgcgcctgcgcgacgggctgggcatggacacgtacttcgccgacccgtactccagccggcggcggggaagcaacgagaaccggaacggcatgatccgccggtatctgcccaaacgcagcgagatccggatgggcatggccggggaactgcgggagattgtcgacgaggccgacaaccgtcccatgcgcgtgctggactaccggacgcccgccgaggcattcgccgacgaactgctagaattgcaggaccaacagggggtgttgcacctctaaatagacatcgggcacacggtttgcgcggtggtgagcagtgagcggtgagtattgagcgacgtacggcgactcacgtgcgctcacacagtggtgagtaatccgccaaacaacaccacgagcagggcgatggtttcaatcacgaagtacagaatgaaactcgcccagcttttggtcagtacgttcagcggcgaggtcttccggataatcaccagcagaccaacaaacaccagggcgtatacggcgatgccgatcgccgcccccataatgcccagattcgcggcatttgccagaccggcctgcttgccgtagaccacgtacgtggaataccagaagttgagattgagcatgctgagtcccgcgatgaactgctcacaggccagcccgagcacgaacacgatcagccatggccaggacggcgagacgaccaccgccatcgccaatccgacgtacgtgatcaccacggccacccaaccgaccagtgcgataccttgcggagacactccccgagcacggccacaatggagtcagtattattcaccgccagcgagcgaccgaaccagtatggcgcgatgatggcgcacagtacggcaagaataatcaacgcccaacgcaacggatgggagcgacggcgctcgatatcagccaaagacaaatcggtctcgggtatggaagcctcggggtgcctggaaacctcgacggtctctactttgccgcctacgatttccgtcgcctcgttaggttcttgctcgttggattcctgctccatgcaccgcctcgccgattacctgcttattgccatgtattgccatgccgattattgcgatgcctatcttagcgtgcgtgttgggcaagtacctgatgttccctgtggtttcgcgcactgattggatacagacaggctactgctgttgcccgtctgtatccggcgacttgtccgccgctgtatccgtctgttcctcaggcaacgtattggcagcctgttccttacgccgcctgccgtgcagcagggcctcgagcatgtcgacctgacgctccagttcgtcgatacgacgtacctgctgcgaaatcagcaagtcgcgtaggtcattgttctgctctttgcgggagacggggaagatgatggcgcgacgttcgggcgatacgtggaaatcggattcgctgccggtaccagccggaagtgacgattccgccgagtcgcgccaagctctcgctgctcgcgcactctccggaatgtttggtgcgcccgcggctcccgagcggaaaagctccgaatctgaagcccccccccagcttattttccacgccggctttggcattgccggagttcaggatttcgtcttgcgattcacgccagcgggcaaggcaacgttcgatgcgcttgtacccgattagagccggatccaatccggcttcacggaacatgcgcacgggtgaggcaccttcgttgtagtggactacacagtaacgcttgaaatcatcggtataggtgatgcgcttcgccgtggcttccgccactgccgacaacgacttcagatacttgatctcctcggggctaaaagtccctccaccactggtcatcctcatcccttacactcgttggaaggctcattgcacacccccttgattatggggtgaatgccatagttcgggatagtaatacttataattcggacatgcctaaccctagtagggtcgtttttatccccgtttaagtggagcctgagtagtggctggacggcaactgaacgataatcggcccacgaatggggtatacaggcccatccttcacctcccctacgattgtgttcgcttggcgattgttaccgagcctgcgtgaaacgtttgttgtggtgaaacacaagttattttcgatgcccggccccattacattcaaatcaaaatgccatacattgcccataagattcggagatggtccacaagtcatccgtctgagatgccgccaatatgacaaatggccgatctgaataatcagatcggccattgttatagctgctcagttataagcagcagtcaagctcacgcgttgagagcgcgcttggtggaacgggacttgacgaacacggtcaccgcggcacccgcgatcagcagaccgatcacggagaacagcatggttccggcggcaccggtgagcggcagctgggtgatgttcttgacgttggtgacctggaaggtgcccttgttgtccttggacaggttccaggcatccttaccagcgaaggtggcagcagcatctgcggttgcaccggtagtgatcgtgaacttgccaacgaaggtgccgttgtagccagtcgggaccttcgtctcaatcacggtgtaggtggtgttgagcttaagaccgttcagagtgtacttaccctcagcgttggattgcagtgtgtccgtggcgccttcagggtaagtgccatcagcattggcggtcggcagagaatacgcaccgttagagccattgaacttaagcggagtcttcgctttgagctcgtcagcggacagaccgctaacatcgccttcgtacacttggaactcagcaccagtcagagcagcagcgttcttgtcgactttctgccaagtcacggcaccagccttggtggtttcttccttgctgctcttcaggtcgacaacgccggcagcggcgagaacgccagtggcgttgttcacggacggcgcggcgcccgtgatagcagtgccagcgagaatcggagcattgccattccacacgagcttgtgagtgtcattatcttcgacgaccagctttccactctggtcgacaatcaagtacagaccaccctcagcgaaggtgaaggtctgggtcttgccaccgttagaagccgtcggggtaatgtccgtgacagccagatccttaagcgcgttcacaaaagcggtggtctgcgcggcggtcagggtagtgttgcccagccaggcccactcgttcagggaatcacccttggtctggtcgttgtaaccagcagcagcgaaagcagcatccactgcctcaccggagaccaaaccctccagctcaacgccagtgttgccatcagacacatacttggcgagctcaacgtacttgaacatgcgcaggttagcctgcaggtcagcggtgtcaaccggcttggtgtagaactggtttgcatccgtggcgttgactgtgatagtcgtgctggagatgatggcctcagccgcgttggcggtggtggcgccgaacgccatgccaccaagcagggtggccgcagcagcgacacccgcgaaaagcttcctcaacttcatgagaaaccctctcttccttattgtgattgattttcttgcaatcgcggaggctgcaaccccacagcaaggcctccgcaatccgcaaatccttattgttttttcggggagggaagccttcatcgactcccctcagtccgccttcggcggccagctcccctcagcgagggaagccaaaaccacctcaagtttcttgaaatcagaccagctgacgcttacgccagaccgtgtagcccgcagcagccagcagggccagcaggcccaggccaccgccgaacaccatccagtcacgaccagtcgtgccaccggtcagcggcagactggagatagccacatacttgttcgtgaactgtgccgactccgtattcgttcggtcggaatcgttctcgccgtactcgtaagagacaacggcatccgtcctggagaccgtgaccttgacggtcaccttatcgttgtcatacttccaaccggcagcaggcttttcggtgtcctccgaagcctcgaacgtgtagaccaaattgtcagcaccggtcggaaccctgaacttcaggtccccattgccgaagccaaccgtcgcgctcgcgccgctagcagtcaattcgtccttggacacagtcgtagtcagtccattgttggccaagccggtaacgtcagcgcacttaccagcattcgcatccgtgctatccacacacttcaggttgaagccgaagtccgaattagcagcatgtccctgcacaaccttcgtcaccttgacatccgaagcgggcaaggtcacgtaagaaggcgtgttggttaccgtgaaggcaccggattgtgcggtcaaaccttgtagcttgaggtcagtcttatcaaccttggagtcatagccttcaaccttgacctcggaaaccgagtatgtgtgcccctcagggccggcaggcaccgtgaactcgtgagtccagttgccggcggcattcagagttgctgaaccgttggcataatcctcgccgtcctgcttgagctggacctgcacggaatcattcgcgtgattctcgttgtcgtcggaccaagtcttcgtcaccgtaatcttggagaccggaagggtgatggtcggcttctgcgggtaggcggcggtctgcggatcgctcgtcgtcgtgccgccctgcgaggaggtcaccacggtcttgtagtcgacagtggcgctggagttgtcgttcgtgtagaagttgttgtcgccggaggcattggcatcgtccttgtggttcttaacagcctcgtcgaacgcagcctgcgtcggcttgacattgaagctcaccgtgtaggtgacgccgtcctcaagcgtgtcgtcgttggacgtgaccggccaagacacggtgccatcagccgcaaccgtcgcctccggggcgtcagcccacgccgtggtctggcctttccgggtcttcgtgtacgtgaagcccgcgggctctccattctcggaggcgctgtcggagctcacgacccagctggacagcctgtcgtgaatcgtcacgtcggcatactcagccgtcttggtgatctcctgataaatggactcgaagatgttgttcagctggccggcatccgtggcggccttgtagtagctgctggtctcggcgcggtcaccgaggttggcgttccaagactttccccacaaatgctcactgctcgttgcagtggcatccgggtagttgctggagatgccgtgcatgtacttgttcaggttgctcgaggtgtcgccggggttggcaccgctgacgacgccgatcgagtagatggtcgtcccggcgtccttcaggctcttcgccttgttcaccgcggtggcggcgacggtggggtcaaacccgctgccgtggttcggctcgccgtcggtgaagaagatgacgaccttcttcgcgttggcgcgaggctgatacgttagcgccgcctgggcgcggttgaaggcgtagtcggcggaggtcgcgccggacgcgctcaggccgttaaccgtgctcgtcagtccggagacgtcgtacgtcaggttgctgacgatctgcgtgtagttgtaggaggaccagccttcgcggtaaaagtcattgccgacgctggtcttctcggtgccggcgaacttcaccagggcgatgcggttccgctggctctggtcggtaatcttcgcgttctctgcagccgtcgcattgatgaatttattgaccgcggtcttgagcgagtcaatcttcgtaggctggttccaaccgctagcgatcttttcggccatcgaaccggacacatccaacaccagcacgatgtcgagtggctggttcgtcacgatctcgcccgtacccgcgctcttcgcaccggtgacgttcaacgccaccgtgtacgtgccgtcttcattggcggtaacggtcttctcgcgggccggagcagacaacgtcggatcatccggcacgccgtttgttccctcggtggaaagaggagcaggcgcgctggcggccgccttctcatcggtggtctgcgattgtgtcgtggaggcattcccatcgtccgccatggcggttgcgctcacaccggcgacgccaccgagcatcgccacggcggcaacgatcgccactaaccgtttgcctttcctgcccgccgcggcccctaccgctgcgaaccattctgcaattctcttcataaccttgcctgtctcttacgatcacgtacgccaaaacccggcgttacgcttataaggcgttacggtattaagcaaaaagcacgaatgcgtacacccgggtagagggaattttttacccgacattgaaaagaaccttggaatttttgaaaagtggcaccctcgtcatccaccctgcgataacgcacttttcttctcgacggggcgtgccggtcccaccatctgggaactgaggcggatttgccgccgctgcgcggggaccggagttactgacgaccgtcagtatgccactgctccgcatgtgtgcagtatcacataccgctacgcatacacggagacatactacatgcaatttctgtgaacgcaaacatacgactcaccaaggccgtgttctgttgcgggcggtggtgttacgggcaatgttgtgggtagtaccctagccacaaacctatatagtggagcggatgacgggaatcgaacccgcgtaatcagtttggaagactgaggctctaccattgagctacatccgcgttaagcgtcgcttttggcgacttgagttattatacatatttcttcggggatggcaaacgcgtgtggctgcagcaggaccagccaatctagttgatggattgcggctttgccgaggactcccctcagtcgcctacggcgacagctcccctcaaagaggggagctagaaaccgtcgaaatcacaaatggatgagctgggactcgtatggttggaggtcggcgtccatcgcgttcagaatgccgttgcaggcgttgaggtgggcgtgctgcgggtcgggcgagaagttgaacaggccgaccagcgtcttgccttcgtgctgacgaatcacagcgagcaccgaatcgttgaacgtatcccacgtggacacccaagcgtcaggcgcgaagcagggatcgttgcgcatcgcgcgcaaatcttccatgcccttccacagctggttctgcaacgtaccggacttcttgcgcagagcggccttggtccagtcgaacttactacggtgcagattgcggctgtcttccacgcgatccgggtcttccttgtaatcccagccgttgagctgggcgatttcgtcgccgcagttgagcatcgggaaaccgcgcaggaagctcatggcgtggtgcatcatgaggtcgcgatccaccgaggtctctagcagtggcttgtcgtgcgtgatgatggccttttcgatgccgcacaggctggcggtggtgccgcaactgcgggcgtcgcgcgtggcttcgtcgtagttgtagagttcgcccatcgaccagctgccgggggttgcgccctcgtagaagtggtacaggaattccttgtgcttgagcgggtcgatgtcgaggtaacgctccacgtcttcgtccaagccccagccgatgtcgtcatggcagcgcaaataattcacgaaccagcagttttcgggcagcgagttgagcttgtcgatctggttcttgagcagacgcacgtcgcggctggcgagcgcgctccacaggttgaccatgatggagacgttgtacagcatgtggcactcgggggcctcgggcgtaccgaagtaggcggcgagctccttgggggccatgaccacctcgcccttaagcaccacggccgggcagacgcattccaaaatgatgcgcagcatgcgcacgatggtgtggacctgcggcaggttgcggcaattggtgccaagctgcttccagatgtacggcacggcgtcgatgcggaacacctcgacaccgaggttggccaggcgcatcacgctgcccatcatggctacgagcaccttcgggttgcggtagttgaggtcccactggaacgggtagaactgggtcatcacccacttgttcatcttctcattccaagtgaagttgccgggcgcggtgttcgggaagacctgcggcacatcccggtcgtagcggtcggggatggtgcggtccgggtagcagaagtaatagtcctgatactcgggatcgccggcttcggctgccttggcccagcggtgggtggaggcggtgtggttcatcacgaagtcgatgcacagactgatgccggcgcggcgcagcttcttggccagcgcggcgaggtcttcgttggtgccgagcttcgggtccacggtgtcgaagtcctggaccgcatagccaccgtcgttgttcgggtgcggcatgtcaagcagcggcatcaagtgcaggtaggtgagcttctgctccttcaagtacggaatcttgtcggcaagtttcttgaggtcgccggcgaacaggtcggtgtacatggtcatgccgaacatatcgccgcgcttgtaccagcccgggtcctgctcgcgggttttgtcgagacgcttcaaatcggcgggacggtcagcgtaggctgcggccatgcttgcgacgagtgcgtcgaaggcgtcgtgatcgttatataggctcatgaagagctgttcgagttcgtcttgatgagcagcaaggcgagcgttgaacacggcgctcgaagcgggacgcttggcggttgcggacttggtcgccgctgccttggaggtacgggccgaacggacggcagtcgtcgccttagtcgctgtggttctggccgtacgagacgtcgtgcgcttggttgcggttgtcttggttgccgtggaagtcgtagcggttttggccgctcgggttgatgctgtcttggcagccttcttcgccacctcggtcttctcgaccgattccactgcctgtgccgactggttgctttgagccaccggaaactcctttgtctctatccgttgcccgcgtcaatcgtttgacgctttgtattacaaaacatcaaaccggttcgacaatcgcaacccaagactcgccgagccaccggcgctattccacagaaatcgtcaccaccgcggaggcaatcggaccatcgtggctcagggaaatatggatatgcggcatcgaccccgcaccgaaagccgagcgctgcgccgaacgcgcattccgccgctcctgcatcactgcataaggcccgttatcggaagcaggggaataagcagaggaatagcgagcgcctgcagccgaattcgcgtaatcagtttggaagactgacgccgtccccttacccagagacacatgcggcacaccacgggaatcatccaagatctcgatttcaggccacgggaaattatcaagcgtgaacggatagggggcatcgccaagataatcgcaccacgctttgaggaacgcctccttgcctgcccacttggcggacagatgcacggcctcgtcatcgttcttcagccgtgcacgatccgccgcctgacgtacctcacgaacggaaaacagcgagcgcatgcgcgagccgggttcagacagctgctcggcgaatgcggcgacgtcaaccacgtcatgacctaaaccaaatgtgcccatagcacctattatcagccattcaacacgttgacaacacatccagaataacgaggttcacacggaacgcggcatccacaaacggaaaccctcggccgctccgcaagccgaatcctgaaagtcaacaccaagtcaaactgttgactaacggtggacacggcgtaaaatgtcgatattccgcccgacactccaatacgtaaatcgattgacgtcaaacgtttgactttttaacgcggttaacacaatgatccaatgaaggataacttcacaacaaccaaccacaaccagccaatgaagccagcaaggaggtagaaccgtggtcacgatgaagcaaatcgccaaccgcgccggcgtttccatctccaccgtctctctggtgctcaacaaccgcgatatcggccgcgtcagccccgatgtcgccgagcgagtccgcgacatcgccgccgaactcggttacctgaccaaccgtctggccagcgggctgcgcaccagcagtacccgcaccatcggattcctcagcgacgaagtggccaccacgccgtttgccggccgcatgattgagggcgcgcaagacgtcgcccgcatgcccgcgttcttcgacaagcacccggatgtcgacggcttcttctgcttcaacgacacccgcgcttgggccatctacaccgaggccacccgtcgcgggctgattatcggcaaagatatcgcggtggttggcgtcgacaaccaccaggttgtggccgaagcgctggatccgccgctttccactgtggaactgccgcattacgagatgggctactgggcagtcggtaagctggtctcgctcatcgaaggcgaggcacccgatccctttcctcgtgccggatacccggtcgagaaggttcagccgccgccactgagcgagcagtcaccccagcttgaatgccagctgcgcatcaagcaatcctgggtccggccccgctcccagcgatagcctgcccaaaaatcacgcatctatcctacttgacccggtttcgactgtatatcgaaggcgctattgctgttttcgtgggtggtggttcgttgttgaaccgttgcgggagtaagagacgacgaaccgacatccacgaaaacagcaatagcgtcaaaaaacaatagggtcgggaagaacaccgtaaatgacgttcttcccgaccctaatcgcgagacactcccctcagccggcattcaccgaccgggggagccagagaatatcaggcctcgtagtagccgtcggcaccgaggcgggcgtccgggttgaggagcatcgccttttcgacctcgtggtggtcgtagccacggtgatcctcgcggaagcgacggttgtcgatcggctcgtagagcgcggcgcgacccatcatgccttcctcaaggtgacgctggccggcagccaggcgggcgttggcacgctcacgccaagcttccagtgcggcctcaccatcggccttggccacggccgcctcgaaggcacccggatggaccagagccacgaagccggaaacatgtccgaagccgagcgaggtggccagaccggccttgaccgggcgaccagcggtctcgcgaccgaactcgtcctcaccaccgccgatgcgcaggggcttcctaacccagaccatgtggtcgtcgcgctggagcttcggatccacgcagtcgagcgccgcgttcgccggaatcacgccggacttgaacagctgcgtcagaccgttgacctggaagatgcaggcaccacccttggcgtggccggtaagcgtcttctgcgagatcacgaacagcgggttgccgtcggtgcggccgatggcgtgggccagcgtgttgtgcagctcggattcgttcgggtcgttggcgttggtggacgtgtcgtgcttggagaccacggcgatgtcgtcggctgagacgccgagcttagccaggtcgtgcacgagcttggagtccttgccgccgaggccggcagccagggcaccgaggcccggagccgggatcgaggtgtgagcgccatccgcgtaggagtggatgaagccgaccacggccgcaaccggcaggccgagcttttcggcgatgtcaccgcgggtcacgaggatcgtgccgccgccctgggattccaggaagccgccacggcgacgatcgttcgcgcggctgaagaagcgcgcgtcgatacccttgccatacatttcctccgagttggcggtggcgttcatgttgccgaaaccgatcacggattccacgccgatgtcgtcgatcgcaccggtgaccacgaagtcggccttgccgagggcgatcttgtcgacgccctcttcaagggagacggctgcggtggcgcaggcggagaccggctgaatcatgttgccgtagccgccgatgtaggactgcatcacgtgagccgcgaccacgttcggcagggcttcctgcaggatgtcggtcgggatctcgtggttgaggaagcggtcgaggtacagcttgcgcatcgacatcatgccaccgaagccggtgccctgggtcgaagccaccagcgaggggtggatggactcgaggatttcggccggggtgaagccggcgcccaggtaggcgtccacagtggtgacgatgttccacagggcgatcttgtcgacgtcgccgaccatcgaggcgggaatgccccatcgggtcgggtcgaagcccttcgggaactggccgccgactgtgcgggtcatggtggcgcggcgcggcacgcggatcatcgagccggcgtggcgggtcacgttccattcgccggattcctcatccggggcgatggtggtgtgagcctcgtccaacttgacgtattcggcggcgacttcgcgggtgggcacagagaaggtgacgtcgtggtcgaggaagacctcggcttcctcttcgtcagcaccgtccttgtagtcgttgcccatgccttcctcgaacgggcggatgccggagcgggccacgacctcgtcgtggtagcgctcggcgatgtcctcttcgggcacgaggttgccgtcggtgtcgtaccagccgggcttcgggctgtcggcccaagtcagcaggcccatgttccacgcgagttcgagcactgcgccggcgctgaggtcgacggtgccgtccgagtggatgccgagctcggcctgggcgcgcgtacgaccggagccccacgggcccagctcaccgacggaaacgatgacgatttcgtcttccggcttggcagtgacgttggtccaatcgttcaagtcgaccggagcctgcttggtgacgatcggtgtgggcagcgccttgatttgctgcccacgcgaggagtcggacagtccagtggactttccggcgacggagccatccgtttcctgagacgaggccgcagcagcttccttctcggcgtcggccatggcctccgcacgcagggccttgatgtcgatgggctcggagccgaggccaccggtcaggtccacatcgagcggggccttgagggcctgctcgcgcgattcggcagtgcacaggtcgagcagcttggccgcaatctgtgcggtggagtaggtgcggatgccgtgacgctcaacgacggcgaccagcgggtcgttaccgaccatcaggccggtgccacgcacccagccgatcttcgggtgagcgaaggtgacgcggctcgaccacaccttttcagcgcgggcacggttgacgatggcgtcaaaggcgctcttgacttcgccgtaggcaccgtcgccgccgaatacgccgcggttcggggaaccgggcagcaccacgtggagcttgtgctgcacgttggtgtcggcaccgatgtggctgaagccggcgatggcgcgttccacgccccacagcatcagtcgggcctgcgattcgaacaggtcgccggagtcggcgagcgtgccatggaccggcggagcggcgaacgggaagaacagagtcggctcccacgcgggcttcagaatcgtggtggtagcaccggaggtcttcttctgctcgtggcccacccagtcgaccagtgcgtcgacgtcgcggtagctggagaggttggccggaaccagccacagcttggcgttgccggtagcgtgctcgcggtaggcctgcttagcccaagccttaatggacggcttgaagctgtgcgaggtggccaccacagtggcaccgcctgcgagcaggccttcgaccacctgagcggcaatcgagttcgggctcacgccggtgacgatggcgatatcattcgcgtaacgggaggcgttcttgttggacgcaacctgttcgagggcctcggagccggccttctggaaggcggccttgagttcttcgctctccgactcgttggcgaaccactgggcttcggcggcgatggtcttgccaaggccgatgaagctgccgttcaaggcggcgggatcgttgtcgtagtaggcgcgggcgaggtcttcacgggcggaggcccaccgatcatcgaagaggatggccttgttggcgtcgaagcgcggagcgacctgcttaggccagtcggagccaagttcggcttcaaccgcggccacgacggcggcgttctcgtcctcggattcttccggagccggagcggccacgccgagctcgttcagcacgaagcgggcggtggcggcgagcacgccgttggaaccggtgaccttctcggcgaaggcgtcgagcgcggcggaatcgaccacagcgccaccagcggcaccaccggcggacggcagggccacggcaacacccttgagctgggcgacgacctcaacggccgcatcaatcagcttgtcggcttccggcttgttctgcacggcggcggtgggcagcttggccaggtcgccgccacgggagctggcaccctcgcgagtgtcgagcagcagtgcggcgagcacgctggccacccaaccttcaccgagctgccatacgttggtcacgcggtcgcggatgtactgctgcttgacgccggcggcaccgaacagcgagcgcaggcggtcgcgcagcgcctcggagagcacggcaccgaacggcttgtagttcggggcggccttgttgacgatttgggcgagcttgtcgagcgtcgcttcagcagcaccgtccacgctggcgactcccagctcggagctgatgtccatgagcagctggttgcggcgagaagagacaccgttggtcagggtgtcagtggtgtcgttgctgccgatctggtcgatgcgcaccttggcggagtaggccatgagcacgccgatggcatcggaagccttgaagggcaggtcggcgacggcggcaccggacggtgcgccggccgcggcctgccctgattgcaggccgcgcgaggagtcggacagtccagtggactgtccggcgacggagccatccgttgtctgagcagcctcagtcacggcatttgccggagcggcaccggaaccgagcttggcgacggcggaaccaccggcaggagcggtttcgaccggggccgaggccgcagcctcttccggctcatcgtcgggaaccagcgaatcggtgtcggtcatgtagacgcggccttcatcgcggccgacgttgtagacgaccgtatcgttgccggcgaactcgggtagacgcagggtcttggcaccgaggttggccagggtcggggcgttgccgaggccgacttcgacgtattcctccacgccgaggccgccctgttcgcgctgaccgaagagcagcgcctgggtttcaatccaacgcaccggggaggcgaactgccaggagagcagttcggtcaagagcagacggccgagcttctggtcgtcatcggcgtaggaatcccacacggccgggtcgtcgagcacggccttgatacgctcggacggcacgacttcgaggatcttggcggcgaattccttggtcatctcgaacggggtggccaccaggttcgggatgtagcggtccaccagacggccacggtagtcgatgtaagcgggaagcagcgcgtcgagcttgtcgcggaattccggcacgcccttgcgcagcagtgtggagtggaacggcacatcgatgccgggcaccagcatgaacgcgggcttgccaccgaatgcggccacgcggcgggcggaatcggccttcagagccttgagtccggcgatcgtaccggcgatggcgtactgctggccggcgaggttgtagttcacgatctccaggaattcgccggacgccttggccacggattccacgtattccttgacgtgcgcgtcgtccacaccgaactggttcgggcgcagggcacccatgcggtagttggagcgaccctgtgcgtcacgctcgatgaggtggtgcatggtggaaccacggtggaacacgagctccagcacggtttccagcggaatcacgtcggcgaacgcggacagcgcgttgtattcgccgagcgagtggccggcgaagtaggcgggccagatgtcggcgccggcttcgcgcagacgagcggtctgggcgaaggccacggtggcgagcgccacctgcgtgaactgcgtcaggttgagcaggccttcggggtggcgataggtcacgccgttggcggtgagctccttcgggttatcgcgcacgaggcccaggatcgagaagccgagcttggagcgggtgagcttgtcggcgcgctcccacacgtcgcgggcggcggcggacttggcacgctcgtccagaaccatgccctgcttctggatgccctggccggggtagacgaaggcggcgcgcggcgcgcggaccagtgcggtgccgcgggagacgagctggccgtcgatacggcaggtgacttcgagggtcatgccgccgtggcgcaccttgccgacgcgctcgacggagatttcgacggtgtcgtcaagctgaaccatgccgtacatgttgtaggtccagccggcaatctcgtagtgggcacccttctcgtccagcgcctgcacggcgtgctgggcggtggcggacagccacatgccgtgcacaagcggagcggccaaaccggagatgcgagcgccacgagtggaggtgtggatcgggttgaagtcgccggaagtgcgggcgaaggcggtcatgtcgtgtggggcgacgaccttcacgcggcgcagcagacggcgcggcgtgggcgcgatctcctcgtgctcggcgtcgccgaactcgggggcgtctgccggcaaagcatcggagtagacgcggccgcgaatcgcgaaacgctcggtttcgcgggcaagcagcgtgccgtcggcagcggtgtgggtcacgtggatggtgaccacgcggccggaggcggactcgaagtaatcctcagcccaagacttcagggtgatggtttcaccggtgtgcttaagcaggtcctcctcgttcacctcaagttcgatgaggtggtcgaggtgaacggcgttgagcaggccttcaatcaccgggtagcccttgacgtacacggagccgagcgccgtgtaaatcgccggccaggccgggccgaccagcgcatcgggagcgatgcggctgggctgcagggtcgtcggcagagcggcgccggtggccgcttcgtggtcgaagccgaggttggcggagagggtgtaggcggcggtggcggtagcaaacggacgctcgtcagaggtcttgccgtcaagctgcggcatctcggtgagcttgtcgccggtgatggcggtgttgccgatgcctgcggtggcggcgagcatcgcgtagacgtccggaatcaggcgttcgcggtccacgaccggcacacggccgggctcggcgccttccacgatgagcgggatgacgatatcgcgcacggcgtgcttggaggtgccgccgtccgggtcgttgtcccagtaggtgtcgaggtggatgtccagatcgtacttgccggccgcggcgtcaaacgcgcggatctcgtagtactggtcgcccagggcggtgccgtaggccgggttgtcggtgatgtggccgacccaggagatgttcggggacttgcggatgaagtcttcggcgctggtggcctcgccaagtgcggcgaaatcgtcgttctcagcggcatcggcggcctgctgttcgtcctgcacgcgcttgatggcggcggtttcgaagcggccgaggatgtcggcgatcggctcgtcgatggtggtgatgccggcaacggagatcgggccggggatggcacgcacggaatcggcggagtagcgctggtcttcggactgccagagctggtcctgcccccaccaacgcagcaggtcgttgtcgatgacgggcacgaacggcatgggcttggggtattcgcgcacgagcaccgggaaccaagccacgtcggtcgggaccaccttgagttcggcggtctgcgggtaggccagtgcgagcttttcgagcgcgggggccgggtcggcgagaatgtcgtcgtgggtcagcaggccagcggcagctgcctcttcagcagaaacgccatcagcggcgaacaacttggaggtgaattcgccggagtccgtgtcgttcacacgggcttcgatgcgctgcagcaggtgctggaagcggtcggcgtaagtcgggtcgacccacgggaaggcgagttcggcgaagcgctgcgcccactcaaggtaggtcatggaggccaggtcgccgaagtaaggcttggcggtcttgttcagggcttcgatgatttccttgcggcgggagtcgagctcttcggggtgcttcatgacgcgcacgagcagacggccgcattcggcggagtcgttctcgagctcgtaaatgtcggcgtgcaggtggctcaggccggaggacatgccaccgacggacttgccggacggcacccagtgggcggcctgcggggcgaacacgtcgtcggacttggcgtcggccggaataccgggcgtcttgacgagcagctgcttgacttcggggctggtgtgagcctccttggcggtcatcgcggcggtaccgataagcacgccgtcgaccggcatgtcgggcaggccgtaggcgtgggcccactggccggaaatgtagtcggccgcgcgttcgggagtgccgatgccgccgccggcgaccagcacgaggttgtcacaggcgcgcacttcggcgtaggtggcggcaagcaggtcatccagcgcttcccagctgtggtggccgccggcttcaccgccctcgacctgaaccatgatggtggtgggggccacggccttggcgatgcgcacgacctgacgaatctggtccacggtgccgggcttgaagctcacgtacggcaggccgtccgcctgcagcgacttgatcagggccacggcttcgtccagctcggggatgccggcggagacgaccacgccgtcgatcggcgcgccggatgcgcgcttcttgggcacgatgcgggaggagccgaactgcaggttccacaggtaacggtccatgaacatcgcgttgaattcgaccgtgcggccttcctccagctcgtcttcgagggtggcgatgtggcggtcgaacacttcggcggtcacctggccgccgccggcgagctcggcccagtagccggcgttggccgcggcggccacgatttccggttccacggtggtgggggtcatgccgggcaacagtaccggcggcttgccggtgagcttggagaacttggtgaccagcttggcgccggccggggtgttgatgacgcgcggggcgaatgccttccagttctgggtgcgctcaggctcgctttccagcgtggagagcgtggagcgctcggccagcgtggtggcttcgaccacgccgatgccggtgccttgcaccacattgccgatcagcttgccgagcgtgttgccggggccgaggtccacgatccacagcttggacgggtcggcggcgtcgaacagcgccttgacgcgggcgttccagtccacatggttcagaagcacttcctcggcaagcgcacgggtgcgcttctggtcgaagccgcaggcgccggcccaggccacggtctgctcgacggcgtcggccatgagcggcgagtggaagggcagggtgacctcaaggtattcgagggtcgggttgaacacggtgccgccgtggagcttctgctcgcgcagcttggcctgatgctggtgttcgcgctcggcttcgagggcgaaggcagacaggtcctccgggtagccggaaagcacgtggtggttgtcggagttggtgacggcgatggagatcgggccgcgagcgttgttgacgcgggccaccagagcctcaacctgttcgcgggtggcgcccttgacggagagcatcggactggcttcgccatacttggggttcaggcccagttcgcgcacgcggcgagtgccggctgcaccgatcagggcggcgacggccagaatctcgtcaagggtcttgccggcggcctcgatggagccggcggcctcgatggcgcgggccatgtgcacggcgagcacgccctgggagtggccgagcacggcgagcggcttggcctgggccacgctgtagccgaggtgttcgaggtcgagcagggcgccgagctgggtcagtgccacgccttccacggacgcggtggcgtcggctgcggcgccgaggcgggccgggttcggagtgaagccgaacaggtcgaccggacggccggtggtggtcagcaggtcggcggcgaccggggtgagcagtcggttggatgcggcgatgtggccgcgcagggcctcgtcaaggctgggatcggtggtctggtctgccagggctaccggccacggggtggactggccggcgaaggcgagcgcatggggctcggtggctaggcgattgaggaagaaggtggtcattgctttccttacttgtgtttggttgacgtcttcaaaaatcagaggggctggttgccgtggtgtttggtggtgcgcttgacgcgccgcttggtggcgagcgtggccagcgattcgacaatcacctcacgggtctgttcggggtcgatcatgccgtcgatctgcccgatttccagtgacaggttcgcgttgacggtgctggtctcgtactccttgatgtacttggcccgcagcgcatcgacgtcctgtccggaggccttggccttggccaggtcgtggcggtggatgatgttcaccgcgccggccgcgccgagcaccgcgatctgggaggagggccacgcgaagttcaggtccgcgccgatggccttggatcccatcacgatgtacgcgccgccgaacgccttgcgcaacaccacggtcaccatcggtacctgtgcgttggcgtaggcgtagatcaccttggcgccgcggcggatgatgccggcgtgttcctggtcggagccgggcttgtagccgggcacatccacgagggtgaccacgggcaggttgaacgcgtcgcacaggcgtacgaatcgggcgactttctcggacgagtcgacgtccaggatgccggcgagcacgttcggctggttcgccacgatgccgaccggcttgccgtcgatgcaggcgaagccgacgagcgcggaggcgccgaacagttcctgcacctgcacgaattcgccgtaatcgacgatgcaacgaatcacttcgagcatgtcgtagggctgacgttcgttggtgggcacgatggtggcaagtcgcttggcggtctcgcgttcggcgcgggtgacggcgtaggcgtagaccggcggcttgctttcgctgttggacggcaggtaggcgagcacggtgcgcgcatagtcgatggcgtcggattcgtcctcgccgaggtagtgggccacgccggacacccggttgtgcacttcgccgccgccgaggtcggccatggagatggtctcgccggtcgaggccttgaccacgtccggtccggtgacgaacatgttcgagttctcacgggtcatgatgatgaggtccgtcagggccgggcagtagacggcaccgccggcgcaggggccgagaatcaggctcagttggggcacgaagccgctggcctcgcaagtcttgcggaagatgcgaccgtactgggtcagggcggccacgccctcctggatgcgggcgccgccggagtccacgatggccacgatcggcactttgaggtcgatggccatgtccatcagtcggcagatcttctcgccttcggcggtgccgagggtgccgcccttgacggagaagtcctgggcgtagacggccactttgcggccgtagacctggccgaagccggtgatgacggccgcaccggcgttgccgccggcgatattgccgccctggaagcggccgatctcctcgaacgtgccggtgtcgaagagcaggtcgaggcgttcgcgcgcggttttcttgcctttggcgtgctgcttgtcgcgggcgcgctcttcggcggcgcgggccagttcggcggccttgaccacagcggtgcgcagcggctggtgggccgaaggctgtgcggcgttggcggccgaggccgcagccgcggccttcacggcctgcgaatccatgatgtcagtcattgccaccctccttcttggcgtcggtggccttatcggctccttctgacgagggagctgtcgacgcagccgcctgagggagagatcccggcgcagccgcagcagccttggccttgccggcgttcacgtccagcgtgaccagcgtgtcgccggcctccacgccgtcggccgggccaacgaaaatcttcttcacttcgccggcggctggcgcgtacacgtagttctccatcttcatggattcgagcaccaccagaaggtcgcccttggccacttgctggccttcggacacgttgatgcgcgtgaccacggcctgcatcggggaggcgatgacgccggatttggcgccgtcgttggccgcagcggcactggaggccacgttgtgcagtcccgcaccgcgcaacggctgggtgggtcgcttggcaccgcgggcgcgggccgagccggtgatgttctccacgatgtcgagtggcacggtgagcttgacgcggcggttgttcatctcgatgacgaacgtctccgacttggacttgtcgggcgcggccggggcagcggcacccggggcggcggccaaggaggccggctggccggaggcggcggaagccggtgtgcggttcaggtacgtgcgctccagccacttggtggacacagcgaacgggtggccatgctcggcggtgaagtcgtcgttgcggaagatttccttgaacagcggaatcggcgtgggcacgccttcgatcacaagctcatcgagcacgcggcgcacacgggccacggcgtcgagacggttctgggcggtgacgatgaccttgcccatcatcgaatcgaacttcggggagatggtgtcgccctgttccacaccggtatcgatgcgcacgccggggccggccggccactggatcttctccaaggtgccggagccgggggtcaggttggtggccgggtcttcgctggtgatgcgcagttcgaagctgtggccgcgcagttcgggggcgcgggtgagctcgccaccggcggcgatattgagctgttcgcgcaccaggtcgaggccgctgacctcttcggagacggtgtgctccacctgcaagcgcgggttgacttccaggaagtacaccttgccgttcggggtcaccatgaattcgcaggtgcccaggcccacgtagccgaccgtggtgaacaggcggcgggagtattcctcgagcgtgctgatgatttcctcggacaggaagggcgcgggtgcctcttccacgagtttctggttgcggcgctgcagcgagcagtcacgggtggagtacacggtgaagttgccgtgcgagtcgcgcccggactgggtctcgacgtggcgtgccttgtccacgaacttctcgatgaagtattccttcagatcgccgccttgcagcgcgtcgtggttcatgtagaagcggcgcagctcctcgtcgtcatgcaccacggtgatgccgtggccgccaccgccatcagtgcgcttcatcatgatcgggtagccgtgggtgtgtgcgaagtcgagcagcgtgcgcacgtcggtcaccggttcggacaggccgggcactggcggcactttggcgcgtagggccacgcggcgggcggtaatcttgtcgcccaaatccaccagcgcggtgtggtgcgggcccacccagatggcaccggcatcctcgaccttctgcgcgaagctcggcacttcggaaaggaatccgtagccggggtgcacggcattcgcaccggtcttgtgcaggatgtcaatcagcagatcctcgttgaggtacgtgtccttgtaggtgtcgccggagagcaggtatgcctcgtcggccatgtccacatagcggctattgcggtcctgttcggagtagacggccacggtggagatacccatctccttggccgtgcgcaccacgcgaagcgcaatctcgcctcggttcgcaatcagcagttttttgacgatagaagccatagtgtcaaattgtgctctctatatagaggagagggcaagctgcgttcacacaaaagctttcacgcccttttgtaggctacgaacaaacgcgcgcgtaggttccggcaacgtaaccgttggcgcctgctatcaaaaacgttgcaaatccgccgattgcacatccttgcgcgccggctcaagaagttgacgttacggttgtgttcgtcaacttatgacaaatcgaaatcgacaattttgtaaattggtacgaaaccgcacgaaatcgaacacctctacgatggcaaccgtaagttcgggggaaggctcatctgcgggcgaacggaaggtgaccggaccggcatcggtccatcgccgcacgattcgcccgcacagggtcggattcatttgggaccgtccaccatatggacggttcggactgtcggggataccgcacgacccgccggaacctcccctcatccatcgcataccgcccgccgttcacggcgatatcacgcaacataggggtcattgatatgcagacttcacacaccaccgcatccgctgcggccaccacatcgctcgcccgtcgtatcgtcgccgcatcctggaagccggtgctgttcgccgtgctgatgtggctgtccgcggccgccggcgagattccgattccgggcacgccggtgccgatcacgctgcaaacgttcgtggtgatgctcgccggtcttatgctgccgtggcgtcaggccggcgccgccgtcgccacctatctggcggccggtgcggtcggcctgccggtgtttgccggcggcacctccacgctggccctggtcggcccgagcgccggcttcctcttcggcttcctgccgggtgtggtggtcatcgccctgctgcgcggcaagtccgacacttcgtccttcgcggccgccgcgcgcaccgcgggccgctacctgctggccgcgctggtcggcggcgtcgtggtggtgtacgccttcggcttcgtcatccagtccgcgctgaccggtgcgccgctcgccgccgtggccctggcctccatgggcttcgtggttggcgacgccatcaaggccgtggtggcctctctggccgccgccggcctgtccaagctcggtcgctgacctgagctactagctagctactggccggctattacagcactcccacatcggcggtgcggaccgtatggtccgtgccgtcttgtgttctcaggatcagtgaggcgtcttcgttgaggccgatggcttcgccggtcagcgtggtgccgtccgtgaagtgcgcctcgacctgacggccgcgcgcccagcacaccgccttcacctcctcgcgcaacgactcggcctggcccttcgggtcggcgatgaacttcaccaaccgctcgcggaagccctcgacctgacgttcggccaccgcatcgcgcatctcgccgaacgacggcagcccggagacatgcagctgcagcgaggtcgattgcggcgtgggcagccgacaggcgcccaaggccaggttcaggccgacgccgaacacgatgacgacgtcgtcatcgacatcagcatcagtaccggtaccggacgacggcggaatcaccagttccgagagcagcccgcccagcttgagcccgtggcagaacacgtcgttcggccatttgagttccagcgagcagtccggctggttcggcgcggcaccgtattcctcgatcatgccgttcagggcgtccagcgtgaccagtccggcgatcatctgcagccagccattgacggattcgtcggtggcgatcgcgcgcggaatgcgcacggcataggacatcgtcgagcaacggccgggctgactgacccacttgtgaccattgcgcccacggccggcggtctgccggtcggcggccaccacggccaccgccagttcgccatcctggtggtcgggcaacgtcaacgacccgtcgccaatcatctgtacggccagcgcgttggtcgaatcggtttcgtccacggcgaccacatgatctgcgacggctgtagttctgggtagctgcggcgttgcagctttcaacgcaatcatcatgggcactacgttacctcgattttggcgcgatatgcccgcgttattccatggaaaagcgcgcaaaatcaactattttcacccacatagcccatgttaacgttcacaacttcggaaattccgcattcgccgaccccacgcatgcacccggccgtcatattggcttgcgaacaatggcgatgcccggcagacatcgaatatcaaccgttgacctgtgcggctaccatatattgtcatgacgtcaccagccaccgcgaagcttgccgccgtatccagccgccagtcccacccgcatcttgcgcgcgcgggcgctgccgcgcgctggacactggccgtgctggccggcctgtggcttgcactgtgcacggcggtcggcccgctgtactgggacgaggagaacggcaccctcgcccattggaactgggccaataccgcaatattcgtcgtgtcattcctgatatatctcggaatcatcacgctgatggtgcgattcgcagcaggccagcgcatactgccgagggctatcggcgagcgactacgtcaacatcagcagaatagcgaaacatcacggcccgccgccgatcagcaggccagccaaccagccaagacccgtcgtaccgttcgcgctatcgtcacgtccaccgtcactgttctggaccgctggatcacacgcggcacgaaccggttctggaagcttatgctggtgttttttgtcggctggctctgggtgccgaccactctgctggccgcattcggtgcggacctccgctcacagatccgtgaattcagctgggcctggaaccagtggaccggcctgaaacagccctatatcggcttcttctccttcgtgccgatggacatctaccccactgcgcactacatgtggccgtccgatcccacgtatctgaccgaccagcacaatgtggtactcactgtgttctatggcgcgatggtcacgtttgcgaggcatctgaccggctcaaacgatgccggtatcgtgacgttggctgccctgcagacgctgttcgccgtgttctgctgcgctgccgccgccaatcgattcctgaaccggccttggataggaaaaacggcaacggattccgccgctcccccacaggccggaggattggctcgattcctgattctgctgttctttatggtctgcccgctggccgtgttttccactatctccatcaccaaatcgccgctgttcgcgttctcgttcgtctggtggttcagcgtctggtatgaactcgtccagacctggcaccccgccggcacccgcaaacatcctcagacccctgccatcgccacgcccgtccacttgccgcgtcacagtttcatcgcctttatcctggccacgtcggtaatgctgatttccgcgaaatatgcgtggtacatcatcgccctacaaatcgtgctggctctgatcgccgaccgcaagcgctgggcgacttacgtcgtggcgctgctcatccccaccgtactgattcacggcggcatctccttcgccatctcctctggtgcgatcatcggcggcgacccaatcgaaagccgcggcgtacagctgcaaatgatcgcccgcgtggctcagcgcaatccggacggtatttcagacgaagccaaaaagaacctcgcgcccgtcttcaatctcgatcagatggccgacgcttactcccagcaggatgccgacccggtgaaatcctccggtattcaggccaagaaggtcagctacaagtggcgcacggtgacgcccgaggatatgaccaatttcaacaaggcatggttcgaaatcgtcaaggacaatccgatcatcgcgctggatgcgttgctggccaaatgcttcggatacttcaatgtgaacgatcagccgtacgtatcgatggattattacgtggccagcgattacgtgcagaaaaactccacatggatcaaggattacaaccatgactggcgtgagcacatcgccggcttcactcgcgtatggggcagtattcccgtgctcggctggcctacgcacggcaatttctacgtggtgatgacattgctgatcggcgcggccgaggtgattcgccgacgttggctcaccctcatgacccatattccgctgctactgctgatgggcgtgatgattaccgcgccggccaataatttcgagcggcacatgttgccggttgcgtttgtattcggattcgtggtgctgacgtattggcgagagtctttggctgaaaggcaacgccaatcagcgacgctacactagtgactatgtcagattttctcgaacttcttgctgccgacgttgccgattcgtccggtgcatccggtatgccgggtgcgcccgattcatccgattcggccgcacccggcatcaccgcgaccaaccgcgtacgcaccgtgctgttcgagtgcctgttcaatcatctggccgacgaacgagtggagtccctgttcaccatcctcggtttcgagcatgacttcgattgttacaccatcgccggataccctgcccggtccgccgcacgtacggccaaggaaatcgagaaaatcgtggccgatttcggcggtatgtgtctgaccgccaagcgcccgatcggcaacagcaccgccgtagtggcgttgattcgtccggtcggtgcggccacgccggaaatcatctgcaataccatcgccccgtcgttcgccgccgatcggccaatcgccttgggtccacagcgcaccggtgccgatggcgcgatgcgttcgattcaggccacgctctactgtcttcaggccgcgccggccctggccgccaccgtgcagccattgccgcgcccgttacgcaccgacgacgccctgcccgaacgtgcgttgatcggcgacgcggacgcccgtgacgaactggtccgcgtggtctacggaagcctgacagcagcaggccctgatgatccgacgctgctcaccgtctccacattcctgaagttcggcggttcgctcgagaccacggccaaggagctcaacgtacatcccaatacgatccgctaccgtttgaagcgtgccgccgaatccaccggctgggatgccaccgacccgcgcgaggcgtacgtgctgatcaccgccatcgcgttgggtcgtgtggccgaagcgtaacggaccgcagcgtagtcgggcagaagcataaccagcagaaccgtagccgtcaaaggccatagctgaccggacataaccgtccagcccgacagcctagcgggccgaatcaggctgcctgaatttcgcgtacgccatcgcgcagtaacgcggccaaggattcttgagtggctaacacttcgtccacgaatccaccggcggacaggctggcgatcacgcgaccggactcgttgtccacaatcggtacaccgacggcaccgacacccaacgtcacatcctcatccgacagtgcatatccacgttcgcgagtcaagcgaatatcctcgcgcaactgttccacactgaccagcgtgttctcgttatatgccggaaacggcactcctgcaagatagcgttcgacatcggcatcctcgaaatacgccaaggccacgcggccggccgcgccagcatgcagaggcagcacgcggcccgggcgcaggatcagcgaatcgatggcatgaccttgcgcgcattccacgcataccaattcagtgccggagaccacactgaggaatgaggtcatgccggtttgcgcggtgatggcatgcatgaccgcaatcgcaggctgccattcggtacgagacgtgcgagcggcatcagccaatcgcagccagtccagcgataatgagtagttgccatccgtatccgttacggcccaccccacatcgaccagtccatccagcacacggtatacggaggatcgcgggatatcacaggcgtcggcgatatctgccggagacaggccattctccgccgccaatgcgtccatcacacgactcgccttgtctaaagcgcgggtcggttcacgtttgtcttccgccatcgccgacgttccttccccctgacttatccctgactcatcgtattcaactgctcaggccaagataatcaccgctgtatccaaggcctcgcgacacctcgcggccgacagtctgcaccaattgcaccatgtcttgagccgatgccgttgccggtttcccatctaccagacaggccagctcaggttccaaggagcgggaaaggccactcagggcgattgccgcctgaatctctccggcgtgattgaataccggtacgctgatagtcacggagccggccatggtctggccgacatcataggtgaagccgcattcacgtatatgacgagcctgtcccattgctgtggtacgcatcgtggagaatgtgccgccgagctcgttgttataggcatagtgttccaacagctgctcgtagcgagccgggggaagccaggccgtcagtacatgagagggagcgctcatgctcagaggcaagctattgcccaccagctgtgcatagctttgcaatgcctcacgggtgcgtgtctcgatacacaccgtgcgcaatcgcctccgaacgaacagaccccagatgccgaactggccacgatgggcgcggaaggtacggcgagcgatctgctgaatgtccagtctgctttcgatttggccgccgatccgtacgcaatcgatgccaagccgatactcgccacgattgatgccgcgttccacccaaccgactgcggcgagattatccagcaaacgatacgttgagcttacgggttcaccagtacgttcgcttatggtttttgcagtgcttggtcccagttccgccaatacatcaagtactgccttggatttcaccaatgcatctacgctacggtcatcacggcttggcgccaccatgcgcgtcacctcctggcctgtatgttgatacctcagccatcttaccgggtattcagcgggttgccgcccaaaacgcactgggccccggcaggagtatcccgtcggggcccaagaggtttctggctcccctctttgaggggagccgtccgcgcggcggaccgggggagatccgagacgctaaggcccaaggacgcgagaaacaccccgacgcgcgggtgtcctgatatggggaaagccccttggggcgtgtgctccaaggggcttcctgtacgtgtgatgcggcggcgtgctactctcccacaccctgtcgggtgcagtaccatcgccgtgccaggccttagcttccgggttcggaatgggaccgggcgtctcacctgggccatggccgccgcaaatcttctcttatacggtcagacgctggggtctgccggcctgtggcggcctgggaaccggacagcggacgcggatatgtcgatgtttcgtcttgtggccagacaatgctcattgccgtctggtgtcgtttgcaggaggaagatgcggtccccgaaggaatcggggaatgttagtgttgcctttcgtccgttagtaccggtcggctccacccctcgcggggcttccacgtccggcctatcgaccacgtgttctgcatggggactacaggaactcgaaggttccacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcagcattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatgactgttcgaggttagacatccaatgcgaacagagcggtatttcaccttacggctccgcgcgatctggcgaccgcgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctcccacagcaagtgtgttcaccatcgggggtctcccttaaaccgaaggaacgggagtgatttgccgagttccttgaccaggattcgctcgatcgctttggtattctctacctgaccaccagtgtcggtttggggtacgggcggctttgagcctgacgccgaagcttttctcggcagccgggatcaccggatatcgggccataaggcccccatcatcgcacctcggacccatgcgggacggatttgcctgtcccacgccctgcgtgcttgaccacggaagaccacctccgcggccggctacccttctgcgtcactcctgcgctgacctactacaaggatcggtcccaacaggccagggcatcccgcccccgaaggagcagtaagcccggacccggaggttagtactccaagcctcggttttggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctctcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaagggtggctgcttctgagccaacctcctggctgtctatgcgactccacatcctttcccacttagcacacgcttcgggaccttagacgacggtctgggctgtttccctttcgacgacgaagcttatcccccgccgactcactgccgggatacgcgtcaccggtattcggagtttggttgctgttggtacccgatacgggcccgcaagcatccagtagctctacccccgggacgtaatgacccgacgctgcacccaaatgcatttcggagagaaccagctatcacggaatttgattggcctttcacccctagccccaagtcatccccccggttttcaacccaggtgggttcggtcctccacgcggtcttacccgcgcttcaacctgctcagggctagatcatcccgcttcgggtccaggacacgcgactcaaacgccttttaagactcgccttcgctacgcataccccacacgggttatgctcgccacatgccactgactcgcagactcatttttcgataggcacgccgtcaccccacaaaagggctccgacggattgtaggcgcacggtttcagagactgtttcactcccctcccggggtacttttcacctttccctcacggtactcgttcgctatcggtcagacaggaatattcaggcttacccaacggtctgggcggattcgcacggggttccacgggacccgtgctacttgggagacgcgatcggcagaccatgcgcgttcaggtacggggccctcaccctctgcggcccggtattcaacccggttcccctgacacatggttttctgcaactgccggccggcccgtcggagccggcgcacgcgatcccgcaacaccccgcgcgcaacccccgacgggtatcacacgcgcaaggtttggccatcatccgctttcgctcgccactactcacggaatatcctttcctgcaggtactgagatgtttcacttccctgcgtaccccccggccgaagccggtaccgacccatgacggtcggtgggttcccccattcggaaatcctcggatcaaagccctgttggcggctccccgaggcatatcgcagcctcaaacgtccttcatcggtcctgtctgccaaggcatccaccatacgcccttgcaagcaacacacaccacgaaagtgcatggccgcaagattcctctagcaaattcccagacgacaaatcatcacactaaaaatgatcacaaaacgatcgaaacgaacaatagagttcgattcgaaatcaacagcaaaacaaagattcaaaaactcttgttttgctcgcgtccactatccagttctcaagccaccacgcaccgccacgccgaccagaccggcacacggccggcccgcaggcacgacgggcatcgaatcgcgccaggcaaaaagcctggggtggcgatccgggagcccaaaagcgcatccataccaccccggcacccaccgcacgaccggcagggcaaagccaacgacgtcttccacaccagcaaccccgccgccatcgcaccatgcgacgcgcggggcgcacaccgtcggacgaacatccgactgaattctccgtagaaaggaggtgatccagccgcaccttccggtacggctaccttgttacgacttagtcccaatcacgagcctcaccttagacggctccatcccacaagaggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcataatccgctggcaacacggggcgagggttgcgctcgttgcgggacttaacccaacatctcacgacacgagctgacgacgaccatgcaccacctgtgaacccgccccgaagggaagccgtatctctacgaccgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactctcgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggaacatccggcattaccacccgtttccaggagctattccggtgtatggggcaggtcggtcacgcattactcacccgttcgccactctcaccaccaagcaagcttgatggatcccgttcgacttgcatgtgttaagcacgccgccagcgttcatcctgagccagaatcgaaccctccacaaaaaaacttcatgaaaagcatccgaatagatgactctcaaaacaaaaattgacgagcacgtccttaaggaaggacgccctcaaaaaacctcacccctcatcaaaccctcccgggtacccaaccaccacgacaggcaatcaggcgaggaatgaactggcaatcattgactataaagaagtagtacaaacacgctcttgagttctcaaaccaccaccacaccagccagacgggaaaccaaccagaggaaggaacccgccgcgctgagcggcaacaggtgaataacttacacgcatgtccggattcacgcaaatcaaggcgcacaaaaaccccaggaatcgttgcaatcacacggttccctcggcgtgtcgcaaacagcctatttgcgctgttctgatatcagaataatccgttttgcattgccgatgcgtaacaaattcatgtgttcatcggcgtgttgcaagaattcgattgcgtgaccatccaggttcaccttctcgcaaccggtcatcgcatatgcaaaaagggacttccctttacgggaagtccctttcagtagctattgaagctcgctagcttcaggccagggtgttcgggtcaaccggaacgcccgggttcatcgtggaggtgatggttgccttggtcaggtaacggcccttcacggtggacggcttcagacgcttgacttcgtcggccacagccttgaagttctcgtccagagcggactcatcgaagctcatcttgccgatgaggaagctcaggttgccgttcttgtcgacacggaactcgatcttgccgcccttgatgtccttgacagccttggtgacatccatggtcacggtgccggtcttggggttcggcatcaggccacgcggaccgagcacacggcccagacggccgaccttgcccatcatgtccggagtagcaaccacggcgtcgaagtcgaggaagccgccctgaacctttgcgatcaggtcgtcatcaccgacgatgtcggcgccagcctcggtagcctcggtagccttcgggccacgggcgaacacgaggaccttggcggtcttaccagtgccgtgaggcaggttgacggtaccacgcacgagctggtcggccttacgcgggtcaacgctcagacggaacacagcctcgacggtctggtcgaagttgtaggagggcatgctcttgagcagagcgatggcctcgttggcggtgtagaggttgttgcgatcgacgcgctcagcggcttcgcggtacttcttggaacgctttaccatctgtccttctccttatcagtccgtaaccgtgatgcccatcgagcgagcggtgccctcgatgatcttcatgccggcctcgatatcgcgagcagacagatcttccatcttgatctcggcgatttcgcgaacctgcgccttggtgacagagccgaccttgtgggtcagcgggttctcggtgcccttctcaacgccagcggccttcttcagcagagctgcagccggcggggtcttgagcacgaaggtgaaggaacgatcttcgtaaacggtgatctcgacagggatgacctgacccatcttgtcctgcgtctgggcattgtatgccttgcagaagtccatgatgttcacgccatgcgaacccagagccgggcccagcggcggggccgggttggccttgccagcctggatctggagcttaatcagcgccgagactttcttcttgggagccatattatggttcttctttctataacgcggttcgaatggtcgccgtcctcaggttcggctgtctgccatcatgctcggtcttgactcattatttatccgtgcatgctgtaggcaatcggcctgtggtcggtctcctcccgcaacttatattgctgtgctgtgctagcgagtctcctctccagacacaagctttcctattatgcaaatccacccggacaacacaaaaagcccgaccacgatggtcgggctctgcaaagtttgggagttaatctagcttctgaacctggtggaagccaagctccaccggcgtatcacggccgaagatggacacgagcacggtgagcttctgagtggtgggctccacgtcggaaacaacggcggccatggtggcgaaaggcccatcggtgacggtgacctgatcgccaacggcgtaggagacctcgaccctgcgcttcttggcggcggcgggcttgtcgccggcggccttgagtgcctcggaagcaatcatcggagccatcatcgccacgacttccttgcgggagagcggcgccggatccttggtcgggccaacgaagccggtcacgccttcggtctcacgaacgatacggcgggcgttctcatccggccacatacgaatcagcacgtagccaggaacacgcacgcgggtgatgaccttcttgcccttctcggtgtgcttctcgacttcttccatcggcacctcgacctggaagatctggtcttccatgccgaaggaggcgacgcgggactcgatgttggtcttcacgcgcttctcgtagccggagtaggtgtgcagcacgtaccacttgccatcaagggaacgcagggacttggagaattcgtcaacggcctgctgaccggcatcggtctcctcggcctgctcggattcgttgacttcttcctcgtcctcatccagagaaacggtctcggtctgagtggaagcaacgggagcggattcagtcgccgccggagcgtcggactcaacatctgcattgtcgacggatgcgtcagattctgcggaaaggtcagcgaccggttcgaccggggcagctgcctcatcggcagcagcttcggaagcctcgacaacaggctcctcagccgggacggcgtcgaggttctcgagattcagttcatcactcatgcgttgttattcaccttaggttgtgcggatcagccgaacacccacagcgtggccttgcctagaccgaagtccatgccagtcacgagggccatcagcagcagcacgaagatgaatacggccagagaccagaagaacagttccttggcggtaggggtcacgaccttgcgaagctcgtcgatgatctgcttgatgaacagaccgatacgcatgaagacattcggcttgactgccttttcactcttgctcgtcttagccattccgtacctcgcgtcagctgcttgattattagaaacttggcagggaaggcgggactcgaacccacaacctacggttttggagaccgttgcgctaccaattgcgccacttccctaggtgaaaatccacctcggcgtgcgttccgtagagaacgcttcgccacggcgaaaccgccaagtcgttatagtaacggctccggtggattatcgcaaatcgcgtgtcgcgcgcgtagcacgcgactcttctcagttagcccattccttgaatcgacgcatgccttcggctaggtcttcgtcggccagtgcgtaggagaaacgcaggtaaccgggagcaccaaaggcctcgccggggacggcggccacgtgggcctcatccaacagtgcagcggcaaagtcagcggacgtatcggacactgtgcccttgggacccagcggcttgccaagcaaagcggtgatgtccgcaaaaacgtagaacgcgccggtcggagtcgggcagttgacgccctcgatatcgttcaaggcggtcacaatcgcacggcggcgcgcgtcgaaggccttacgcatctcgtgcacctcatccagcgggccggccacagcagccaaagcagcacgctgggagatgttggccacattggaggtcatatgaccctgcagcttggcggcggccttggccacctcaagcggagcgaccatccagccgacacgccagcccggcatcgcataggtcttggccacgccgttcagcaccagcaactgcccgcggcattccggcacggcggcaccgatgtaggtggtgtgcgcatcgtcatagttcaggtgctcgtagatctcgtcggagataacccaaatgtggtgctcgacggcccaacgaccgatcgcttccacggtttccggcttccagacggctccggtcgggttgttcggggagttgacgatgattgccttcgtatgctcggtacgggccgcttccagcgcctcaagcgagggctcgaagttcacgtcggcaccggcgaatacttcgaccggcacaccaccggcaagcttcacagcctcggggtagctggtccagtacggagcgggaatgatgacctcatcgccatcgttgagcaagatctggaaggattcatacacggcctgcttgccgccgttggtcaccacgacctgatcggcattgacctcatagccggaatcgcgcagcatcttagccgcaatcgcttcgcgcagctcgggcaggcccggcgtaggcgtgtacttgtaattcttcgggtcaaggcaggcatctgccgcagccttgaccacgtttgcgggggtcgggaaattcggttcacctgcgccgaagccgacaacgtcaagtccggcggccttcatggccttggccttggaatcgacggcgagcgtagcgctcggtgccacagtgttgatacggtcggaaagagtctgccattgcgccatagtcatggctcccatgctaaacctacagcacgaaaaatcgccagagccgcactatggtgatggaatctgtcgtgtgacagattccatcagtcacacgagcacgagattgtcgcgatgaaccagtgggtgggcgtactgggggccgaggaaacgcttgagttgggcggtgttacgcccgagcatctgcggaatttcttcggaatcgaagccggcgaggcctcgggccaggtgttcaccgctttcggcatcgatccagaccggatcgccggcggaaaaatcgccatgtacttcgagcgcgccggccgccagcagcgaggcacgcccgccgcgaatcgcctggccggcacccgcatcgaccacaatcgtgccgcgcgggtcggcggcgaagccgatccacagacggcgtgaggagccgcgggccttaaccggtgcgaacacggtgcccaccggatcgcccatcatcgcagggcccgcgttcgaggcgcaggtgagtaccgtggggatgcccgagacggccgccacgcgcgcggcctcgagtttggtgaccatgccgccggtgccgaccttggagccggagccggagacttggatgtcgcccagcgcatcaatcacgttgggcacatattccacacggcgggagccgggctgcgagggcggcgcagtgtacagcgcgtccacgtcggtcagtagcaccaaggcttcggcccgcaccaggttggccaccaacgcggagagtcgatcgttgtcgccgaagcgaatctcgttcgaggccaacgaatcgttttcgttgatgatcggcaccacgccgaggtcaagcagacggtccagcgtgcgttccacattgcggtactgggtggcacgaatcgtatcttcggcagtgatcagaatctggccgacgcgaataccgaatcgaccgaacgcagtctcgtagcgggccatcagtagcccttggccgacggctgcggtggcctgctgagtggccacgtccaccggccgcgagtcaaagcccagaggcccgaaaccggcggcgatagcaccggacgagaccagcaccacacgtccgcccatcaatcggacctgagccaaggccgcggccaacgcgtcgagcttgtccgggtcgaggtgaccgctcggctgggtcagcgagctggagccgactttcacgacaatggttccggctgcggcgatcatgcgccgcacctcggcctgactcggagtgctcatttattcctcggtttcaccatcttcgctggactcaccgtggccgaacaggctggtttcgtcatggcgatcgtcgtcaacggtcgggtcggcccagtggccggccttgcgttcggccatcatcgcgtcgcgcacggcggcacgggcgtccatcatctcgtggtattgggcacgacgttcggcgttggagcggcggtgcgtgcgcgggtccagctcttcgagacgcagatccttgcctcgggcaccgaggttggagccgtcgagcatttcggcaccagcggagatggtcggatcccaatcgaattcgaccatacgggcaccacgaccgatgcgcacttcgtcgccggggtgagcacccttgcggcgcagctcgtcctccacgcccagcttggccaagcggtcagccaggtagcccacggcctcgtcgttgtcgaagttggtctgcatgacccagcgctccggcttgacgccacgcacctcgaagaacacttcgccattgccgagttcgcggcgctcgaccgtgaactcaagcgcactgccgccctcgtcagcacgacgcggacggcggcccttggtctccaatggcttgatgaccacgcgagcctcctcttcggcctgctcgcggttggccacttcctcacgcatctcgtgcaccagcgcagacaacgcgaagttgagctcctttagaccctcgtgcgaggcagtggagatctcaaagaccttcagcccgagtttctcgaactccggacgcacgaactcagccaattccttggcctcgggcacatcgatcttgttcagaatcacgatgcgcgggcgttcgggaatcgggatggcacccaacggcagctcgagcttgtcggcgtagagcgccaactcgttttccagcgcgtggtagtcggacatcgggtcgcggtccggttcaagcgtggcgcaatcgatcacatgggcgatgatttcggtacgttcgatgtggcgcaggaactccagtcccaggcccttgccttcggaggcgcccggaatcaggcccggcacgtcggcgatggtgtatcgagagtcgccggcgataacgacgccgagattcggcaccagcgtggtgaacgggtagtcggcgatcttcggcttggcggaactcatcgccgcaatcagggacgactttccggccgaggggaaaccgaccaacgccacgtcggcgatggacttcaattccaaaatcacgtcgcgctcttcaccgagttcgccgagcagggcgaagccgggggcgcggcgggtcttgttagccagggcgatgttgccgaggccgccggcaccgccttgggcgacgacgcagcggtcgccctcgtggcgcaggtcggcgagctgcgcgccgggatgcttggctttgccctgttcgccgcgcgcctcaaagacgacggtgccgcagggcacgggcagaatcaggtcctcgcccttggagccgtccttattgtcgcccaaacccatggtgccgctgccggcgacacgatgcggcatgaaacgatagtcgagcaggctggtggcgttacggtcggccacgaacaccacggaaccaccgtcgccgccattgccaccgttcgggccggccaacggcttgtatttctcacgacggatgccggccgaaccgttgcccccatcgccgcccttgacatggacggttactcgatccacaaaatcactcatattgattaccttacaaaaaagccgcgtccttacgggcgcggcttgaaaaaagcttgacgctatatcgctcaggcgatgacgtcgacaaccttgcggtcgcgacgcacaccgaacttcacggagccatcggtgagggcgaacagcgtgtgatccttgcccatgccgacgttgtggcccgggtggaagttggtgccacgctggcgaacgatgatgttgccggccacgacggcttcgccgccgaacttcttcacgccgaggtattgcgggttagaatcgcgaccgttgcgagagctggacgcacccttcttatgtgccatgattcatggtcctttctataactcaggcaatcgccgtgatcttgacgatagtcagcttctggcgatgacccttacggcgagcaacaccagtcttgttcttgtacttctggatgctaatcttcgggcccttggcttcgtcgttcacaacctcagccttgacggacaccttggccagatcggcggcggcaagggtgaccttgtcaccatcgacaacgagggagaccgggaattccacggtatcgcccttcttagcgtcgagacggttcacgaggatgacgtcgccaacctcgaccttttcctgatggccaccggccttcacaatcgcgtacattatcgttccttttatgttttggaaagctaccttgcctaacacgcaccgagcttgcggtcagacaccgagtttcgaatctacaccaccatgcggactaaatcaaatgatttttgcccgcgtgtcaagcacgacacacctgttactcttccgcttactcttccgccgtgttgttggcagcgacggcagcggcggcaatctgagccagtttggctttgacgtcggcgctggaaccagccggttcgggagcgggagcggtgccgcgaccgtgcttgttggttttgacgaacgggtcgccaccgcgaagcgcgtagggatcgtcgtagtcggccgaaacggtcggctgatcatgcaggatgaaaccacggcccttgcaggtcgggcattcctcggagaacgcctcgaccagaccctggccgatgcgcttgcgggtcatctgcaccaaaccgagcgaggtgacttcggccacctgatgcttggtgcggtcgcgtgccaagcattcgaccaagcggcgcagcaccagatcgcggttggcgggcatgaccatatccacatagtcgatcatcaccatgccaccgatatcgcgcaggcgcagctggcgggcgatctcttcagacgcctccaggttgcaacgcgtcaccgtttcttccaaggacttgcccttgccgataaagcggccggtgttcacgtcaatggtggtcatggcttcggtgcgatcgatgacaatcgagccgccggacggcaggtagacctgacgctccatgcccttacgcagctgggagtcgatggaccacttgtcgaacacgtccttgccttcatgctcggccgggtcccacttctccagcttgtccttcaagtcgggggccatggtgtcaaggtattcctcgatacggtcgtagaccttgtcaccttccacgatgagcttgctgaagtcgtcgttgaagatgtcgcgcaccacgcggatggccacgtcgggctcgccctgcaggagcttcgggcgcttaccgtgccagaattcctcgcgcttggcgttgatgcgctcccactggcggaccagtgattcgagatccttgacgatggcgtcttcggatgcgccctcggctgcggtacggatgatcacgcccatgtctttcggggcgatcttggagacgatgttcttcagacggctgcgttcgcgctccgaaagcttgcggctcacgccggtcatgccgccggatggcacgagcaccaggaagcggccggcgagcgtgacctgagaggtcaggcgggcacccttgtggccgatcgggtccttagtgacctgcacgagcaccgggtcgccggacttgaacgccagctcgatgcggcgcggctggccttcgagacgagcggcatcccagttgacctcgccggcgtagagcacgccgttgcgggcctggccgatgtccacaaatgcggcctccatgctgggcagcacgttctgcacgcggccaaggtagatgttgccgacggtctgtacttcctgaatgtcggagacgtaatgctcgaccagaacattgtcttccaccacggaaatctgggtgtgatgttccttctcacgcaccaccatcaggcggtccacgttctcgcggcgtgcgaggaagtcctgttccatgagctggctctggcggctgcgctcacggcggttgtcacggcggcgctgcttcttggcctcgagacgagtggagccctccacatcagtgatctcgtcgatgtactgctgcttgcgggagcgtcggaccagcggctgttcgctgttctgactctggtcgtcggtgccctcgccgttcttgccgccacgacggcgacggcgacggcgagtaatggtctgctcctcatcgtcctcatcgcgatcacggtcatgatcatcgcgatcgtcacgacggcgggaacgcgtatcttcggcatcgttctcggcggtatcgtgctcgccgttggcaccggtttcgccgcgtgagccgcgacggcggcgacggcgcgaacgggtgcgggtggcgtcggattcttcgtcgccctcctcttcggcaatcggcgagtaggcgatatcgtccagctcgaggtcttcctcaatctgctcgacttcggcggctgcacggcgctcctgggcgttcaggcggcgggagcgacgggaacggcgagagtcggaagcgtcatcggaatcgaaatcatcatggtccgtgttggcgctggcattggcgtcaccggcggcagcgttgcgggaagcgtcacgagacgcatcacggtcggcggcattgcggccacgatcgtcacggtcgtcacggcggcggctgcgcggctgcgcgtcgtcatcatcgtggctgcgcgagcggcgggagcgacgcgacggacgttcgtcgtcgtcaacatcgtcatcacgagtgtcagcggtatcgtgcgcatccacagcggcgggcagtaccggttcctggaagagcagggacgtcatcggcttgccgcgacgcacggcctcgtggccagagggcagggattcgaccgcgtcgaacaggcgctcatccggggtgtcctcgtgcgtatccgcaactgcacggcgagaacgacggcgaaccggacggtcctcgtcatcatcatccatatccatagacgcacggcgagagcgggagcgaaccggccgatcctcgtagtcatcatcgtcggactggcgggagcgagagcggcggcgaaccgggcggtcctcgtcgtaatcgtcatcgtccacaaccgaacggcggcgggaacgtggggcgtcatcgtcatcgaaatcatcggcactgacagtgcggcgcgaacgacgaggacgatcatcctcgctatccgagtcggccactgcggaagcggcgcggcgcgaacggcggcgggttggacgttcggcggaatcctgggaatcgctggattcatcggaatcgctggaatcggctgacttggaatcggccgcagtgccggcatcgggaagcgcgggggcttcgaacagcggggcgcgttcctgcacttgcagttccagagaagcgccggcagcaccggtgccgcggaccacgcggcggccgccacgacgacggcgaacaggttcggcgggctgggaggcggcggcaggcgcagcgttcacggctgcagccgaatcggcattggatacggttgaattatcggttccgtcgttgacgaaaccttcacggttgtcagtgggcacaatgctcctcgcggcgcgctgcatcacgacgcctatttccaggcctatacgcttgtctcacaccacgctctcaccgtggccgcacgaaaacgcgccgcgtaaaggcaacttcgtctcaagtctgtcctgcgggtggcggacaccggcgcttgcgttgtctcattctcaagagccgcaaggggatcgacgccatctcgcacgctgatggttatgcagaaccaccatcctttagtatgccacatattttgtgcgggcgtggcccggcgaggctgacgttctctcggctcccctcccccgcggtgacagctcccctcagggaggggagctagagaggtgtcagaccagccagtcggtaaggattgcggccatggcggtcaggtcggattcaggcacctgctcgtcgtgcttgtgagccagcagcggatcgccggcaccgaggttgacggccgggataccgagctgagagaagcgtgccacgtcggtccagccgagcttggccagcgggtcgcggccagtgcgctccttaaccagtcggaccagatcctgggcgagcggggcgttcaggcccgggcgcgcggaggggctttcgtccttcatttcgatgccgtagccctcgaacacgccgccggtagccacatgctcgccattgccgagttcggcaccggcgtccgcgcccatcatcagagccttggcctcggccaacgacttgtccggggcgaagcggtagttgacgtgtacgcggcattcatccggaatgacgttcgtgcctttgccgccggagatcagcgtggcgttgaggccctcgcgataatcgagcccgtccacgttcacggtggccggctcgtaggcgttgagtcggttcagaatgtcggccgccttgtggatggcgttctcccccatccatgcacgggcggagtgcgcggccacgccgtgggttacgacgtcgaagcgaatcgtaccgttgcaaccgccctcgatgccgctgttggtgggctcgccgatgatggcgaaatcgccggtgatccaatcgggatgggcctcgacgactttgcgtaggccattcttttcggcgacgacttcctcatggtcgtagaagacgtaggtgaggtcgactttcggggtggtttccggcgtgcggccgtcgagcgtggcggcgaggtagagcatcaccgcgtcggaggccttcatatcggtggcaccgcggccccacagcacgcggtcttcgggatgagcgtgggcgatttcttcgcgaatcagcgaatcgccgggctccagccactttggtgggaaattgtcgatgaccggcacagtatcgaggtgcccggccaagatcacacggctcggcttgccgaagtcggtgctggccaccactgtgtcgccgtgacggcggacggtcaggtgctcttgctcgttaaggaaggcctcgacctcgtcggtgagggggccctcgtggtcggacacggagaagttctccatgatctgggtgagcaggctgttcagctgctcggcagtggatgcggtgcggttcaattcaagcgtcatgtgaacagcgtaccgcgtgggcggcgggcccagcacactcactacatgagattttgcggccgaatacatttttatgtgccacactggggtggcgaaagggaggattatgccaggtctaatcagcgccatgcaaggcttctgcgttatcggcatcgtaatcgcggtgggatatgttgccgcacgaatgcgaatcggcgggccgtccgctcagatggtgctcaaccggttctccttcttcgtatcgagcccgtgcctgatgttcgcgattctctccaaggagccgattttcgacatcttccacccctcgattatcgtggcgttcttctccgccgtgctggtaggcgtggtgtttttggtgctcaaccgtatgttcttccacctgaatgccccggacgccaccatcggtgccctgaattcgctgtacctcaattccaataacatcggcctgccaatcgccacctacattctgggcaatccggctcttgtggcaccgattctggtcatgcagcaggccatcttcacaccggtgggcctgacagtgctggacgtgaccaccaagggcaaggtctccatcaaggaaatcgccaagcagccactgcatcagccgctgcttatcggctcgctgctgggcattgtggtctctgcgatttccgctaaaagcggctggttcccagtgccgaaattcattttcgacccgatcgacatgatcggcgattcggctgtgccaatgatcctgatggcgttcggcatgtccctgcacggcaccaagccgctacagcagaagggcgatcgcccggccatcttcacggtcgcggtcctcaagaacatcatcatgccaattatcgcgttcctgctcgcctacttcgtgatgggcttccgcggctccgagctgtacgcctgcgtggtactcgccgctctgcccaccggccagaacgtatacaactacgcggcccgctacaacgtgggtctcaccttcgcgcgcgacggcattctgatgagcaccatgaccagcccggtgtttatcgcgatcatcgcggcgctgctgtcgtgatgggtgcgcagagaagcgttctcaatagtatccgtgcgcgcaaatgcacagatatcgcacaaacgaacatttgctcatccgcatatttgcggtgatttcagcgtttctacgttcgatttgcgtatacgaaagtacgcacagttgttattgagaacgattcgctgcgcagctcggctcagtcatcagcccgataatcggtcagattcaagctggccgccacatgattggacgcgaacgcgccgatggaaaccagcgcatagcacaacacaagcccgccgaagaagctggccagcgtggccggttcggtcatcgaagcggcgaacagaggggccataagcagcatggaacagccgccggccacgatcaccacgatgttgagcggggtgagtacctcgatgaatcgcgcacggttcaaggtcttgacatcagtgccctccaacaccagcatgcgatattcgccggcctgatcgtacacgctgccggcctgcatcacaccggagctgaccgcggcaagcacagcggcgaacactagcgtcaggatgccgccggtgccgatgtcgcgaatgaacacggtggacgggtcgttggcgtcatcgaccacggcggccgatccgaagaatccgcagatcgacgtgatgccggcgatgaacacggccaacgcaatgccggacacattgcgccaggcgcgcttagggttgtcgagaatacggcgcatggcaatcatcgtggccgcatccttggggcgcttggccttggccttggcgcgagcggtgaccacccacgtgccgataagattcaccagtgcgaagcacagcagcatgaaaccgatgatcacggcgtccatcaccgcctggccggcctgaggcagcatggccgggttcttgaagacgatcacagccgccaccatgaccaccacgaacagcaccatacgggtgcccgagggcagtgcggtggcggtgcgcgaggtgacgcccaatggggtgattgccacgcggcgcaaggtgaccagcgacgatatcagcgccaagatggccacgcccgccaaggtgattaccagcgccagcgggccgacccatagctgttcgaaggtgaaccgctgctcctggaagggaatcagcatgactgccggcatcagggcgcaatagccggcaatgccgataagcgcgccgatcagcgcctgtccggcggcgtcaagcgcggtgagacgcaccacctgaccggtggtcgcgccggccagacgcagggcggcgagacgggcgtcgcggcgggatgcggccagtcgtgcggcggaaccggcgagcgccacgaacggcacgacgagcagcatgcaggcgaataccgccaacgccacataggcggtggagaattgggccaggctcgtcgggtcgctgatctgccgtttccacgcggccaccgtatcgggccggcaggcaccgaagtcgaacgcgcaggcgacggtatgatcggccgaagcccgccagatgaaaccgtgtacgccgccgagcacggtgaggaagatggtggtggctgcggcgaaggcgatgattgccagcatcgaggtgtggccggcgctgccgcgcaagccggggcggtgaaacagccgccagagggcgaacgtgctcatcgcgcgcctcctgcggtggtttcgctcccgccggctggagctgccgagcgtagcgaggctgagggtggttcagcgccctcgggccacccccagtcagcctgcggctgacagcccccgccagcgggggcggagttggggttggcgtctgtctggtgcagacggccgtcctgcatcattacggtacggccgcagaacgaagcgacgttggggtcgtgggtgacgacgaccacggcggaaccgttgtcccgcgcggcggccatgagaatgcccatgacctcgcggccggtggcttggtcgagcgcgccggtcggctcgtcggcgaagaccacggcaggtttgacggcgagtgcacgggcgatggcgatgcgctgcatctgtccgccgctcatctcccccggccggtgcgtggcgagcgcgcgcaatcccatgcgttccagccacaggatcgccgtgtcggtggcggtgcggtagggcatgccgtcaagcatcatcggcagggcgatgttttcgaccgccggcagttcgggcagcagctggccggactggaagacgaagccgaagtcgttgcggcgcagtttggtgcgctcggcgtcgctcatgcggctcaggtcggcaccacggaagatgacggtgccggcggtcggcttaatgatgccggcgagcgcgtgcagcaaagtggatttgccggagccggacgggcccatcacggctaccgtctcgccctcccggagcgtgaagttcacgtggttcagggcgagcgtgtgcatggtcggcatggcgaagccgggctgggctggctgggatggctggccggcctgaatggcacccggtccggccgcagcgggattcgccgacgcataaccggctcccgtgccggctggtatcacgccggtgacgccgtgcccggcctgtgcgcgggccatgctggcggtgtagtccatgaccaggtcgtgcgcctcgatgaccggggcccactgctgggtgtgcgatgccggctgctggaactgttggggttgctgagactgctgaggctgagccgccggtcccggcgccggctgaggctgctgcaattgcgatgctgctgtattcatactcccgagcgtacggagcgaacgcccagccgaccatcgggctgcggtatgaacctttctggattaccggcccgctcctcatccgcaaggattagagatacgcaaatgattaatgaccggcaaccactattcggtgccggtcattatgagcattgcattcaggcgctacgcgcattattgcgcggtagccaactcgtccaggcgggcggcgaagcggggccagtcggtcttcatagcggtgaggagcttgcggttgggcacgtcgtcaatcgggacccagcagatttccatgctttcgtcgtcgtttgccttgggctcgacggtgtggccgggcttttcgaaggcaaacacggtggtgtaggcccacgggccgtggtcctcgcggtaggagccgaccacctcgatgtcttcgggggtgatgttggcttcctcgtagctttcgcgcagcgcgccttcgatggacgattcgccgtccgcagtggcaccgccggggataccccacgtgccaccttcggcgctccacgcggcacggtgctgcatgaccacgtgagtcaccttgccgctcgccgggtcgcggcgagccagcagaatgccggacgcaccgttggtgccccaatgcttgcggccgcaggcgcagtccacccagccatcgccgggctggtgtacgttttcgaccggcggcagaatgccagcgtgctggttgcccgatgccttgctttccggttccagttcaccacggccgacattccacaggtcagtccacgtgatgcccagttcgccggccagatgccgggccagcggcaagctgaggccgatgatgccgtgcggatcgccctcaatactgtcgatgaacgcaccaccgaagccttccagcgtgaacgatccggcgacttccagcggctcgccagtggcaatgtaccgttcgacgtcggcatcggtgaattcgccgaaatggactttggcgtggcttgcgccgcgcacggtacgcccggtcgcgaaatcgatcaggcagtggccggtccacagttcgccggtcgcgccgctcatgcgcttcagtcgttcgcgggccacggcttcgctgtgcggcttgccgtagcattcgccgcccaagaggaacatcgaatcacagccgagaatcagcgggccgactgtcgcctcggtcagtcccggctgtccggcaatagcggtggcgatgggttcggtgacggtcggcatatcgatgccggagaagtcgcgcgtggtggcgatttccgccttggaatagtcaatgggcttgccagcggcggcttcacgcaagtcttcgacggcagcttcgcgttccgaatccttgatttccttggccttgagcgggtaggcgatcacgcggtcaccggtcgcagcggcggcagtatcggccacatcacgatacgcacgatgaacggcctcggccttggccgcggccagaatcatcacgcgctgcttgatgctcaaatcgtcgacggtgacgccttcttcacgggcggccgcttccagcgcagcaggctcatccacatgcgagacgcgaattgtggggcagatacccgccgaatacagcacgtcacggcgaggcttggacttggaagcaagaattagtggaatgggcatgacttaagtccttatgctcccgctggcgggagctgtcgaacgaagtgagactgagggtggtctctgccggtatggcggaccaccctcagaccgcctgcggcggccagctcccgccagcgggagccttctcctcgacttagcgacgctcgatttcgacgccggcggtgttgatgggcaggtgaagcacacgccaatggccggaagcaagctgctccgatgcgatctggtcgatggcttcgcgggcgttgccgtaatgcagcacgagcacgcaggggccggcaccggagactgcggcggcatagcccttggagcggaagagcgcaatgagctcggtggacggcggcatcagggcaccgcgatacggctggtgcagtttgtcctgcgtggcggtgaacagcagcgcgttggactgggcctgagcggccgcaagctcgtcggcgaacgccgattcacgggttccgccagagcaagcgcacgtatcggcatcctgagccggggcagcggcgacgccggacttgccctgctgggcggcctgagccagcaccacgggattcatcgcagcgggcagcagccccacgcgagacacgttgtagacggcgtccttgtatggcagttccctaggcagcgcctgacgggccttctcagtggacagctcatagtcgggcacgaacacggcggcggtgatggacgggtccaccgggtagttgacggcgtggaatccgccgtgcagcggttcaccaccaggaacggcgaccgagccgacgccttctgcggtttcgaagtcccaagagacggtcaggccaccgaacacagccggggccacattgtccgggtgtccttcaatctgggcggccatatcgaagacggccggacggttgaggtcaccggtctgggcgaaggccgcggcggcggcgatgccggccacaatggcctcggcggaagagcccatgccacgagcctgagggatgttgttggtcgcttccagcgtgaagccgagtcggccgaggccgaacgtggcacaggcacggcggaaggtggagaccacgaggtgggtttcgtcgcatgggagggcgtcggcaccctcgccgtggatgatcacgtgggcaatgccgtcgttcgggtcgtcgttgagcgtgaaagtgagctcgtcatggtagtcgagcgccagacccacggtatcgaagccggagccgaggttggcggacgtggcgggcacgcgcacgtgaacgctattgcagattggattcatggttgttccttaaaaaggagctccctcatcagagggagcttgggtattcagctttcaccgttcgaccgcctcatcagagggagcttaggtcttgtcagtccagcacgcgcaggatggacgggtcgccggtgacgaagtcgagcgcctgcacggccttgacggtgttgcgcagggtttcctcgtcggtcaggtgggtcacgacgcgcaactgctgaatctcgccgtcgtagccgggatcggtcatggtgggcttcaggtcctggttcacaccgttgatggagacaccgttcttggcgaactcagcggcgatggcggccagcacgcccggcttgtcgtgaatcaggaagcgcacggcgaatgcagccttggaggcggtaatcggagccttcggcagattcttgtacagcgggatggacgggccggtgcagccagcagcaatgtggcgggcttcggtcaccacgtcgcccacgacggcggaggcggtcggagcgccgccggcgccacggccgtagaacatgaggtcgtcggcggcctcggccttgacgaacacggcgttgaaggagccgtgcacggaggccagcgggtggttctcgtcgatcagggccgggtagacgcgggcggagacgccggcctcgccgttctcgaccacggcgagcagcttgatgaccttgtgttcggcggtggctgcggcgatgtcgtcggcggtgatcttggtgatgccctcaacggacacatcgtcgatggtcacggaggtgtggaagccgagggtggccatgatggcggccttgttggcagcatcgtagccttcgatgtcgccggtcgggtcggcttcggcgtagcccttggcctgggcgtccttgagcacgtcgtcaaactggagacccttggtggtcatctcgtcgaggatgtagttggtggtgccgttgacgatgccgagcatgctggtcaccttgtcgccgaccaaggactcgcgcagcgggcgcaggaacggaatcgcgccacccacagcggcctcgaagtagatgtcgacgcccttggcctcggcggcggagtagatctccgggccgtacttggccagcagcgccttgttggcggtgaccacggaagcaccggattcgatggcggcaagcacgaacttgcgggccacggtggtgccgccgatgagctcgatgacgatgtccgagttggtggccacgctcaaagtatcggtggtgacgatggactggtcgatccacgggaacttctcagtttccttcgggtcgaggcaggcgacgccggtcagttcgaccgggcggccgatacgagcggacagttcgtccttctgctcgacaatcaggcgggcggtctgggagccgacggtgccggcaccaagcaggcctacgcgaatcggggtttcgttgttgcgagccaattcagggtccttccaaaaagttttctatatcccaccgctattttacggattatttccgacagcagaccgaaagtactcatcaaagctgacggtccttttcgtattatgacggatttggccgcacattacagactgtcaggcgctcgcctctgcacgtggatcactcgctgacgtcgaggttgagtaggtcgtctacggtctggcggcggagcatgacgtgcgcaccggactcgctgacagcaaccaccaccggaatcagcgcttggttgtagttgctggccatggtgcggccgtatgcgccggtaaccggcacggcgagaatgtcaccgcgcttcaaatcggcgggcaactgcacctcgtgaaccacgatgtcgccggattcgcagtgcataccgcacacacgggcaagcatcgtttcagcggaaccggtgcgattcgccagacgcgcggtgtagtcggcaccgtagagtgccgggcgaatgttgtcggacatgccgccatccacagacacatacacgcgctcggcaatcgggttgccgtcactgtctttggcatcggacaagtgcacgtgcttgatggtgcccacgcggtacagggttacgccggcgggcgccacgatgtagcggccgggctcgaagctgatggccggggcgggcatgccgagcgcacggttggtgctgttgaccgcatccgccaagcgagtgagttccacgtcaatgtccattgaatcttcgccatcggtgtaggccacggagtagccgccgccgaggtcgatttcgggcaggatgtaggcgtcggtggcccacagggtcttgcgcagcagcatcatgcgcttggccgcgtgaatgaaggcgtccgcatcgtggatgttggagccgatgtgcgagtgggctccgaccagttcgagtacgtcctggttggcgaggatggtcttgagcacggcgatggacggaccgtccgcaatggcttccatcgcggcggccagcgccttgtctgtgtcggagacttcctcgtggctcaggtcgtacgggtacttgacgtcgtagtgcagctcgcgctctgatttctcggtcttttccgcgccattttccggggaatgcgtcgcagagatacgcgcgttggtagcggcaggcgtcacgtctttgaggtcgttcagcacgtcgagcacggcggcgtcggccccggcggccagcagcggcacgccgaacttctggtcctcgtgagcagtggagatgtactcgtggccgccggcgtggacaccgacggtgacgcgcagcatcacacgggcgcgtttgccgagcttgcgggcgatggcagcaacgcgctccggctcgtcgggctcgtcgatcacgattttggcgaagccctgttcgatggccagcgcgatttcctcatcggacttgttgttgccgtgcagcaccagacgacgtccgggaacgccagcggcgagggcgattttcatctcgcccatcgtgcaagtgtccacaaacatgccggcctcggtgaccaatcgcacgacttctttggacaagaacgccttgccggcaaagctcacgtgcgtagtggaggtgttgaatgcttcggcggcagcgcgcacgaagtgcctagcacgtgcgactacttcatcagtgtcgatgagatagagcggcgagccgaactcgtcaagcagcgattcggcggtacgaccatgaaattcgatggagccttcggcattcacagccgtagcggccggccaaattggagaaataggcataatcacatcttttcgggggcggtgacgccgaggaggtcgaggccgttggcgatgacctgctggacggcgtcattgagcttcaggcgggcggcggcacgggccggctccgggttcttggcgatctccaaggccttgcgagcttcgtcgtcgccacgggtttccggatcagtcagggccatcggcaccacgcgctccacgttgtaccacttgtgataggtggcggccagttcttcgaggtaacgggccaccttgtgcggctggcggtcgtcggccgcagtggcgatcacgctcgggaactgggcgagggcggcaagtacctcgccgtcggcctcggtgtcgagcagggccaagtcggcaccctcgtagctgatgccggcaacggctgcgttgcggtccacgttcttggagcgggcgtgcgcatactgcacgtagtacaccgggttgtcgttggtgtgcgaggcgagcagggccaggtcgatgtcgaagttctggttgtagtcggagcgggccagcgagtagcgggcggcgtccacgccgaccacggagaccagatcgtcgatggtcacgacgttgccggcgcgcttggacatgcgcacgggcttgccgtccttcatcacgttgaccagctggccgatgagaatctgcatgttcttgccgggctcgtcgccgaaggccgcgcacatggccatcatgcggccgatgtagccgtggtggtcggcgccaagcatgtagatggccacgtcagccgggttttcggcgcgatggcgcttgtcccagtagtaggcgatgtcggcggcgaagtaggcgaactcaccattggacttgatgatcacacggtccttgtcgtcgccgtgcttggtggattcaaaccaagtggcgccgtccttgtcgaagatgtcgccgcgggacttgagctcttcgatggcggcgtcgaccttgccgtcggcgtacaggctgttctcatggaaccagacgtcgaagttcacgcggaagtccttcatggacttctgaatctcatcgaacatcatcggcacagcgcgcttgcggaattcctcgcgcacttcggtgtcggcctcgccgagcggttcgccgtcgtcgttgaggccttgatcctggtgggccagtgcggtcaggtccacgccgtcggactcggcttcggcctgaacacgggcggcgatctcgttgatgtaggcacccttgtagccgtcgcacggggtttcggtctggtaaccggcctcgccgaggttgttggcctcagcccaagcggcgaccagcgacttggcgaagcggttgatctgctcgccgtggtcgttgaaataatattcgcgcaccaccttggcaccgttggcctcgagcacgcgggccatggcgtcgccgacggcagcccaacgagtgccgccgatgtgaatcggaccggtggggttggcggagacgaactcgagattcagggtctggccgcccagatgggcgttgcggccgtattcgttgaccttgttgagatgcttgtcggtgtcggtcatggcaccggcggcgagtacggtgtccaccacggcggcggccgaggcggagtcgagcgtgatgttgatgaagccggggcctgccacctcgaccttggcgatgccgtcggcttcggcgagcgcggcggcgaacggctcggccagatcgcgcggcttcatgccggccttcttggccagctgcatggcgatgttggaggcccagtcgccatgcgcgcggtccttcgggcgcatcacggcgagcttgtcgacgggcggaatcagctcgtcggtcaacgcgccggcctggccggcggcgacgaggttgtgggcaatgctggaaatcagttcacttaaggcttcaggactcattcttctaaggatactgagaacggcgacacttgcgccctggtatgcctatatgctgcccctgctggcgggggcaagcacacagccgaaagataccaagcgaaaaagggtaggcgacaatcgccggaatcgttggaggctcgccgaaaccgctatacataccgtcggtcggtatctatagtgatctgcaacatcaagcacagtagggaggccaccatggcacgtaacgctcaccccgaggtgacgcgcacccgcatcctcgacgccgcacaacggctgttcatggcccagggctatgagcacacctccatccagaacatcgtggacgagctcggcgacctctccaaaggcgcgatctaccatcacttcaaatccaaggaagccatcctcgaagagctcaccaaccgagacaacaatatgcaggacgacttcaacgaatccgtcatgaatcgcactgaccttaccgccctcgaaaagttccgcgtgctatggcggcattcgatgaccaagcaagaccacgtgcagatcatgcgagccgccatgccgatgctgagcgatccggtttcgttcgccgcgaatatgcaggtatggagcaagcatctgcccgaacgcttcctgccgctgatcgaggcgggcgtcaaggatggctccatccccaccgagtatccgcgcgaggccgcagagctgctttcgttgctgccgaattattggctgatgccgtatttctacccggtgaccctgcccgaaatggagcatcgcatccgctgcttggccaccatgctcgacgcgatcggcgtgccgattttcgatgacgagctcatcacggtcgccgcgaagggcatgatgacgttcgcaggggagccggagaaaggctcagaatgaatagcacagtgaaacccgagaatgacatcgccggcaccgccacccaacgcccgctgctgtcccgcgacttcgtgctgctggtcgccggacaaggcatctcgctgttcggcaatgtgatgctgcgattcgcgatgtcgatgtgggtgctggacgaaaccggctcagccaccatcttcgcctcggtgctggccatctccatcgtgccgaccatcctgctctccccgttcggaggcgtgctggccgatcgcgtcaaccgccgcaccatcatggtggcgctcgacgccatctccgccgtgctcgtgctggcgagcgccatcgtcttcgccaccacgggcttccatatcgtagccatcgccaccatgcaggtgctgctcgccgtgctcggcgccttcgaaaccccgaccgtgcaggccgcactcccccagatgttccggcagtacggcccggccaccatgcgccaaggcatggccgtgatcaatcaggtccaacaactaagcagtctgctgccgagcttcctcggcggcgtgctgtatgcgatgttcggcatccgtctcatgatgatcatcgccatcgcaagcttcgccggcgcagccgcgctcgaatgcttcatccgcctcagtgccccggatcgcggcgacgaggagctgcccaccccacttgaagacctcaaggcaggcgtgcgattcctcatcaaggaccggccgaacgtgttcagactgctgttgttcgcggcggcgctcaactttgtgcttatcggctattccggcgtcggcttcccgtacacgattcgtacagtgctcggcttcgacgccactgtctacggcatcgccgacggcctgatcggtgtttccggcgtggcgggcgcattcatcgccggcctgttcgccgccaagctcacgatgcgctggctgccggggctgatggcgacgcttacgctggccatggtcccacagggtattgtgttcctgctgccggtcgacgcatggaccaaactcgtggtgctgatcgtattcacctgcggcacgatggtcgccagttgcttcacgaatctcatcgccgtgcccgccatccagctcagtacgcccgaggcaatggccggcaaagtgatgtccatggccgcggccgtgagcatgtgcgcccagccgctcggccagatggtgtacggctgggcctacgaccaaatgccggtcgccatcgtgctgttcatcaccaccgccctgttcgccgtgctcaccgtgctgatggttccgctcgccaagcagttcgaggactgacgatcggcgcgcacgccacatcctgccgcccggccataattgaatcaccgcacgaaaaggcacgaaaaggcacgaaagaggtacctatggccacgctcaacccccaatcattggtcacgttgtggcaaatcgaacagtatggttcgttctccgccacggccaaggccacgggttggtcgcagccggccatcagccagcagatcaaaaagctggaggcacagtgcggttcgactctggtgcaacgcacctcgcatggcgtggaactcaccgccaccggttcgatgctcgcccgccacggcgaggccatcgccgatcggctggagcgggcggcccgtgaagtcgaggattatcggcatcatcggtttgatcacctgcatttggtggccccaccgtcaatctgctctactatcgcggcccgtaccgtggtcaagctcagtatgttcacggacatcgagctgagcctgattcagatggagccgccggaggcgatcggtctgatttcccaaggcaaggccgataccgccgccgtgttccgctacagcagcatcccgaacttcctgcacatcggcgacgacctgaccttccattcgctgggttacgatccgatgcgactgctggtgcgccgctccagcggcatcgccaaacgattcgaggagaccggcgaacctgtgccgctgtccgccgccaaagacgagcattggatcgccggctgccccacctgccgcgcaaatttggtgaaactggccacccgtgccggattcaagccggatatccgccactgcacggatgattactgggccacgcagaacctggtcgaggttggtatgggcgtctcgctggtgccggcgctcgatacgcatatcaacttgcagggcgatctggtggcctgtcccattgccgacgattttgcggcgcgcgaggtcggcatcgtgactcgtgccggcgaccatcgccccgcgcttggttcattgctcgaggagctcgagcgcacgtcactcaaatatttgagtgccaagtagtcgcacagcgataagcaagcttgcgagcgccatcacgatttcggggagccagaccgttgagcagcccttctgcaccgggaacaatgacatgttatgagcatgaacaacattccccagtcaacgactttgagcaacacaaccgccggcacctcttgctttgatgccaatcacatcgacgtgacgaccatcgaggatctggagcaggtcggttcggataaatggacccgttaccccggctgcatcggcgcattcatcgccgagatggattacggtctggcaccgtgcgtggccgaagccatcgaagaggctactgaacgtggcgcgctcggctacattcccgacccgtggaagaaggaggtcgcccgctcgtgcgccgcatggcagcgccgctacggctgggaggtggatccaacgtgcatccgcccggtgccggacgtgctggaggcgttcgaagtgttcctgcgcgagatcgtgcgcgccggtaactccatcgtggtaccgactccggcctatatgccgttcctaagtgtgccgcgtctgtatggcgtggaggtccttgagattccgatgctgtgcgcgggcgccggcgagagcagcgggcgcaatgatgaatggctgttcgatttcgacgccattgagcaggcgttcgcgaacggctgccatgccttcgtgctgtgcaacccgcacaacccgatcggcaaggtattgacgcgcgaagaaatgctgcgattgtccgatctggccgccaagtacgacgtgcgtatattctccgatgagattcacgcgccgttcgtctaccaaggccacacgcatgtgccattcgcctcaatcaaccggcagacggccatgcaggctttcacctccacttcagcctcgaagtcgttcaacattcccggcaccaagtgcgcgcaggtgattctcaccaatccggacgatctggaactatggatgaggaacgcggaatggtccgagcaccagacggccaccatcggtgccatagccaccactgcggcctatgacggcggcgcggcatggttcgagggcgtgatggcatatatcgagcgcaatatcgcgctggtcaacgagcagatgcgcacgagattcgccaaggtgcgctatgtggagccgcagggcacgtatatcgcgtggctggatttctcgccactgggcatcggcgacccggccaactatttctttaagaaggccaacgtggcgttgacagacggccgtgaatgcggcgaggtcgggcgcggttgcgtgcgtatgaacttcgccatgccctacccgctactggaggaatgcttcgaccgcatggccgccgcacttgaggcggacgggttgttgtagaacagaattgcggctcccctcaaagaggggagccgaggaacggccgaattagtcgaagtcggcaccgagggcttcgagtttgccgcggaagtcggcatagcctcggtcgatcaggctgatgccgtgcacgtccgaggggcctgacgcggccaaggccgcgatcagatggctgaacccaccacgcaggtccggcacgtcgatgtcgcgtccggtcagcggggtcggtccgaagatcacggcggaatgcttgtagttgcgctgccggaaacggcacggcagcgagcccaggcactcgcggtacaactggatggtggcacccatctcgaccagcggcttggtgaagccgaaacggttctcgtacacggtctcgtgcacgatcgacaggccgttggcctgggtcagggccaccacgagcggctgctgccagtcggtcatgaacccgggatgcacgtccgtctcgatcgccacgggcttcaagtccccgcccggatgccagaaacgaatgcccttgtccgtcacctcgaatttgccgcccaccttgcggaacacgttgaggaacgtgatcatctccggctgggtggcacccttgacgaaaatgtcaccgtgcgtggcgagcgcggcggacgcccaggacgccgcctcgatgcgatccgtcagcgacgtgtgcgtgtacccctgcagttccttgacaccctcgatgcggaaggtgcgatcaacgtccacagaaatgattgcacccatcttctgcagcacgcacaccagatccatgatctccggctcagtggccgcgcccgacagttcggtcttgccctcggccagcacggccgccagtaaagtctgctcggtggcgcccaccgacgggtagggcaggtggatcttcgcgccgtgcaggccgttgggcgcggtgatgtggatgccgtccttgtgttccttgtccaccgtggcgcccagcttgcgcagcgtctccagatggaagtcaatcggacgtccgccaatcgcgcagccgcccaacgcgggaatgaacgcttcacccaaacggtgcacgagcgggccggaaaacaggatcgggatgcgcgacgaaccggacagtgtatccacgtcggccacatcggccagctgcacacgcgaggcgtcgacggtcacaatgccgttcgcaccgtccacatccacgtccacgccgtgcagacgtagcaaatcggacaccacatgcacgtcacgaatctccggcacgttcttcagcaccgacttgcccggtgccagcaacgcggcgaccatcgccttgctcacgaagttcttcgcgccacgcaccttgatcgtgccattcaaaggcttgccgccctcgacatgcaacacgtcatccggattctcagccacgccactctcctcaatcaatcaagattcaaaaaatgctaccgtccagtttgccataagccatgtgccgactccgtgaaatgcaccccagccgaactttgatcaccgtgcacaacggatcccatacccccgtcgaatcaaaccgataacgtgatcttcctcacatttgccgccacggtgttctccatacttctacgctacgattcagggcaatggcatcagacgccatggccacaagcaaaggagcattcatgaccacagtcgccgtcatcggctgcacgcacgccggcacgttcgccaccacctcgattctcgccgagcaccccgattggaccgtccatgttttcgagcgcaacggtacgctgtccttcctctcctgcggcatcgccctgtgggtgggcgaccacgtatccgacccgaagaaaatgttctactcctcccctgccgctctggccgaagccggcgcgaccatgcatatgcgcaccgacgtgacgtccgtggacctcgacgccagaaccctcacctaccgcgcgctggacgaggccggagaccccgccgaacagaccctcgctttcgacaaactggtcgtgaccaccggctcgcgcccggtcatcccgccgatccccggcatcgacagcccgcatgtgctgctgtgcaagaactgggatcacgccatcgccatcaaggaaaaggcgaaaaccgccaagtcggcagtggtgatcgggtcgggctatatcggcgcggaaatcgccgagcagttcagcgtcaccggcgtcaagaccacgctggtcgacggccttgatcgcccgctggccaataatttcgataagaccatcaccgatcaggtggcggccgcgttcgaggagcacggcgtcacgctcgcgctcggccagaaggtggtcgagttccgcgacaatgacgacgacaccgtcactgtggtcaccgaaaagggcgagtacacggccgaaatggcgattctggccgtcggcttcctgccgaacaccgacctgctcaagggcaaggtggacatgctgccgaacggcgcgatcgtggtcgacgactacatgcaggcgtccgcgccgggcgtgtacgccgccggcgactccgccaccgtgttctacaaccccaccggccagcacgattacattccgctggccaccaacgcggtgcgccagggcctgctggtgggccgcaacatcgagacgccgaccgtgaagtacatgggcacgcaggccacgtccgccgtgcagctgtacgatctctcgctcgccgcctccggcctgacccgcgccggtgccgaacgccgcgggctcacggtccgcgagacctcgctcaccgaggattatcgcccggacttcatgctcaccaccaccccagtcacgtcgattctgacctgggacccggaaacccgcaaggtcaagggcggccagttctgttccaaggccgatatctccggcgcggcaaacgtgatttccatggcgattcaggccggcttcaccatcgaccagctcgccaacgtggacttcctgttccagccgaacttcgacaagcccgtctattacgtgggtgccgtggccatgaaggcggcggctgagtaagacggctgtactcaccgcaaaaagaaaccccggcgtgatgggcgccggggagagaaaggagagaagaagaagaagaaagaggttaagttatgcagcttgttcggccgtgattacatataacaacaccagtttcaatgcaacgtgggcactggctgggaattgtctgggaatcacggcccgtacaggctgtttcttgttttggagccgatttaccggctcgccttgatcttgtgggccagctcggcgtcccacatcgcgccggttgcggacatcaccgaatccgcgccggcgtttctgtatgcctgatagtcggccggcgaaaccacgccgcccacgccattgatcttgaaatcaagaccgagcttctcgcggatcgcggccagacgggcgaccatgtcgaggccggcaccacgaatcgcattgccacacacgccggagcgatcacggcctgcaccgggcagggcctgattgccattggcatcgaccagtttggcggaaatcgtattgatggtgctgaatccctgcacagtgccgtggcccacggtggaacgcaccatgagttcaaggtcgccgtcgctggggatgtaggcgagcttgaccatcagcgggatgtcgccgatctcctgcttcacggcctcggtgatgcggcccacgagcagcggattgtggcatagcaggcggttgtggccctcgttggggcagctggtgttcatcaccatgagcttggcaccggtctccttgaccaggcgggcggtagtggcatggtcggcgatgtattcctcctcgctcatgccctccacacgcgagccttggaagctcgggaccagcacttgaccgggaccggcggcctcgatggcggcgcgcatgtccggctgccagacgtcagggctctgcgagggcacaccgaagctgttggagatggaaatcggctgttcatagttggtgtcggccagcacgccttcgtccagttcggcgctgcccggcgtcagtgaaccgtccgccgacttggggtgtacggcgagcacgttcgggaacgggttgcagccccaggcgcgcgaacgcacggttttgtaggtcgccagatcgaagcccatgcggaaggcggccgtggtgaagcggctgttgagcagcgggcctgcgggaatgccgaaaggcaggttgaccggctggcccaggaaggaggccgaggcaccctcgctggtggttccggcggcatcggcaccgttgccatccttcagcgcctcggcgaacgcgccgaacggcccttgctcatagttgtcttcgtagctgcggctgacgtcgtaaaacggctcaaaatcactcatgcttcaacgataagccaacctacatgcgtacacgcacactcaacccaccatcgcgccgtcaaacgaaataatggcgaaagcggcattggctaccacaaagatgatgaacgtcggagctgcccagccaaagtacgtgtctggaatactacgattcgtacggtgatattggcgcaaacttaaatagtgcaaacacaccctagaagagataggagggaatggcactttctcgcgttgttggtggaagtatttgggatgctaagcgagttgccgcattggaaccagacgattgcgtgaagtgaccctatacgtaaaaggtctcactggcgagagccagtgagacctttgtctgatgcgatgcgagcgacccaataatctcaatcagacacagagccaacggccctgggcctgcaattatggactcgcctttcggcgaggctcaatgctggcctcgctgctgtcgcagctcggcaggccgatcgcggctaaataatgccgcgatcggccaacggccctgtccagtctgcgtcctcaggctcgcgggcggactcgattctttcttcggcccagtgtttggcggggatggtcttgggcttgaagggaaacttttcggcgcgcatcttttcgtaggcggcgatgtcgtcctcgtgctgcagcgtcagatcgatatcgtcgtagccgttcatcagacgccaacgcacgtaatcgttgacctcgaacggcagggtcacgtcgccgcaagtgacagtgcgggtctccagcgagacagtcatctcacgaccaggctcttcctccagtagcttccacaggagttcgacggactcctgcggcataatcgcggccagcacgccgttcttggcggtgttgccgtagaagatgtcggcgaagctcggcgcgatgaccacgcggaaaccgtaatcgtgcagcgcccacacggcgtgctcgcgggaggagccgatgccgaattcggggccggcgaccagaatctggcccttaccggcgtattccggcttgttgagcacgaagttcgggtctcggcgccatgcgtagaacagggcgtcatcgaagccggacttggtcacgcgcttcaagaacacagcgggaatgatctggtcggtatcgacgttggagcggcgcagcggcacgcccacgccggtcagtgtggtgagtttttccataacaattttcctttcggggatctctcccccagtcagtcttcgactgacagcccctcgtcagagggggctcacgtgtattgactcagagatcggcgggagacgagattgtgccgcggatggcggtggcggcggctacggccggcgacgccagatgcgtgcgcgagcccttgccttggcggccctcgaagttacggttcgaagtggaaatcgagcgctcgttcggcaccagcttgtccgggttcatgcccaggcacatcgagcagccggcgttacgccattcggcgccaaagtccttgaacaccttatcgaggccttccttctccgcctgcaaacgcacgcgggaggaggccggcaccaccagcacgcggtggatgttctcggccttgcggtggcccttcataatcgcggcggcctggcgcaaatcgtcgatacgaccgttggtgcacgaaccaatgaacacggtgtccacggcgatgtccttgatcggcatgcctggcttcaaacccatgtatgtaatcgcacgttcggcggcggcgcgcttggtggcgtcggcgatcttgcccggctccggcacggcggcggtgatcggcagaccttggccggggttggtgccccacgtcacatatggaccgagcttggtggcgtcgatgtccaccaccttgtcgaatacggcatcgtcatcggtcttcagcgtcttccagtacgccacggcctgatcccacagctcgccttccggcgcgtgcggacggcccttcaggtactcgaacgtggtctcgtccggcgcgatcatgccggcacgcgcaccggcctcgatggacatattgcacacggtcatacgttcgtccatggtgaggttgcgaatcgcctcaccacggtattcgatcacgtaaccctggccgccgccggtgccgatcttggcgatgatcgccagaatgatgtccttggccgtcgcgtccgcgggcagcttgccgttgacgttgacggccatggtcttgaacggcttcagggacagcgtctgtgtggccatcacgtgttcgacttcggaagtgccgatgccgaacgccagcgcgccgaacgcgccgtgcgtcgacgtatgcgaatcaccgcacacgatggtcatgcccggctgggtcaggcccagaatcggggcgaacgcgtggacgatgccctgatcggcgtcgcccagcgggtgcaggcgcacgccgaactccttgcagttcttctccaaagtcgtcaactgcaacgcgctcgtctcatccgggttcgggcgatcgatatcaacggtcggcgtgttgtgatcctcggtggcaatgagctgatccacgtgacgcggcttgcggccggccaagcgcaggccctcaaacgcctgcgggctggtgacctcatgcatgagcatcagatcgatgtacagcaaatcaggggctccgtcgctgcccttgcgcaccagatgatcggcccagaccttctcggccagtgtcgttcccatagtgattcctccaaaaaattccgcgcgaggcattgtgttcgcgccttgttcgtggtattagcctatgtgcttgcgatgggcccggccatgagcatgccggatattgagatacggtcaaatgatggcctcaatatgactcggacccgactcgaacatgacctagtcatgactcggttccgctccagacatgtctcttcggcatccacgaacgccctttcaacttcatggccaccctgtgagacacttccccaatttgccatttcactatgtgagatggcataatcgcccttattatgactgattcccgggaagaaccattgaacaacagcttgaccgagtccgagccggttgaagacaccaccgccaaggacgatggggaaatccattccggcgttggcgtccttgataaaaccgtaaagattcttgacgcactggaatccggcccgtctacgctgggccagcttgtggccgccaccggtctcgctcgaccgaccgcacatcgtttggctattgcactggaacgccaccgtttcgtactgcgcgaccagcatggccgattcgtactcggctcccgtttcgccgaacttgccgccgcagcaggcgaggatcgtctgctgaccgccgccggcccgatcctgcagaccctgctcgatcgcactggcgagtctgcgcagatttaccgccgccaaggcgatcagcgcgtgtgcatcgccgctgtggaacgcacctccggcctacgtgattccattccggtgggtgccatgctgtcgatggaagccggttccgccgcccagattcttctggcttgggaggattccgaccgtctgcaccagggattgcgccacgccaagttcaccgccaccaagctggccgccgtacgcaagcgcggctggtccgagtccgtgaacgaacgcgaagagggcgtgtgctcgatttccgccccgatccgcaacgcctccggccaggtcatcgccgccatctcgatttccggcccgaccggccgcatgggtgccgcccccggacgccgctatgcgccgctggtgatggccgccggcaagtacctcaccgaggcactggtcaaagccgttcgctgaaacataccagtcaatccaaccgatagcccaaccggcagaaatcccgcgtcacaacgaaagagacgcgggatttctgccactaatacacagcggaaggccaccgaaacctcgaatacttcgcgccgctttccgcctctatcaggaacagttacctgaataaaccgggttacctgaataaaccggacagttgactccatagcgacggcttgcgcagcaaatcatcaccctcgccctcgccaggcgcggtttggttcaccgcataggtataggcgcgtttggaactgggcttgcccaccagttcgccaaactccagcaattgcgtacgcggctcgtaagggtgacggatatcaaattcgatcaatcgcgtggcacgtttggccggagccggtccgtacgtattgaatccgcaggttggcgtagcgataagcaacagaccctcatgttcgccgacgaaaccgttgcgatgatcatgaccagctacgacgccgaaatacccctcgcgcagcaattcgaattcgcctgacgtatcagggcaggatatgccttctcccaaatatccgccgggctgggtttgcaattcgtccagcacgtagtaggtatcggcgtgcgaacgatagccctgcatggcaaacgccgcgttggccgccaccggcttcagcacgttgtaatactcgggcatcggcatgtgctggaacaccattgatttcgcaccgatacggtcgggcacggcgttcaggaaggcgagcgctgcgggcgatggtgcgccgaagccgccgccatgcacgtaatcgccggagtcaagaatgaccagacccagcacattgcgcgtatggtcaacgtccataaccggcagcgcgaaggtgcctggttcaccggaaccagtggcaccagacagcgtctgcacagcaccacccgctccacaggtgtatgcaatctggttcggcaaggtctcactcggcggattgacacaaccggggaactcacgatagataccgtccagttccgcattgcttagcccgcattggaaatcatggttgccatacgtcacagcccacggaatgccgcgcgccgccaacggctcagtgaactggccaatggccttgcgcaccagcgctcgggtatggttcagcgcggattcggcaataggttcgtcacaccagcgacgtttacggaatgaatcggcgaacgccggatcgtagccggcgatctggttgccggagaaaatcaccagatcaggccgtgtggcatcaaggctggcctcaatcagggtgatggtgtctttggagactttcggcccatcctgaatgtcggcaatctgcagcacgcggaacttgccggaatagtggaattgcagtcgtccgagacgcgcagagatagagaccggacggccgtcttcggcatcggccggcttgatacgaggtttcgacgacatcccctctggcgtacgctgtgtttccgtcatgccctccactgtacacacaaacgaaaaggcccgccggagcgggccttttctacaagttcaactactggagcagaatctctgcacaacatcatcgttgtaacggtaagtctttccaatgcccgtccaacgtaacagtcctcgtgaccatacactatttgtgggctctgctctgttcagttgttcttgtacctcataatctattcatcactcccgtttctcgcaacctgcagagagtcgttgtgcgttttttatcacaactgttcaatcgcactttctggctatcggaaaacgagctgaaccgttcacatcgaacccgtccgatgttcgatttcgttcgtttcaccgccgctcacggcgtgtcgcgagcgacgctagcacactcaaaaccaaccaacaccgaactaacatgaacacccgttgaattctggcgcgttcagtcgttttccggccacgccaaagcttacgatataagctatggcacagatatttgacgcaccctcgaaggcaattctgcgcagccaaatcgcagagcatattgccgaaaacgacaacaacgaccgccgcgtcgatcaggaaggcgaggcaccgctgcccaaggaccgtttcttcgaccgcgagctcagctggctcaagttcaaccagcgcgtgctcgaatgtgcggagaacgaagacatgcccctgctcgagcgcgccaacttcgccgcgatcttcgcctcgaaccttgacgagttcttcatggtccgcgtcgccggcctgaagcgccgtatcgactcgggcatcgccgtgccgtctgccgccggcctgagcccgcgtcagcagctgcgcgcgatcagcgagaccgcacaccgtctgcaagacgagcacgcacattacacgatcgacaccattctgccggaattggagaaggagcgcatcgtcctgctgacgtgggacaagctcacatcctccgagcaggagcgcctctcgcgctactaccgccagcaggtgttcccggtcctgacgccgctcgccgtcgacccggcccacccgttcccctacatctccggcggctccatcaacctggccgtgattgtggagaacccggcctccggcaagtcgcacttcgcccgcgtcaagatcccgggcaacctgccgcgcctggtgccggtggacgacatgaccgacgaggagtccaaggacgagcgttacggcttcatcgccatggaaaagctcatcgccgcgcatctggaatccctgttcccgggcatgatcatcaaggaagcccgctccttccgcgtgactcgtaacgaggacatcgacgtggaagaggatgacgccgagaacctgctcaacgccatggagaaggagctgctgcgccgccgcttcggaccgccgatccgtctggagatcacggacaccactagcccgttcctctcccagctgctcgccgaccagctcggcgtgagccaggacgaggtataccgtctgcccagcccgctggacctgaccgtgctctttgagctcggcagcgtggaccgcccggacctgaagaaccgtccgttcgtgccgaccacgaaccgtcagatcgccgaggtcgagtcctcccgtgcgcaggacattttcgccgccatccgcgagcgcgacatcctgctgcatcacccctatgactccttctccacttccgtgcaggccttccttgcgcaggccgccgcggacccgaaggtgctggccatcaagcagaccctgtaccgcaccagctccaactcgccgatcatcgacgccctgatcgacgccgctcatgccggcaagcaggtgctggctttggtggaaatcaaggctcgtttcgacgaggacgccaacatcgcgtgggcccgcaagctcgaacgcgccggcgtgcacgtggtgtacggcatcgtgggcttgaagacccactgcaagctcatcgaggtcgtgcgtcaggaagcggacggtctacgccgctactgccacgtaggcaccggtaactacaacccgaagaccgcgcgactgtacaccgatctgggtctgctgacctgcgacccggtggtcggccaggatctgactcgtctgttcaaccagctctccggttacgcgccaaagtccagcttccaccgtctgctggtggccccgcgcaccgtgcgcaccggtctaatccagcgcatccgccgcgaggaggacgccgcccgcgccggcaaggaggcctggatcaagatcaaggtcaactccatcgtggacgagaagaccatcgacgccttgtaccgtgcctctcaggccggcgtgaagatcgacatcgtcgaacgcggcatctgcgctctgaagcccggcgttcccggcctgtccgagaacatccgcgtgcgttcgattctcggccgcttcctggagcactcccgcatctacgccttctgcaacgcggacggcccgcagatcggcgagggtccggcttccggcccggaggtctacatcggttcggctgacctcatgcaccgtaaccttgaccgccgtgtggaggctctggtgcgtgtcaccgccccggagcaggtcgacgggctcatcaagtacgtggacctgcagatggccgactccaccatgagctggcacatgcagcccgacggcacgtatgtgctgcacaccaaggacgacgagggccgcccgctggtcgacagtcaggaatatctgattcgcaagcaccagcgccgccccaattcgcacaactgatttcattcgatgctccctgtcagcacgagctgactgagggtggttacgatgcccggctcctctttcgagaggatgccgggcatcgttgttcagcgcgcaaaaactacgtagcagcggtccaacgtgacctacaatacaagagatgggtacgaacagtatgagacgaatcgtggaagccgccggcggtattctgtaccggtggaaggatgatgccgagccgacgcgggcatcatctccatcagtgaaatccaatattgccaccgatggcaccatcatcgcgaacaccacggattctgacggcgagaccacggcagcacccggcgcatcggacgcggcttccaccccggacccggcgcaggccgacagcccagccacagcggacaacgtactcaaccgcatcgaactgtgcgtcgtgcatcgcccgaaatacgacgactggagctggccgaaaggcaaggtcgacccgaacgaatcgcaccggcatgccgccgtacgcgagatcggcgaggaatcgggcctgcccgtggaacttggcccctatctgggcgacatcgagtacccgctgtccgaagaaggcagcaaacagcgccataccaaggatcggtcggcggataccaagcatatccagttctggatggccacgccgatcagcgccatcgacaacctgcggcgtacccatgcgtttggcccggtgcatcgggcggacatcggcgaaatcgacgaagttttgtggctgacgccggccgaggcccgcaagaagctcagccattccaccgataaggacatcctcgcgctattcgttgatcgggtgcaggagggcgcgcttgacgccgtgccggtgattatcgtgcgccacggcaaagcggaagcgcgcaagctgtggaagggttcggacgcgaaccgtccgatcacgccgcgcggcgcggctgcggcatacgcgctgaaccgcgagctggcgtgtttcaatccgacccgactggccacgtcgccttgggtgcgctgccaggagacgttggagatgttcgcgtggcagaccggacgagacatggttcatctcgatccgctcaccgaagatgcatacgccgctgcgccggacaccgcatgggagtgtctactcagcgaaatcgagttcgcacttgagcgccgtcagcccatagcgatatgcatgcaccggccggtgattggtggtatgttcggacacctgcgcagcatgtgcgttgcgccgtctctgagcaaacgcctgatcgccaagacaccgttcatgccgaccggcacggcggtggcgctgttcgtcactccgacgcctcatggtcccaaaatcatcgatattcagaaggttcaaccgcttgtctactagacccgcattccctgattcatccaactcctcggccgctgccgccgcagctcatgccgcgcacaatggtgccgccggcagtctgggcccaggcttcggctcgttgcgtgcggccggagcggcattcggacctgctcgcatgggttcttcgcgtccttcgcgcccggctcagctcgacccggctgtggccgatggattggccggcggcatggacccgcaagcgttgagcgagatgagccatctgtccgctgccgcattgctggatcgtgtgcgccatagcgaagacccggcggttgtcgagcgggtgctcacgttggtggagacggtcggcgtggatgaaatcgccgaactatggagcgatgctgagccggattcgctgcctggtgtgctgtggcgactgtatatgttgcgtacgtggatgcgatcgaatcgcgactcaatcgcgcatctgtggcgcttgggtgagccggtggccactaccgcctccgccatcgccggcgtggatcaggctcccaatgaagatgacatcgtgcgattggccgattcgattctctccggtgcttttgtgggcgattttgccgtggcgcttgagcgtgcggcggcgtttaccgatgtggtggcgttgggattgcgcgtggaggcgcggcgcatggtgacccgggccgaggccaacggcggcttctcctcggatgtcgatgagaaggccgtgcgcaccaaagccgcccgccttatgcacaccgccggcagcctcatggccaccgccaaggatttccaacacggtgccaacctctggcgtcgcggacggttggagtaaccccgctccaggctccctctgatgagggagccgtcacgggcgatgcccgtgactgagggagaaacccaccgaccgcaccccaacaatcagctaccgcccaacaccaccccttccccggcgcggcgagacctatcgcaagctatactaagtatccgcgtcggaccgtgcttaagccccgggctccattttttgccgccgcgagcggcccttgcgccgacaggcgctttcgcggttcggcgcttcttttttttaccagattcacgccccgagcgttgcgatgggcacgaccagtatgccgtcattgcggcgataggccttcccacctcggccggtaaggaacatcatgaactctggttcgcgaacttgggccatgggattgccgcagattttgttgcggaaggatttgagcttatccgcattgtcatcgttcaccttaaggtcactgagttttatttcgatggcaccccacctgccgtcagacaactcgataatgacatcaacttcaagccccttgtcatcgcggtagtaggcgatgcgattgttcgcgcccggcatggccgacagatatacattcaaatcacgaatgcacagcgtttcaaacagatcgccgagcgtctgtgtatcccgcatcagcgtcttcggcgacgcacctaaaaccgcagcaggcaacgaaggatccacgaaatatcgcttgggcttggttcgcacacgactctttgcgcggagtggcggttcccaaccctccaaatccgtcagcagatacaagtccttgaacatttccaaatagctcttcaccgtctgcgtatccggctcgcgccgctcatcgccatatgccatatccgcagccagcgtcgcatattttggtgcctgcgagatgttcacggcaagagctcgcatcaaagctcgtgcagtttcaggattcttcttcatcttcggcacgctgatatccagcacacttgcgatatattcgcccgggatttccaaggcgaattcatcgtctagctcaagatttgcgggccaaccgccacggcaacaccatctggcgatgtcttcgatactcgtattgcattcggcaggctcgaatttcccctcgaacaaatcggataggctgaccgcgcccgtggattctccggattcagccaagctcatgggccacatgcgcagacgagcaatgcgaccagtgccgctgtgatgaatggcgtcacgatcctttggaatagccgaacctgtaagaatcagctgccccttgcggttcgcattgtcatctatatggcgacgagcggcatcccaaatttgcggtacatcttgccattcgtccaccagatggggctcctcccccatcagcaccaatgcaggatcggtttgggcggccgcgaaaactgccacatcatccagacggtcaacgcttcgagaccgggagagcgcggtccatgtcttgccgcaccatttcggcccaacgatttccaccgcaccgaacgccttgagcagtttgcttaatctgctatctaccacgcgtgaacgataatcaggcctggtcaaggtaccatcgcgaccactcaaatcgttcatattgcagcctttcccagttctatcgttctaacaatatagattttacaccagtttcattcccgattttacacctatctcattcccggttttacaccagtttcattccctgttttacaccgtgttgttttttacgctttaccctctcagaggtatcagaggcagatctcggcacggacagggcattgtcctgctgcaactggcctatcgcagcaaaaagtcgaatcacccacaaatccaatccgataagcaagccgcgccattaccaattcggcaggtcggcaaacttggactaggctgggaatcatggaactccatgttttgaatcatccgctggtcgagcacaagctcaccgtgctgcgcgacaagaacaccccctcctccaccttccgcgagctcgtctccgaactcgtgatgcttgaggcctacgaggccacccgcaacctgtccgtggtggccgcgccgatcgagacgccggtcgccccgatgaccggcaagaagctcgcctccccgcgcccgatcatcgtgccggtgctgcgcgctggcttgggcatgctcgacggcatgacccgcctgattccgactgctgaagtcggcttcctgggcatgaagcgcgacgaggagcaccccacccagcaggtgacgtacgcgaaccgtctgcccgaggacctgtccggccgccagtgcttcctcatcgacccgatgctcgccaccggcggaacgctggtcgccgccacgcactacctggccgagcgcggcgccaaggacgtgaccgcgatcaacatcatcgcggcccccgaaggcatcaagtacgtcgaggagcacatcgacccgtccatcgacttcaaggtcgtggtgtgcgcggtcgacgaacgtcttaacgacaagtgctacatcgtgccgggactcggcgacgccggtgaccgtctctatggcgtaattgactgatttccctggctcccctccccgaggggagccaacataacggaacatctatgcaaatcgacattattgcgccggggcgcgtgaaggagcgttaccttcgcgacgccattgacgagtattccaagcgactttcgcgctactgcaagctcaacatcattgaagtggcagatgagaaaacgcctgaccatgcctccgaaggcgttgaccgacagatcaaggccagagaaggcgaacgcatcgccaagcatctgaaggacggcgcgtttgttattgcccttgccatcaatggcaagcagctgtccagtgaagaattggccgccaaaatcaacgaccttggattgcgtggcaccagccatattcagctggtcatcggcggttcaatcggccttgacgacgcgattctgcgtcgtgctgattttctgctgagtttctcgaagatgacgttcccgcatcagcttatgcgcgtgattctgctggagcagatctatcgcgcttataaaatcaacgctggcgagccgtatcacaagtaaaacgccatacctcatggggcgggaaatcccccatggggcggtaattgccccatgaggcggcaaaatcctcatggggcggtatgccaaaatggcttaattccgcggtttcacatattcttcaaaccgccccatgggcaagttaccgcccgatgagcctgtaaccaccccatgggcgcatcaataacgccctcaacctcacactgcgtcggggacgaacgcttcgaagatgtggcggtcgaagtagggggcgcactgggcgagttcatcgctgctgcgcacggtccatgaaaccggcatcgcacccatcgaacgagcgagcttgacttgcggcgaagcgccaccagtccagtcataagccacgaaatcaggacgagacagccagtcgaacgccagtaagccggcggcccattcagccgcaccattcttgctcagcttcgccggccagctcagctgaccgcggcacacctcagggtgatgctccttgtaccaattcaccgcgcccgggtggaaggattcgatcacgtacgggccgtcatacgcctcaagcaaggcgtggcccttttccatgagctcttcgctacgctcatcccaagccctgttgttgctgaacttgtattccacaatcagcggagcccggccggccaccacgtccagcacatcggagaacagcggcacatgctggtagtaccccttcggcgcggcggacggcgtgaccaccagcggcgggttcgcgtcggcacccggcaacggttcggccttcaaatcgcctgactcgccgttcgggaagagcggaatacgggcgagttcgtcgtaagtcaggtcttcgatgcggcgcggatcgccggccacgcgcaacaaatcggcgtcatggaccacgaccacttggccgtcgagcgtaagctgcacgtcgagttcgatgccatagccagcctcgcaggcggcggcgaacgcggccagcgagttttcgggagcaatcggaccggtcatatccgcactgccgtagccggccttgacagccatgcgacgggcaagcgacacataatcatcgttttcggcgatggatcgctcagtggtatcggcttgggcgctaaccggattatccccaccataatcagcgatatcggtatagccgaccaaaccagaacccgcatcatgcaagccacgatgggcataccatacctccggaatggagggcacgaaattacgacgcttgtcattgaacgtgcgcggggccacggcccacacggcagcaccggcggcggccacgcctgccagcgccacgtttctccagagcttcgacgacattggaatccttcctgttgggctgcctctagcctaacgcttctgccagccattgtggagtggttggatcatccggtttcagcgcgcggtccaggtggttggcgcgcagtggctcccagctgaaatctgccagcagatcggcgggtttgcaaggaattggagtgggttgcagacgcagcagccaggcgcagtatccgatgatttgctcgggggttacgttgcgggcgcgcaaggctcccatatccagcgaacgttcgcgcttggctaaacgccggccggccgcattgtcgataagcggcaggtgcgcatactcggggtgctcggcgagaggcttttccgtgttgccgcattccggctcaaagccgccagccaacagacactggcgaatccacatttgcagcgcggtggagcgcagcagatcacggccgcgcacgatatcatcaacacccatatcgaggtcatccacgaccacgaccagttgatagccgaacagtccatcggctcggcgaatcacggaatcgcctacctcgcgggccaaatcgtagtgctgtggactatagacacggtcgttaaagcatgcgacaccatcaacgattccggcatcgccctgctgttccggcggcacggctcccgacagcgcagcggaatcgtcaggcactgtacgttgcttttctcccgctgccgattccggcatggcgatacggatggaatgctggtcgccgcgaaccaaacgggcacggacctcgtcgggatggtcgtgcagcaggcggcggcacgtgccggggtacaccatgaagccgtcgccctcgttgggggccgaggcggcgcgaatgtcggcacgcgagcagaaacaggggtacagcacaccttgcgagcgcaggcattcgagagcgtattcgtatcgttcagtgcgctgggattggaacatcggttcgccatcccagtcgaggccgagccaatgcaggtcatccatcatgagctggtccgcaccggcgaccacacgcggcttgtccacgtcctcgatacgcatcagcatgcggtcgccacgcgagcgggccgaaagccatgcacccaacatggcgtacacgttgccgatatgcatgcgccccgacggcgtcggcgcgaatcgtccagtcactggccctcctcgtatgaagttcagcaccatggtagcgaaaaggctctcctcctcagaggagagccaatatagtgaagctcgccagcccgaactcccctcagtcagcttcgctgacagctttgctcagagaggggagccagtgattgtcacttgtcttcggtgacgttgtccacgctcacgtccggattgtcggagacaatctggtcgctcgcccaagcggagagctccagatgttcgccgccggtctggtcgacgagcacggtgtcaccgtcgtggaccttgccggccagcagcatacgggccagctggtcgcccacttcggtctgtaccaggcggcgcagcggacgagcgccataagccgggtcgtaaccggtgttggccagccattcgcgagccgagtcggtgacgtccagcgtgatgcggcgatcggtcagacgctgggacacgccagccacctggatatccacgatgccgccaagctcctcgcgcgtaagcgggtggaacatgacgatgtcgtccagacggttcaggaactccggcttgaagttcatgtggacagcgtccatcacggcctttttcttggcgtcggcgtccatgtcctcgttcacgaggaactgcgagccgaggttagaggtcataatcaggatcgtgttcttgaagtccacggtccttccctggccatcggtcaggcgaccatcgtcaagtacctgcagcagcacgtcgaagatctccgggttggccttctcgacctcgtcgaacagcaccacggaatacgggcgacggcgcacggcctcggtcagctggccgccctgctcgtagcccacgtagcccggcgccgcgccaatcaggcgcgagaccgaagccttctccatgtattcggacatgtcgatgcggaccatggccttctcgtcgtcgaacaggaagtcggcgagcgccttggccagttcggtcttgcccacaccggtggggccgaggaacaggaacgatccggtcggacggttcgggtcggagatgccggcacgcgaacggcgcaccgcgtcggacacggcggcgatggcttccttctggccgatcacacgcttgccgaggtagtcctccatgtgcagcagcttctcgttttcgccctgcatcaggcggccgacgggaatgccggtccagtcggagacgatctcagccaccgagtcggcgtccacacggtccgggaccatcggctcatcggccgggttggccgcgctggcatcggcagattcggcatccgcgctctccgcggcggcaagctccttctgaatggacggaatctcgccgtacagaatcttcgaggcctccgccaagttgccttcacgggtatacttatccgcctgcacgcgcaggtcgtcgagcttggcacgcaggtcgccgaccttgttgtggccagcctgttccgcatcccaacgcgccttgagaccgctgagcttctcacgggtgtccgcaagttcggcttgcagcttgcccagacgctccttggacgcaggatcctcggccttcttgagctgcatttcctccatttcaagacgggtcaccttgcgctgcagctcatcgatctcctcaggcgaggagtcgagctccatacgcaggtgagcggccgcctcatcgaccagatcgatggccttgtccggcagctgacgacccgaaatgtaacggttcgagagggtcgcggcggcaaccagcgcgtcgtcgccgatcgttaccttatggtgcgcctcgtaacgctgcttcagaccacgcagaatggcgatggtgtcttccacgctcggctcacccacgaacacctgctggaaacgacgctccagcgccggatccttctcgatgttctcgcggtactcgtccagcgtggtcgcgccgatcaggcgcagctcgccacgggccagcatgggcttcaacatattgccggcatccatcgagccttcggccgcacccgcgccgacgatggtgtggatctcatcgatgaaggtgatgatctgaccatccgcattcttgatttcgttcaggacgctcttcaggcgctcctcgaactcgccacggtacttcgaaccggccaccatggagcccaagtcaagggagatgagcttcttgccttgcagggtggtgggcacgtcgcccgccacgatacgctgggccaaaccctccacgacggcggtcttgccgacgccgggctcgccaatcagcaccgggttgttcttggtacgacgggagaggatctgaatcacgcggcggatttcctggtcacgtccgatgaccgggtccagcttgccttccttggcggcggccgtcaggtcggtggagtacttctctagggccttgtacgagccttccgcgtccgggctggtgaccttcgcgccaccacgcacgccgggtacggccttgcgcagggaggctgcggtgacgccgttcttctccaagatttcggccgactggttcggcttgctggccgcgatgccgataagcagatgttcggtggagacgtattcgtcgcccatctgctgcatttccttctcagcctgggcgatggcggcggtcagctggcggctggcctgtggctgcgaggtgctggatccggatgcgctcggcagcgcgaccaaagcgttgcgcaccgccgcgccgatggcctgcgggtccccgcccgcggcctcgatcagagagcgcgccacgccgttttcctggcgcagcagcgcatccatgacgtgcagggtctcgacctgcgcgtttcctgcggcggacgcactctgaatcgcgtcgccgacggcttcttgggccatagtggtgaacttctgttccatatcgtattcctccatatcatgcggtctgcgcagtgcggctcgcgggcttcgaaagccctgcgagcgttgcgacagaccgcagcttgtcgttgtctgatatggtcaaccgacctggaacccattctattcccaaaacttgagtgcatatgactcaagttttggattttggtggggagggtgactagtagccccctctgatgaggaagcttgggcagccgctacttcagtgcgccgacggcggattcggcggcggcgaggacttcgccggagagaatcgcctcggccacgccctcaatctgcggggtggtccaggtatcgcgtacgtcggggccgatttcgttggcgtactggcgcaccacgcggtatacggcggcgcccgccgcacccggacggtacggcttgcggaagtcgaaggagcggcaggagcacagcagttccacggccagcacgcgcgcaaaggccggaatcgaccggcgcagcttgcgggcggcggcccaacccatcgacacgtgatcttcctgcatggcggagcttggaatcgaatcgaccgaggcaggcacggcgttacgcttcatttcggagacgatgccggcagcggtgtattgggcgatcatgaaaccggagtccacgcccgggtcaccagccaggaacgccggcaggccgcggttgcgcgccacgtcaaggaagcggtcggtacgacgctcggagatagaggctacgtcggcggtcggaatcgccaggaaatcgagcacataggccagcggcgcgccatggaagttgccgttggactccacacggccgtccagcgtgacgcacgggttatcgatggcggaggcgagttccacgcccgccacggaggccgcgtattccacggtgtcgcgggcggcgccgtgcacctgcggggtgcagcgcagcgagtaggcgtcctgcacacgcacggtggagcccgggcggccggcctcaatcagaccagagtccttgagcatgcgggcgatgttcgcggcggaatcgccttggccgcgatgcgggcgcagcgcctgcaagtcggcggcgaatacgcggtcgttgccgagcatgccttccacgctcatcgcggcggcgacatccgcggtcttgagcagcaggcgcagatcggtgatggccatacacaacatgccgagcatgccgtcggtgccgttgaccagcgccagtccttccttctctttcaaatcgacgggcgtgatgccggccgcacgcagcgcttcgccgccgccgatcttgaggccgtcagcgttgcgggcctcgccttcacccatcgccaccaaagcacaggctgcgagcggcgccagatcaccggagcatccgagtgaaccgtattcgtagaccaccggggtgatgccggcgttcagcatatcggcgtagacctgcgcggtttccgggcgcacaccggtgcgtccggtgcacagggtgctcaggcgcagcaccagcaggccgcgcaccacctcacgctccacttccggtccggcaccggcggcatgcgagcggatcagacttttctgcagctgcgcgcgctgttccttggggatggaggtggaggcgagcgcgccgaatccggtggagatgccgtaatgcggcacggtgtcgtcggccaaatgatcgataaccgcgcgactcagcgccatctcatgcttcgattcgtccgaaatcgccactttggcgccgccgcgcgctacggcgataacgtcctcgatgctcagcgctccaacacctacggtgaccgtctgctctgccatgctcatacctttctatatacgtgccgcattccgcatatacggcatatgcggcacatgcttcgccggggatccgcgactgcccgcattcgctcaccgcacctgcccaccaacagcaggcgacgcaaacgcgaccaatcgctccccgagtaatcaaaccttggccatttcacctcagtcggatgcccgccataagccacttcgtccatcttgtgtctgaaatctcagacatgtaaggtgatggaaatatgagccatgcctcgcagcaatacgccttcaccgagccacgtaccgtcaagcgggcgcaggtgaagccatcagaacgggaacatcagacatcatcatccgcgccacgtgtctcgctggctccggcggccgaccgtacgctcgacatcctcgagttcatcgcgagcaatggtcagacgcaagccgccacgctcgctcgcgaactcggcattccgcgctccacggtgtaccaattgttggagattttggagcgtcacggactggtcacccgccttgccgagcagcgcgcgtacggcatcggactcaagactttcgagctgggatcggcctattctcgccaacatcgtgtatcgcaggtcgcgcatccggtgttggcgcgtcttgttgacgagaccggcgaaaacggacatctggccgtgctgcacggcaacgaaatcatttatgtgattgaggagcgcgccgcgcatcgcccgccgctagtgtcaggcgtgggcgtgcgcctacccagtcacctgaccgccaccgggcgggccattctgtccgcactcccccgcaatcaggtccgcgcgctatatcccaatcgtcaggcgttcaccgaccgcaccggcatcggccccaaatcgcccaaggagctggaggcgacgctcgccgaaacccggcgcaccggttttgccgaggaacacggcgacgtgacgcccggcttcgattcatacgccgtcgctgtgcgcgactacaacgatttccccatcgccgggctggctctcactttcgtgagcggatcgctgcgctccgaacaggagcggtctcttaagaccaagctgcggcttgccggcgcggaactgtcccggcgtctcggcgcggtcggcagtttgacatgaggattcgcgagatcatcgtgttgggctccttcgccccgatcacgattttctcaactaagttcaccgattcgctgaccggcaacgccaagctcgccggcttctcgctgacagtgacggccatcatcagcctggtggtgatgaccgccctgcacgcacttctgccgggagcgtaaggcgcgttcttgttctccgcctggacggttcccctcagagaggggaaccagaacgagtcacgcccgaacgattacgttgcgcagatcaccgatgccttcgacgtgcacgatggtctcgtcgcctgggtcgaggtggccagaggcgttcggggtgccggtcatgatgacgtcgccaggcagcagcgtggagaacgacgaaatcgcggcaatctgctcggggatgccgtgaatcaggttcgcggtggtgccagacgccatcggcacatcctcgccgttcagcgtgaaggaaatcttggcgtccttccagtcgaggtcgtcacgcatcacgatccacgggccaagcgggcaggaggtgtcgaagcccttggctcgcgtccacgtggggtcgatgccctgcagatcgcgcaacgtcacgtcgttcacgcaggtgaagccgagcacgtaatccatcgcgttttcaacggacacgttcttggcgatgcgtcccatcaccacggccacttccggctcgaagttcatgtccttggagcaggccgggtacacaatcgggtcgtcggggccgattaccgaggtggacggcttggtgaagatcaccatgtcctccggcgcgtgggcgatttcggagtggccggcctcgtgcatgaactgggcgtgggcctcgtagttcttggccagaccgtaaaccttggaggggatcaccggggaaagcaggcggatgccgtcgccgtcgaccgggtaacgagtgccggtgggcttgacctggtcgccggccagcggatgaccgtcgagttcgatgaggtagtccttgccgtccgtttcgtccttttgtacgaaggcgtagcgcggcgaatcattcaaagaaaaacgtgcgagtctcatgcctgtaagcctactccttggcggttccttccgcagaagcatccgtccaaggagcaagcagaccggccttcaatcgaccaaaacgcacgttcgctgggattgctacttttcggtccaggttttgtcatacagcgactggccgctttgcgtgtgcatgatgacgcgcaatgatgccttgccgctggaggtcttgcacatcgagcccagcagattcgcggtggattgataggtgctgtccatagcatccagtgaggaagcgaaggtatcgcctagcgaggcgtagctgtcgtcgagcacgtactcgtacaccaaggtgtcaccgtcgacacggtagttgaaggtgatgccggtgtctgcaaacgtatccgcttcggattcaatggagtccttgaattccaaagagtcgacgaaatcctgaatcgaatcgtacagcccataatcgccgtcggttagatcgtcatgggtttcgcccaacgtgtcgtccagcacatcgtcaagattatcttgagctttgctcttatcgctgctatcaccgttgcccgaagaggactgactatagaaggaatcggttttcgcctcatctatagccttgctggcatacgaggcaccgccgacgatcagcgcgatgaccagtattacctgtatcaccatgcccgccgcactgatgatgatgccggcgatggccaagcccttgcccttgccgccctgtttcttaatctggttgaggcccacgatgctcaggatcagaccgaggagtgagacaaggaacgagcagataaaaccggcaatagccagaccgttgtacttctggttcgcttcaggcggcacactgccgtaagaaccagaccatcccggctggccgttcggttggccgccttgcatatacgggttatagggcgtttgcggaggcacggccccgccgcccggatataccggagcactgacgctgccgtagaccggaggaaccgatccgcctgccggagccgcccccggatagggcgcgggcgctgccggtgcgggcgcgggcgcagcggcaggagtcactggtggcaaagcctgcgtaggcggtaccggctgattggccggtgcaaaaggctgggtgggctgctcggcaggtgtaaacgcctgtgtaggctgctcaacaggagtgaacgcttgagtggactgttcgcccgctgcgattgcttgggttggagcattgttggcggcggttcccgtttccgccgtcatcgcatttaacggctcagtcggattggcgtcagcttgctgccacggcacctggccgttcggattgacattcggatcagtcatgacatgcactccttcaactgcatcgcaccccacttgcgagatgcgcccctcgtcttacgcgccacattgtgcgttacagacaactgtactcctcgtggcgagccttaagtaccccaggaaatttgtccccgtcatcgacgcgacgtggcactttaccaattcagtcaaataattgcttcacgaacaccaatcacgctcaaactttgtgcatttggcgcggtctccaaaccagctgttcaaaccactctctgcggagcgattcttgcgtcagaagacgggcagcccctcgactggctcgtagcgcgtggcgcggccacgaccacgagattgcgcaaagccgtcttcaacgagacttttcagcagtgcccgagcacgcgagacccctaattccatatgctccgctaattcggaagttgatatgctgccttgactcacaagatactgtagcgcttctgattccgatttggagaggtgtcccacggaagtccaggatttcatggactcgctatttgctggcgtcataacagatccgccaaggtttgtgtaccgtactacaagttttacgcgatcaggacgagttagcacttccagcagtggatgcggcgcgccaacagaatcacaaccagctcgcatcacatcaaagccacttcctgctttttcaccgataccgatgagaaaaaacattttcatgaggataggattgcgtgcatcagatattccaccttgctccgcctcggcctttgtaacacggagccgcccaggattggtgaactcgatggttgattggcgcctaataatcacagtgcctcttctacccatatagtccgcatgaacgatagcgttggttaacgcctcgcgaatagtgatttccatgggattttcatccatacgtcgcgcttctccgtccaaacggaatgggcgcggcaccgcctgccgcagcctaccatatactgactgccaaaaatcgtataagttgccggaccaaattccgtcagtagaggtaatgcgatcatcccaacgatcgagtccaatttcttcacgatagtcaaggaaataatttgcgaattcccgcacgatatcatattcgcgcccaaacatcagcaatccagcaatagttggatgcaactgattatctttggtagaacgagcgagcgcctgcagacgcacgagaaaatcttcgtcattgaggttacgccacggatggttcgggcgaatcctttgaaaataagaacggtacgaggcaatcgtgcctgaatccaatgcggcactacccaaatcttccacgatacgaagatcctgaggagtgtcactgccatcgcgaaacattgctttgacttcatcccggtcgcaatggtagtcaccctcgttattccttctgaaggtgcccctatgctgttcccggctaaaaggatcagcgcccacatatataggcatgatctcccgccctgcacgagggacatgaatcacgatgaaatcaccggacgatccatgtcgaatcacaacatcttggtcggaaagtactgtggcgttgaccttggaacggtcattgacagtattccaaaaatcccgtttgagcttttctgcatccgttacccctgttacattcaattctcgtcgcgagttctctgaaacaccaagaagaataagaccgccatcagagttggcaaatgcactatacgtatcccatagactgtctggtaatttgtctttggcctttttcgcctcaatacaattatcttctcgaagtagcctcacatccgactcggaaaggctggcaagagaaatcaactcaataacgtcagaattcgccactttatacgcctttccgccagtctaccgccactttatacgcctttccgccagtctaccgccactttatacgcctttccgccagtttttcattctggggaagccgagccatgttcaagcagcgtcatcccccacttgcaacgttaaaaacacaaaagcctgaaaccggctattgcctcagcaatattcagtcggtttcaggctcaatcgttaatcctctggcgaaacgacggtctacttcttcagtagcggtgcgacttgctcctcgtaagcggtcagggcggtgtcgatcacgttgtgcatgtcgtagtacttgtacgtgcccagacgaccgccgaacacggtgttcggctcggccttggccttggcctcgtactgggcgtacagtgccttgtccgcatccgtgttgaccgggtagtacggctcgtcgccgcgttcggcgaaacggctgtattcctcccacaccacggtcttgttcgggttctgggcatcgcggcgctccgggttgaagttcttgaactcgatggcgcgcgtgtacggcacgtccgcgtcggagaagttcatcaccgggcagccgaagtggtcgccctcatcgtagcggacctccttgaagtccaccgtgcgccacttgaggtcgccgagctcatagtcgaagtaacggtccaccgggcccgtgtacacgacgggcacgccagccgcctgcagcgccttcttgttgtacggctgggactcgtcgaagaagtccacgccgagctccacggtgatgcgcgggtcgtcgatcatcttctccatccacgcggtgtagccgtcggcgggcaggccctcccacgtgtccttgaagtagcggttgtcgtagttaaagcgcacgggcaggcgcttgatgatgtcggccggcagctcggaggggtcggtctgccactgcttgccggtgtagttcttgatgaacgcctcgtacagcgggcggccgatgagctgaatgcccttgtcgttcaggttggccggatcggtgccggccagctcgcccgcctgctctgcgatgagcttctgcgcctcggacggcgtgtaatgcgcgtggaagaactggttgatggtgccgaggttgatgggcagcgggtagacctcgccgtcatgcgtggcgtacacgcggtgcacgtagttcgtgaacgaggtgaaacggttcacgtagtcccacacgcgcttgttggaggtgtggaacaagtgcgcgccgtacttgtggatctccgcgccggtctcctcgtccatatacgagtaggcgttgccgccgatgtggtcacggatatcgatgatgtgcacgcgggcgccggtgtgctccaccgcctgctgcgccaccgtcaggccaaacaggcccgcgccgacgatgaccaaatccgggtactgcgcgccctccgacgggccgtgctgcgtattctccgccgcatttgccatgactcaaaacctttcaaccggcatgtgcgattccacacgcgtttcattgtccaccagtgtagcgagaagcacctatgtacacatgcgattccgaattcagcggctcctataggcttcgggcttccggcttgcgcaggctgggtttcggctttacttggttcacgcgcgacgtgcgcctaccctgtgacatactgttcatgtccgcataaacagggcggcctgccggctacgaccgcagggcgcagacacgtgaagaaggattcgccatgacgcaggtttcgccgcttgtctcgatcatcgtgccggtgtacaacgccgagagatacctgcgttactgcgtggactcgattcttcagcagtcgtatgagcatctggagatcatcctcgtggacgacggcgccaccgattccagcccgatgattctggacgaataccagcggcgagacaatcgcgtgcgcgttatccaccagacgaatggtggcatcgcgaaggcgcagaacgccggattggatgcggcgcacggcgattacatcgcgttcgccgacaacgacgacatcctcgaccgccgcaacatcgaactgctgctgcacgcgctgatttcgaccggcgcggacatgagcaaggcccgctggaggcagttcggcgtctcccaaatcgaggaagtcgcgatgaaagcccgtgaaggcgccgccgaacctgaacatgtgagcgtgttcacgaatccgctgaacgcctaccagaccgtattctgcaagagcctgcgcctgatcggcgacaagcttggccacaacacggaggcccgctatttcaacgaggcgaactggtgccgcctgtacaagcgcgaactatgggacggcgtgcgattcccggaaggcatgtacgcgcaggacacagctatcgcaggacacctgtacgtgcgtatgaacaaagtggcggatattgacgtgaacctgtacaactggcttcagcgcccggaatccgtaacacaccaaaagcgtgacttcgcgttccaccacgaccacatcactgcggcatcagataatttccgtctctgtcttgaccgaggcgtcctcccatgcgtagctactacacgttgatcggcgaactggaagccgagagggaatctcctaacttccatattccagaaaaccagcagcagtacgaaaccgaccgtcaggaaattaataccctactagccaatctcacccgcgcacagcgcatacggtgcgccgtcatccagcgcattcgtctgtttgagaagtatatctacgaccgcagaatcaaaaatatgcgataaacattctttactgtacagtcctcctcgtccaataaaacagagcccgttgtctagatggaagtgcgataccctttaaattggagattgtccagataaccagtgaaagggtgtcgcaccttgggtcaagtgcattcgcaccttgggtcaagtgcattcgcatctgtcggaagaggaggtagtggggtgcgcacagatatcaagtcgggaagaacggttcgtcaatcaggtatcgaattgcttcgtatcatcgccatgtatcttatcgtcgcccaccatatggtcaatcacaacagtttcgattttctcggacaggacaattcgttcagaaaagtaattctctccttatttgagtatattccgggaaaaatcggcattgcattgttctttatagcttcggcatggttcctttcctcaggcaatcaaagtttgaagaaatcctgcaggaaaatatggaaactggaacgcgctatcgtattctggagtcttaccgcgttgatcctgcaataccatcttgacccggggaccatacatcttcaacagatcatcagcgctttattccctactgtcacacaattatggtggtacacaacctgctacgtcctgtttctcattttcttaccgttccttaatctcagttttaaaaaataggacaacatgatcacaaaatcctggcatttgtcatgatcatggtctggggcgcatcatcgttaattccctacgaggcgttgaatatcggcctgaacatcattggattcatctacgtatatacgttgatcacctactatcgctggtatatgcaaccgctatcgacaaaaaccgccctgattatcgcgactgcctgcactctgctgttgctcgcatggaacgtttcgtttgagctgttatacaccgataagcacgccggagagtatcaggctctgatgtacatcatggacagagagtggtcgctgccgatactcggcttgagcttgggtatgttcatcatattttcccgcatgcagttccgctcccggataatcaacacgatcgcttcatggacgttaggtgtatatctaatcacagaccacagttacatacgagacttactgtggacccagtggttcgccttcgacaagtactaccaatcacacttcccggttgttattatgctggcaatatccatgctggtattcacagcaggactggcccttgaggctgttcgcaagatgatgtttcaacttataccgatgggagacggagtatttaactggttgtggaatagatgcagactattcgtcgcccattccaccggacagaacgattcctctcttgactagcactgcattcatctggagaacgatacggtccagcgatacggcaaagatgacaacaaaaatgggaaggaaggaatacaggtagcgcgccctagtctcgaatagcatcaggaagcatgtcaatccgataaaggataggcgaagaaacaccgcataatcatcagtatttttccttggtagcagtaaagcggcgcacaacaacagaatcatccacagcagctgctgcagtgacccaaaaacggaaggcgtattgttttccatgtagtacagctttttcagcgaattaggcagattcctctcactgggcacctcagggaatcccttaccctcatgtccgatgccaaatgttccatcaccatatgtagtgacgagttttacggcataaaaatggattgcggaatcagcgttcattgcctgcaaacgccgtaatgctacatcaagatctttcgcttgacgatcggttttatctggaatgcccgcagaaatcttcacatcgttcaaattgaacgcaccatatgactgcgggttcgcccccatcatcaaataatgatgataggaaaacgccatttctggatttggattgacatgaaggtgtttctttaacagaggagaagcaacaccgtagataagggtagccgacacaagaatcgaaaggaatatgcagagaatgtctttcaggacgccttcccttctggcataacggagtatgcaatcaatgactaacgcaactacaagaaccaataccgtcggcttgaacaagctgccgacgaaagcggaaaacaccattaccacaagcacaatataggtaataggtgcggcagaattccgataaataagatatagcgatatgacggtggctacgaaggggaacaggaacgtatccgtataaggtgttccgatccaaaacgaaagagaacctaatattgttgcaataatccaagatgcatagactatgcatgccttgccgatagcactgcctatccctaaagccaggataagacatcccaagttgacacccagtgctcccacagacgctgtaaacatcgctggatccagcttaaggacgaagctcacgcgcacaagaaactgcatcaggacagccagcccataattgttggggaacatatcaaaatacggttgaaatgcccctaaatcccctccccttacggcggctacagcataattgaatatcgtgtcaggatcccaattggcaacatatggcgtatatctgataaccgcattttggaataccaataccgcgacactcaacaggggaagcacatagcagtagctattgccacctttacaggaatacttcagcaatgcatatgtcagcaatacaacaaaaagcaacgcgacaacgaaaaacacgggcataggcaaggcatacttcggtcgcaatccatagggattttccagcgatgagtacccgaacgacaccaggaacaatatcataacggcaataacgctgtagatagcatatactgtgtaggtcagatagacgcccaatcgagccaaacccatatctatggtgtcacgcatcgtttccctatcaatccgaattcttcattcatcccatgctgatctgtgcatgctgcaatgcagttcgcaccccatgcattgcagcatactcaccgctcagctttcgtgcttctgctgttcgctgctttccagcgactgcgcagcaatcgcctgttcgtcctccaaattgacggcgatggcggcacgaacgcctttccatttctcgataacgaacaacggattgagagcaagccaatacaacttgcgcttccatgtatattgccggtcacgcaggatgaacaacgaacccaacgtgaaggcacgcacgacctgcttgacaacgaacgcgatggaaatcggatccatggttttgcctacgcgacgaactcccacgatctcgtcgaacatacgcttcctgtagtcacgtagcttaatctcgttggtgtgccacacatttgcacgaggggcataggccttcacgtacccatgccggatgaggtcctcgccgaacttctggtcctcggcatagggaatatcctgataggggacgtcgcacaacagcacggatttgcgcgcggccgagttcacgtccgagtagaacgtgacgaggtcgaagagctgttgcgagtcaataaagtcatcatcatagaacagtgtggtaccgaagtccgggccgaactgcttgaacgtgcggatgatctcctccttcagcagcggtagcgcggtggcacgcggatcctgcttacccatcacgcccacgacctgtgggaaacgctccagcggctgaatgatctcgtacagccaacgatcatgggcgggagtggcatcctgcgtgaggtagatgacatattcgccacgcgccttctccgcagcctgctgacgcaccctgccgtgggaaaattccggtttggtgatggtttcgtaccggaaatgccggaatttcggcgcccaggatctgatgatctcgggcgtgcgatccttggagctggtgtcaatgacgagaatctcgtattcgaagtccaccttctgcttatgcaatgcagtgaacaactcatccagattatcctcgccgtaataggtgggaatgaagacggtggctttgatgtcagtcatgattctgtacggtggcctctctaagaatgatacgttcgaacttctcataggaggcatcccaggaagagctttccgctctcttggagatgcgttggcagcgcgcttcgatgtccgaatcgttgacgaccttgtcaagcccgtgggcaagttcgatcggagaattgagcgtgtacacgatgtccgggttctctccgatgaccatgcggttgttgtcgccgtcattcatcaccggaacgcaaccggcggcaagcagctcaagcggcaacagggacgcattggtgagagagagcacgagacacgcctcggactcatgatagatttcggcgagctgcgcggggttgacgatgccgcggttctcgtacgggaaggggatgtcgtagtcagacacgtcccatccgaaaaacacgatcttgtagtcagggtgcatctggtggaatttcgccaaggcgagcacaccgatctcgaaagcccggcgttcggtaacggggcggccgtagaagcaaatctgcttcttcttggttacatcacctttcggcttgtagatgtcgaggtcggcaccgaagtcgaagtagtcggcgggcatatcgaattcaccgaccttcttggtgagccaacggccggcggtgatgccgtagaaaccgaacctatacgtgttttcggcgagcaccgacttggaccccataccgtagaagagcggctcgtaatcctgcacaaaatacatcttgtgtgcattggtcttcatgttgaagaccggatatgcagtctcccatcccgtggcgaaaagcacgtcaagatcgatgttgctgatgtccttgaccggcacgcaagtcacatcgatatcgaaatgctccttgagcagctggtgggagtattcggccggctgtttggcgatactctcatatataaagaacgtaacgttatgcccgcgttcctgcaaggatttggcgaagcgtgcgatggtatgttgtcctccactgccgacgctgatgggagacagcacccaaccaatattgagcttgctcttctccaccttcaccggagcgtgatatggatgcgccacgaaatccgccgccacgacatcttcggcagaagtcataacatccaacggacgcttagcaaccagatttcctgaagccgcttgctgttgcagcctacggttcaggtaatccaacgagcgaagtagcgtgactcgaataccactcttcctgagatactgtgcaaaagcaccgatttttgacatcatttcgccttccctagcagacgacgcatataacgaactggagcgaggatagcaccacctatcttccactggagagaagcatacacagattccctgaaagcaatcgattcccggacggtccgttccttctcttcgagagagtgaatagtgttcagcagcaaatcgatttccgcgctgaagtaccggaattcatcaggatactgagcgttatacttctgccagatatgatgacgcactagcaacagctttaacaaatcagcttcctgttgatcgttgcgcgaatcggcattctcatgtttccggtagtagtacaacggctcatcaagcagaacaggcgacgcacctgtcaggcatagtcccaatgcaaaatcccaatcttcatatccaacaccgttaagatacgagtcatatttcacaccggattgacgcaaatatggtacggaaatcattgcatacgcaccgatgtagttttcatgtttcaacttttcgagattgtactgagggtacaacgagtcgaaattcactcgtccgaaatacttgacctgacagtagacaatattagctcgactttcggtcgcagcattaactgccttccgtacatagtcagcatcaagataatcatccgcatcaagctgaatgagataatcgccttcggctagcccaagtaccttgttgcgcgtggcgacaacacccatattcttctgggtgacgagttcgacggaatctccatatgtgttcctgataaggtccaccgacccgtccgtggagccatcatctacaacgagaacctcgatgttgcggtaggtctggttcaggacgctgtcaatcgcctcgcacacatactgcgagtagttgtggttgattaccgcaaccgatacgagcggctcagcggtcactggaccgggttcctttggatacatggcttgaggcttctctggcatcacaaacggctatcctaacagaaccaacacctagactggcaccggtgaatgtcgtgaaaagacagtagcatgtccccaagtgcggcaaacggcgaatactacgctgccgcagggcaacatgtagtttgagcgataggataggttctcgtgtcagagctcattcgtcggttccaagcacggtaccgttatggcctcatcgtgctgaaggaactcgtcaagaccgatttcaagcttcgctatcagggatcgattctcggcatggcttggtctgtggtcaagccgttgatgcttttcggcgtcatgtacatggtgttcgtccggttccttaagttctccgacggcacgccgacattcaccatctcgctgctgtgtggcacctgcctgtggagtttcttctccgaagccacttctgtcggcatgcagtccattgtcggccgcggcgatctgctgagaaaggtacacttccccaattacatcatcgttgcttccaccacgatggggtcgctgatttctctgggtatcaacctgattgtggtcatcgtgtttggcttcttctccaacgcgcaatacacatggcatgtcctgctcgttccgttcaatgtcgcccagttgtacctgctggcactagcgtgcgcgctgattctttccacgatgtacgtctacttccatgatgtcgcgcacatctgggaggtcgtgctgcaggcaatgttctactccatcccgattatctatccgctcagcatggtttcgaatcgttacccggttatcgccaagttgatgctgatgaatcccgccgcccaggccatcatggacattcgccataaccttgtggcacctgattatgttcccacggtttggacgatgattgccaatccgttcatcgcactgttgccgtatctgatgacggtggttctgctcgtcatcggtattcacgttttccgtaagcacagtcgtaagttcgcggaggtcatgtaatggtcgatcacaccaacactactcacggggaagttgccgacgcctcgttgaacgaagacaagccggtcgtactgtccgtcgaacatgtctccaagtcgttccgtcttccaaccgaacaggccagcggtttaaagcaggcattcatcaactggaccaagggtatcaaaggctacactgaacaatctgtgctccgcgatatcaatttcgaggttcatcagggtgatttcttcggcatcgtcgggcgcaacggatccggtaaatccacgcttctgaaaatcatttccggcatctatgttcctgaaacaggcaaggtatcgatcaacggcaagctggttccgttcatcgagcttggtgtcggattcaatccagaactcaccggtcgtgagaacgtttacctcaatggtgcgctgttgggcttctcacgtgacgagatcgatgccatgtacgacgacatcgtcgagttcgcagagctgggcgattttatggaccagaagctgaagaactactcctctggcatgcaggtgcgtctcgccttttccgtcgccatcaaagcgcagggtgacattctcgttctcgatgaggtgctggcagtcggcgacgaggcgttccaaacgaaatgcaacgacttcttcacggagattaagaaggatcccacgaagacggtcattctcgtcacgcacgccatggattcggtgaagaagtactgcaacaaggctattcttatccgtgatggtgaggtcatcgtcaacggcgacaagaacgatgccgcgaacacgtacaccgaagagaatctgaagagtctgcagaagaaagccgccgaaacagtcgaggaaggcgagtatcccaccggtctgaatggaacggtaccaatgctgcggtgtgtccctacatcgaagatggtgctgaccagcaaagatacgtttgaatttgacgttgaattcgaatacaccaagactgacgagtatttcttggctgtctccatgctcgacacccgtcgtggtggcattccctatgattccggctccattaagatgggcgtaggcgggaatggcaaacaatccgttcacttctctctaccgcttaatatattcaacaacggtacttataagattaccgcgtccttgcgcaagcaggatcccgcagatccacaccacactttgttggcaggtttctccaatgatgagaattcatgtctgttctccatcaatgaggatgccaagggcacggattatgcgttgctcaaatatgacgctgttgatttgaggagaagctaatgttctcgaagaacgaagatattcgcgatatccagaaaaccgccctgtctatctttaaagagttccggcgaatctgcgaagagaataatcttcgtttctatacttcgggaggcaccactattggtgccctgctgtacaaaggattcatcccctttgatgatgacatcgacatcaatatgccgaggccggattatgagcggttcaaacagctcgctccggccgtcctgcctcgccacttagccgtattcgatggtttagaaagcactcatgcggatttccattttttaaagctgcacgatacacgaaccatgttcaccgcaaatctactattgccgtaccctgactgttatacaggtgcgttcattgatatcgaacctattgacggagttccgagtaatcaagaggaacgtgagcaatggtattttcagatagataagctgtactgttatgacttgctccgcaagttcggcaagaaatacctgtatccggataccatcgcatggctgtacccgaatcgtctgattcgcgccattgcgtatgcttggattcaacttcatccactgcgttattacgcagaaaagtatgaacaactgcagcggcattatgctgaacaatatccttttgatgagtccgaatacatttcttatccacgttatggcatgtatcgaaccaagtccatgtggaatacaaaacgcgccagctgggattcttatattgagattccgttcgaggataccaccatacgagttcccaaaggctacgaaaatgtcctgactaaccagtacggcttcatgcccacatgggagactcagaagcgctacgaacaagacaccgactcccaccacatcaccacagctctggtagatttggtaaaaccattgcacagttacaggacttcaaaatcacttgatagagaataagttgattatcaactctgcatttctcataatactactcgttatattagcagcagtcacggcgctgactgtcatttgctatgctttttgtaacatcagcacaagcaaagaaacaacggatttcacgtatgaaataccgacaaaaaaacggtagtacaatacatcacgtaatcaaatctcagacaaacaatagaggagcaaaaagattaatatcactaggaattaaaaacttaggatatttagtcacccttatcactgctctcattactgcattgactgtcatcaatggcgcaaatcaaactttaatcgacgcaaaggaaactcgaatgcggtcagaatctgactccgcggtgagcaaactggccaacgagagcgcagcagaaagaatggcgggagttaattcgctggtcgccctggctgatgattggggaagtgattcagaccttcaatcacatgaatatcatcaaaaaacatgtgcatatgcactccttacatacctaaaaacaaaaccgacgatgaagaatgcctcatcaatgacggatgacgaggccataatacgcgatagcatccaaaagggtttctccgaccatcttcaagtcgataaagctgccacttcatgggatgaaattcctctcagcttttccggatcatacttttacaatttcaacttatctgacgtttcgtttaaagaaacggcattatttgacaattgcactttttatggaaatgaaacaagttttaatcataccaagtttctacaggatggcattttcactgggagcacattttacaataatgttgatttcacgggtagcttatgaagattccgctctgttttcgataaggccaaattcattgattcacatgattattctaaattctccgagttctctcaggcatcatttgaagatgcacgtatgaaacaagggcttcttttcaacaatgtaaccatcgagaatagaatggattttggcatgctcttcaacgaccagcactattcttctgcccatattgatggagaaatactagctaatgatattaccatcaataatacaacggttgacttagacggagcagtagctcaggattatcaggggagcattttatcagcacaaaatggttcattgaccataggaggaaccacctattcaactgcaggagcgaccttcaagggaagtctaaagtaggatgtcacccattgtgtttcaaattgaggctcttcgggtgtttgtgcggatgtgaatcacctgtctggcttactgcctattagcgtccggggaggcggaggttgagtccgccgcatttgagcatgacgaaaccgatgaggttgtcgaggttcctgtatccgtagccgattggaaaataatccggcttggtaatggggtctcctgaaaatggtaccgggtgtagcgtctggctggtactggtgtgctgtttcccgtagcgtctttcagtgaagcggtccgatggcgggccgccttatcgaaaggaggccgatgatggccgtgaattggaaacagatcatgatcatgcgtctcaaggggtgagccaggaccgggtggcaggcgcggcacggtgcagcaagcgcgacgtggcgcgtgcgtccagggtcatccgcgagcatggcgtgaccatggagacgctcatgggcatgggcgacgcgcaggtgcgtgagcgttggttccccgccaagccgcgcgaggcggacggttcttacgcgcaaccagacatggactcgtacgtggagcgcaagggcacgtaccgcaagctgccggtcaagttcctgtggtacgactaccggcgcaaggccgagacgaccggtctgaggacgtattcgtaccaggcgttctgccgcatgttcgccctgcgctgcgagcaattggacgccaccgcccgtctggagcaccaacccggggagaaggtggattggcaacggtgtgttggactgtttctagagggtttttccttgttgtgtgaactccacggggctcaggtacccgagggtcgagtggagccgttggtggttgtaccaccacacgtaccggttgacgtccgagcgcagttgctccacgttcgtgtagacgttcctgtggatgagctccttcctgacgagccggttggtggattcgaccaccgcgctgtcgtacgggttgcccggcctggaaagggaacgcgtgacgccgaacacgtcgagcacgcgttcgacgcgttccccggcgaacccgccgccgcgatccgtgtggaacacctcgatctcatccagcgggaagcgcagcgcggcgaacgcggccaacacgagatcggcgtcgtgcccgacgccgaccgaatggccggcgatctgccggctggccaggtcgccgggcaggcagacgtacgcccacgaactgccgaccctcacgtaggccgggtcggaggccagatgggtgcgctgtatgtgttcaatagggagttgaggttttagtcacgtagttttttcgggtttaggcagaaaggcatgccgaccacccgtgggccttagcctgatggtgcttcgaatccattcgggaaagggccggaaaggcaaatgatcagcatgcccaaaatacagtctatccgtcagaggcgcaggaatggggagtccgtcgcctcgatcgcgcgcggcgagaaggtcagcgagccgaccgtgcgcaagtatctcaaggccgacgacctgtcggccaggcctccggtaaggagacgccgtggctcggtgctcgacgagtggattcccgtgatcgagggcatgctcgccgaggaccgggagacctggcacaagcaacgtcacacggcgacgcgcatccacgagcggttgcgtgacgagtacggggtggaggcgtcgttgtcgacggtgacccggacggtggcccggttgaagcgtgagttcatggcggagcgcgagatgggtttcctggacctgtcgtggcatccgggcgaatgccaggcggacttcggccaggtcgacgtgcgctaccggggcgtcgtgacgcggatgcggcatttcgtgttggatttcccgtactcgaacatctcgccgtgccagctgatgcccggggagaacgcggaatgcacgtgtcaggctttgcttaacctgttcgaatggctgggcggggtgccccggcgcatcgtgtacgacaatgccgccggcgtgggccgccgacggttcgacgagatccgcctgacccgcctgttccaggcgttccaggcccattacgggttcgaatactcgttctgcaacccgtactcgggccacgagaagggcgcggtcgaggccagggtcggggccgtgcgccgaaggctgttcgtgccggtgcccagcgtgtggagcctcgacaacttcaacctgcgccttcccgaccgctgtctcgagctggggacaaggaccattacaggaagggcgagagccaggccggcctgttcgaggatgatcgcaaggcgctgctgcccctgcccgccaagccgttcgacgtggtcacgtggacgaggatgaaggccgacaaatacggaaacgtcaccgtccagggccgccaccggtacgcggccggacccgaacacgccggccatgagatgatcgtcggcctgagggccctggaggtggagatcctcgatgccgaaggcaaacgcgtgatcacgcatccgaggtcctacggggacaagccgaccgacagcggcgacccgtcgagccagctcgggctgttgtgcgaccggccggcggcctggcgcaacagccgggtgcgcgacgcgatgcccgacccgcttcgcgaatggatcgacgcgcaggacgaggccacgcggcgcgacagcctgcgtgccctgctgcacgccgacggcgagagcggctggcgggcggccgtggccggcatgctcgagatcctcgaatccaccggaggcacggaccgggccggggtatgtctggccgcggcacgccacgcctcgggcctgggacccgtggcctacgacgaccccgtggacctgagcgaatacgacatcgcctacaccaaggaggacgagtgaaccagaagaacggacggaccgaccccggcccgctgcgcgagcgggcgaggagcctgttcatctcgcaggccaccatcgacgaaacgctcgaatgggccacgccccgccaactggacgccatcgaccgcatgctcgccacggaactggccaacagggaggcctccaaacgggcaaggctcatgcgccaggcccggttcccggtgcccaaaagcctcgacggctacgacttcgcgaacgtgcgcctgcccgacggatacaccaaggagcagctgaccggcctcgatttcgtggccaaggcgcaggacctcgtgttctacggcaagacgggacgcggcaagacccacctggccaccgccctgggcatgctcgccatcgagcaaggcaggagcgtgaggttccggcagaccgcggagctcgtgctccagctcggcaaggccaaacgcgacggcgccctcgacaacctgctcaaagacctcgcccgtgccgacctgatcatcctcgacgagttcggctacgtgcccttcgacatcgacggggcccgcctcctctaccagatcatcgccggcagctacgagcggcgcagcatcatcttcaccacgaacatcgagttcagcaaatgggggacgatcttcgccgacgacaaactcgccgccgcgatcatcgaccgcatcgtccaccacggacgcctcatcgaattcaccggccccagccgacgcgtcagccaggccctcatgttcggcaagacggacaaccagtaaaacaaaccaccggccggcactcctcatgccgaaaaccgaaaaaaattagtgacgaaacacgaaacaccgacttgactaaatacagggtgcgcggcgcatagccattgaactcgcgggcgaggatgttgggagccgggtcgtcgtccggcctggccgggcgtggcctataggcggccttggaataggagccggccatgccgttccccttcatgatccggttgatgcggcggcgggacagcgtcacgccctcgtgccccagggcgtgcctgatcttcctggccccgtacaccttgccgctgtccctccacacgcgctccacatccttctcgtaagggtcggcgcgctcggcctcggggtgttcgagcatccagtggcaggtcgacttggcaacgcccaggatcccgcactgcgccgataccgggcagcggccggcgtcggaccgtatcacgcctgctttcgtgcgaataccggcgccgcttgttctgaaacatcgacctccatctccagctgcctgtcgcgtttccgcaattcgatcagctcgttctcctcgggagtgcggttgtcgaccgctttcgtggagccgctgttacgtatcccctgcacccaacgccgcagcgtggaacgcgggatgccgtactccgccctgatctgcgacgacggcttgccgttcccgttacgactgcacgatctgcctcttgaactcctcctcgtaatgacggggacgattcggatcggccatgatgatcaactccttcgttgtcatgtcccgcatgaaccagtccaatacattgtagccaatccagtgccgcgccggccggtggcgagtgggaggccgacggcgtcatcggcgtgggatgtagcccgcacaccgaggtcgaaaggcgcacgcgtttccttatggcgcgcatcgtgcccgacaagaccgcccgcgaaagcatcggagcgcggttcctcatgttctccgcgctgccggctggggccgggaccggcgtcacgcacgacgacggcaccgagtccgcccgccacgcggaactgcgcgaacggctcggcatggccacctacttcgccgacccgtactcgtcgtaccggcgcggcggcaacgagaaccgcaacggcgcgatccaccgccacctgcccaaacgcacgcgcatcgacccgtccatgaccgacgagatacaggccatcgtggacagatcaacaaccgtcccatgcgcgtgctcggctaccgcaccccggccgaggcattcgccgacgaactgctaccattaaccaaacaacaaggatgttgcacttctaaatagacaacggggggcgaaaccccgcaagccgacgaggactaggatttcgcgctcaccaccggtgaggcaccactccgggcttcgcgctcattttcaaatgaggcacctcgggcattcttctgtttcaagataatcttgtcgtcggacacatccttaaggtgcttgccgtacgggctcttgccgtacttctcggcggcctcaagcagctgctcgcgggtaatccagccgttctcataggcgatttcctcggccacggcgatgggcaggccctgcgcgcgctgcacggtgcgcacgaactcgcccgcctcgtacagggagtccatcgtgcccgtgtccagccacgcgtagccgcggcccaacgtgcgcacgttcaacgcgcccgcctccaggtacatcttgttcaggtcggtgatctccaactcgcctcgcgcggacggtttcacctgcttggcgaactccaccacgcgctcgtcataaaagtacaggcccgtcaccgcgtagttcgacttcggacgcttgggtttctcctcgatggacacggccttcttgtccgcgtcgaactcgaccacgccgtaacgctccggatcgtccacgtagtagccgaacacggacgcgccctcaccgttctccgccttcgccttcgccttgcgcaacgtggcgcccagaccgttgccgtagaagatgttgtcgcccagcacgagcgcacacggctcacccgcgatgaactcctcgcccaacaggaacgcctgcgccagaccatccggggacggctgcaccacataggagaatttcacgccatactggctgccgtcgccaagcagtcgctcgaagttcggcaggtccttcggcgtggagatgataaggatgtcacggatgccggccatcatgagcacgctcagcggatagtagatcatcggcttgtcgtacaccggaagcagctgcttcgatgtcaccgtcgtcaacggatacagcctcgtacccgagccaccggcgagaatgatacctttcataaggacctgctttcttcacagtcgtaatcagctcacaccagcttagccaagacagtggcgaaacagaaaaccgcgcaggtcattctgcgcggttttcacactgacatcaggccgtcggaatgggctgacagacctttccggtttgtcctatctgtcctacttgccgagttccttgttcacgtatgcttcgagggtttcctcccagtcggcgggcgtgtagccggcggccttgatcttggacaggtcgagcgcggaatgctcgggacgcgggctgaccggcgccttcgcgttcgcgaagtactcggccgtgctgatcggcttgaccttctccccgttgccgttcgtcagttcgaacacgcgggacgcgatctgcgcccagttcctcaccgcgccggaaccggtcaagttgtacgtaccgtacggggcatgcgagtccagcaggtggaagatcgcctcggccatgtccttcgtgaacgtgaggcgcccgtactggtcgtccaccaccgtcacctgctccagctggtcgtccgggttcgcgacacggtccgacagcatcatcatcgtcttcacgaagttgcggccctcgccgatcacccagctggaacgcaggatgtagtgctccggcgcgttcgccaccgcgatgtcgcccgcagccttcgtctgcccgtacacgcccaacggcgcgaacgcctcatcctccgaatgcaggtccgcggtgccgtcgaacacgtagtcggagctcacatgcaccagcgtgatgtgatggtccttcgcgaccctcgcgagcagggccgggccctgcgcgttcgccttccacgccaccggacggccctccgcggtctccgccctgtccacggccgtgtacgcgcccgcgttgatgatcgtgccgtacaggctccaatcgtacttgtcgtacgcggtcggatcggagaagtcgaactcgtcgatgtccgtgtactcgaaaccacgcagaccatgcgcctccgcgtacgcgcggaccgcacggcccaactggccgttgcagcccgtcaccagcgtgcgcttcggctccatcggcttcgcatccctgagcatcggatgatgcaggtccgcctcggagcgttcggactcctccaacgggatcggccactcgatgcccagctccgggtccgcgaggttcacgaacgtgtacgtcttcttctgttccagcgaccaatgcgcgttcaccagatacgtgtacacggtcccgtcctgcaaggcctggaagctgttgcccacgccgcgaggcacgtagatcgccttggacgggtccaaacgggtcgtgtacacctggccgaagctctcgcccgggcgcaggtccacccacgcgccgaagatctcacccgccgcgatcgagatgtacttgtcccacggctccgcatggatgccgcgcgtcacgcccttcgtcgcgttgaagctgatgttgttctgcaccggaccgaaatccggcaggcccaacgcggtcatcttcgcccgctgccagttctccttgaaccagccacgattgtcaccatgtaccggcaggtcgaacaccaacaggcccgggatgttcgtctcctcgaccttcaagtccttctcgaattcgaacgacatacgttccctactttctatcttcagaatcgttttgccacgttgctatgcagcgtgcaggattaagcgttttcaaggcctcccctttatcggggaaagcccaattcgggcattcggggcccaaggcatcgaggatgaagaacatgtcgtatctcagtttcgcgaactcgacccgcagaaggttctcatcatgaccgatacggttgcggatggtacgaaccgatttgaggcggtccaccagttccttgcgcagcctgtcctcaaacgggtcgccgtcgttgccgggaagccttcccttcggcatacgacgcagttccgacgcccatgcatccgcgatgttggggaacgcgcccatgaggacatgggcgagttcagggtccttgccggaacgggacaacatgccatcccacgtgcccaacgtcaattgggagaacacgtcgtcgcgggtgatcgcatccccgtgccttggatgcgtctggtcggaacgccaatgccgttgcttgcgcaatgccgtgttccgggcctccgcgatatagtcgcgctcggggctgttgatcaaagcccgtatcctcccgatcggatcgcttttgccggcttcaagccagtccgggatgcccgttatctgctgcccggacacccattcgcaaagccggtaatcgattgcatttctgacgaatatctcgatatagccgatataaccgattgtgatggcggatgcctccacgttccagcggtacagcctcaccgccagatcaaccagccgttcccgatcgaccgtatccacatgccgtcttgcataatcgagatacacctggaaccgcgcgtcagcaagaaaacgactcgccatcacggcattgtccgcttgctttttcacattcatatgtgtatctttcatagtgctataggggccacaccttcgaggtgtggccattttcatattccgctcactgaccctgctgcttgtatttggcttcggtggcggccttggccggctcccaccaggcgcggttgtccgtgtaccacttgatggtctgctccaggcccttctggaagtccgtgtgcgtcggcttccagccgagctcggtctgcagcttggtggaatcgatcgcgtagcggcggtcgtggccgggacggtccttcacccagtcgaagtcgtccgggctcttgcccatcacggtcaggatgtcgcgcagcaccgtgatgttgttgcgttcgccgttcgcgccgatcagatacgtctcgcccaagcgtcccttggtcaggatggtccacacgcccgtggagtggtcgtccgtgtggatccagtcacgcacgttcaggccgttgccgtacagcttcgggcgcaggccctcgaggatgttcgtgatctgacgggggatgaacttctccacatgctggaaggggccgtagttgttcgagcagttggagatggtggcgcggatgccgaacgtgcggtgccaggcgcgcaccagcaggtcggagctcgccttagtggagctgtacgggctggacggatggtacggggtctgctccgtgaacttggccggatcatccagggccagatcgccgtacacctcgtccgtgctcacgtggtggtagcgcacgtcgtacttgcgggccgcctccagcaggcggaacgtgccctccacgttggtcttcaggaacggctccgggttcgcgatcgagttgtcgttgtgggattccgccgcgtagtgcacgatcgcgtcatggcccggcacgattttgtcgagcagctcgtcgtcgcagatgttgccgtgcacgaactccacgcggtcgcccaggatcggacggatgttctccaagttgcccgcatacgtcaacgcatccaacaccgtcacatgaacatcgggatgattgttgtacacgtaatgcacgaaattcgacccgatgaaaccacagccaccggtcacaatgatgttatgaggagtaaacacttcatcagccatacgggcaatcataccgtcgcggccgtacggccactgagaccccgggttctagatagaagtgcaacgcctgtctacggttggaagtgttcaggttcataaccgaagagaaagcgttgcactcatcatgaaagcttattcccacctgtcggcacaggaatatgtccggatcgacgagttgaggaaccgtgacgggctcggggtccgtcaaatcgccctgaggatcggccacgacaagtccgccgtcagccacgaatgcctctaccagtggatccacgtgaaaccgcagaaggcattggacctcaggcggtacctgccgcggggcaaacgacatcgcacgcgggcgaagggacgccggtcgaaggggccgcgcatcgggatgcgcgtgccgatcaccgaacgtcccaaacgcgtgggctcgcgccgcgagttcggccattatgagtccgacacggtcgtcggcgcgtccccgtcgagacggtgcgtcgacacgcaggtcgaacgcaagagccgccgcctgttcgccaggttcatcgacgacaagagcgcgctggccaccgcgcgccgaatacgacatccacaaggacatccccgcgccggcgaggatcgaccggacctgggacaacggcaccgaatcctcctgccacctgctcgtggacgaggcgctgggcatgctcacctatctcgcggacccgtactcctcccaccagcgcgggtcgaacgagaaccgcaacgggcgcatccccgctacctgcccaagaggaccggcttcgacgacctcacggacgcggacctgcaggccatcgtccaggagatcaacgacacccccatgaaggtcctggctgagaaacgcccaacgaggtttggtaccgcgaactcggcaaggtaatgtcgagggcaagccacccaaggacgagcgttgcacttacaaattgaatctggggacacttgcgccgcaggaatccatgtttaccgcttcgctccagtgactgagtcaaagtagtacaaccttccattgatgtattgagtaccatacagcatcttcccatcggcaccgtagtacaccgtcttaccgccattcgagttcagacgctgccagccggacttccgcgcaccagtcaccggatccaagtagtaccaagcgccatcaatatgctgctcgccatacagcataacgcccaatccctgctggtaatacacccacttgccgccgctcgatgacaaatacttccagccgtataccacttgcccattcgacgaagacgaatcgtcatcaaagaaataccaatgtcctctcacctgcgactcaccatgcaccattgctccgttcgcaccatagtaaacccatttgccgccgctaggctcgttcgtgatctttgtgcgtcgccaacccgataaacgcgcccccgtcatcgaatccaagaaatactgcttcccgtcgatagttttctcgccgtactgcatcttcccatcggcaccgtagtacaccgtcttaccgccattcgagttcagacgctgccagccctgcttgcgagcgccggtcaccggattcaggtaataccaagcaccattaatcttctgctcgccatacagcatgtacggcgcataatacacgttcctgtcatccggcaaaacgacccagccggtcatcctcgctccgctatcgggattcaggtaataccatttaccagcaatgttttgttcgccgtacagcattgcaccgtccgaaccatagtagacccacttattcgcaccgactttgagatatacccaacccgttgcgcgcgcgcctgtacccggattcaggtaataccatttaccgccaatttgctgctctccgtacagcatatgcccatcggaaagatcgtaatacacccacttgccgccgctcgacgaaagccgctgccaaccggtagcctttttgccggttgcagtatcgacgtagtaccactttccgtccttttccacctcaacatattgcgttacaggggtcttattaccgaacgcgttcatatccacgcggccggaaatgccgctgatggagccgccgctcgtgtactgccagccgcggtcgttggtggggaacgcggtgtactgcatggtggagccatactgcgccacccagcgggtcttgccgtggatgttgccgctgttgagcgcactgttcaggtagcttgtgtacgagtagacgctcagattgttgtaaccggccgcctgcagtttgccgtaccaggagttgacgatgccgtcgtacacgctcggactcgtcgggctcctatgccccgtgtacgtccagttctctagatcgtagaacaccgggtagctcaggtcgcccgggttcacgcccgcctggcgcagcaggttcaccacgtccgcgccctcggacgcaccgtcggccgcactttccgcatacgagaagacgtacacgccgaacgggatgccgagacgcttgcattcgctgatgttgcgcttcgcctgcgcgtcgaaaccattgccccagccgtagctcagacggatgatcgcgccctcgacgcccgcgttcttcaccgcctgccagtcaatcgtgttctgccacacggacacgtcgatcacgcccttcgcctgctgggcgaacaggttgttgcgcgcgtcgaagaacgcctgcgtaccgttgtacgtgccccagtgcgcaccgtactcattgttctgcaacgcggcgagcttcaccgacgcgttggtcgcgcgcgtcttcgaggagaccgcgttcacgtcaccgccgttcgcagcgaccttctccttcacatccgcggcactcaccggaatgaacgactcaccatccgtcttcgccaacggatcgggctgcttgctctccgtgcccacgatcttcggatcggtgaccgtctcgcccgtcttgatgtccttcaactcgccttccggcgtagccgcatattgctcggacaccaccgtcgcgtcatcggagatctcggcggacaccttgtccggcagctcggcatccggattgtccggcatcgcgtcggcagccgtctcatcggcgaccatcacaccgttcgcgaccggacgcgtcgcggaagtcgcggaccgcgcctgcgagcgcgcgtcggatgaggttccgtccgaggcggccgcggaggccgtcacggaggccgcggaccggacgccggacgcgtccgcgtcggcgttcacatccgcgagcgcgctggccggagtgacgcacaccgcgcccaacatcgccatcgccgcgacggacgccatcgccgcagtcacaccgcgcaccgcgccggatgccgttgcacgcgcacgcaacgcacgcagcatgcccgtcgcacccttcgcatccgcgccgtcgaaccgcttcttttccaccatgcgtaactccttgacgcacccatcccgcgcacccgcacaccgccacgcgttccgatggtcgaccggactctcacacgcgggaacaggcaggcgcaaacaggcgcaatcacaacgttttcaaccgtgctccagtctaatgagcaaggcggataagacagacggagcgaagcgggcaaaatcggcggagctccgccatacattccggcgacggcatcatcctatcttttgagaagatacttcctgtttctactgcgcggcggcgcagtggcgagaacgagtccacgtttaacgagccggctcaacgccttacgcgtcgtaggaaggcccctccccgagcgacggccgatttcgtggacatcaagtggcttatccgccgacaatacggacagtatcgcggattccgatgccgtaagacccttacggcccccactcggctcctcaccatcgaccttctccgctagtgcgtaccgatcagggccgatttcatcggccagcctcgcttggaccaatctatgcaaaatcaccctgatgtcgtcggaatccagatacagcgcgacatgcaactgcggaaccgtcatatcgccatgcctcttcaacaagagcaacgccatacgttcatgacgagtcaaggggacgcccacatgatcaagccagtcacggttctcctgctgctccacgccgtagcgtccaagaacgaccgtgaaccgatcgggagttgcgcggaacacaggttcccccagtgcacgggatttcatctcgcgaatcaccagagggatgccggagccaccgccttccacggtcacatcattcgcatcgtcatacggtatctgatgaagcagctgcatcaacgtcgcattgcggcagcatgacacgccgctgccgatcgtggccagcgtgaccccaccccataatccgccaggattcgacacctccacccgatcggggtagatgtccacggtcacggattctccgaggaattgcgcatcatattccctgtgaaccacggcattggcgacgacctcgcgcagcacctcctttggaatctcgctatcggtacgggctccgacccccacgacgaacgtgggagcccgcaggtttttggcgatggcctccaccgcctgttcgattgcctccggcatattgccgtcgcattgcacacgatccacgaaacgcggaccctcaaccgccgatttctcgacacccggatgtgcgacgacgtcaatgatcagcttgggatagtactgctgcgggtactgtccggcggccaacagtcccgcaagacgcacctctccaaccttgttcaccatattcaatctggtcatgcgctcaagacgagtatcagtcccgcgcaacgccttggaattacgatgctcggcaagcaccctgtccaccgcctcggcattcagatcggagacgtcggcttcagggacaaccatacgatccgcggaactgggcgtcagggcatgggtcatttcgaacacttcggttggcgacaatctcaaatccttgtcgtccatacggcggtacccaccggtttgcggccctctcgccgtaagatagcagggtttgtgctgaatgccgttttcatggatgtcgatgaccaggaacgacaagccgttctgctcgcatcgggaaacgtcatactccggaggattcgtcaaccgtgctccttgcggattgccatctcccataccatccatgaactgcgatgcaatatggttggcgtcgaatcccggaacaggcgagaaatccccgtcctcgctgattcccaacaacagcacgccgcccttggtgttggcgaacgcgctcacactctcccacacgctggtgccgatggtccgcgcacaggatttcgcctcgaaacgggcgtcatcgttgccttggacacgtagatgttccagcacctcggcgatatcgtcattcgtccacatcatcatcccccttgatcagcttatttgtcttacttgttgcgaccacatggatccaagcagtcgcctccaatcgaccccaaacccacgtctgaaatctcatgataacgtgaagataaatactctgtcatgagcttatcatgattgcatcatgataagctcatgacatcaagaaccggtttatgacaagcgacacgaatacgcatgccgaacagcaacaggaacctgaacgcaagcatcaacatgtaaatatcgaaattgaccgaaccgagaaaatcacgcacgacattacgcaaacagctaaactatctatagcacatgagcatgggccggaaccgggatgagacggcttcgaactgagtatgaggatgggaagatgatcttcgagacaaacacgcagaaagcgggcatcacgagcgccggtggcgatggttccggcgagcgcgccgaccgccgcgaccagccggtcgtgtattttgtgcttccctgctacaacgaggcggaagggctcgtgcacacggccgacgtgctggccgccaaagtcgcacatcttaccgaaaccggacggatcagcaaacaaagccgcatcctgttcgtcgacgacggttccaaagacgacacctggagcatcatccgcaatctgcacgaacgcgacgcacacttgttcggcggcgtaaagctctcccacaaccgtggccatcagaacgcgctcctcgccgggctcatgaccgcgcgcgcctacggctgtgacgccgccatctccatggacgccgacctgcaggacgatgtgaacgcggtcgacgagttcatcgacggattctgcaacggcaacgagattgtctacggagtgcgttccgcacgcaagaaggacacatggttcaagcgcaccaccgccgaagccttctacaaggtgttcgagtggatgggtgccgagacggtacccgatcacgccgattaccgtctcatgagccgcgagacgctcgacgcgctcagcgaataccacgaagtcaacctgttcctgcgtggcatcgtgcccacactcggctaccagaccagcaaagtctactacgagcgcggcgaacgcgaggcgggcgaatccaaatacccgttgaagaagatgatcgccttcgcgattcagggcatcacctcgttctccacgaagccgctgagcttcgtcaccggcgccggactgctgtctatcctggtagcgattggcatgttcgtgtacgtgctcgtctcgctcgggttcggccacgccatcgccggctgggggtccatgatgatctccatctggctcatcggcggactcatcatgctctccctcggcatcgtcggcgaatacgtcggcaagatttatatggaatccaaacatcgcccccgttaccgcatcgaaaccacgctgtaggagggaccggcggccagcgtgacggcccctcctacagtgcttggattgtatctattttgtcctcatcatacgagtcaacgcgtatagcaatgccccttgcttgaggcgaaaatgagaccgtcgccgttctcctgccttgttataacgaagaggtgaccatcggcaaggtggtgcgcgacttccgtgcggcgctgcccgacgcggccatctacgtgtacgacaacaactccaccgaccgcacggccgaaatcgccgccgcgcccgacatagtcgccaaggtgctcgaaggctatgacatggtgatcggcgaccgcctctcatccacttatttccaagagaacaagcgcccgttccacaacttcggcaaccgacttgtgcgcggctccatcaaccacctgttccgcgcgcacgtcaccgacatcatgaccggataccgcgcgttcagcttcaccttcgtcaaaacctaccccgtgctctcgcgcggcttcgaggtcgagaccgagatgaccatccactcgctgaacaacaacctgcgactctacgagatgccaatccagtaccgtgaccgccccgaaggctcagtgtccaagctggacaccgtaggtgacggcatcaaggtcatgagcaccatcttccgcatgatccgcgaatacaagccccttcccttcttcggagggttgggcctgatcattggcatcgtcggcatcgtgctgtgcggcacagttaccttcgaattcgccaaaaccggcgtggtcacgcacttccccacgctgatcggcgcggtgatgctggtcatcacggggcttctgttcatcatcgccggtattatcctggatgtcatggccaagaatgaccgcaagaccttcgtcattgacaccaacaaaatcgcatacaacaagaggcactgacagcgacgtactaaaagatggggcgcaaccgtgagtcgcaccccatcttttagtgtcagcccaaaccgcaaaatatgaaggtgggcaaatcatttacctggtatctgccatgctttcttgaacgtcaacaatgacacccccactcatcttcagctggttcgaccacacactcaatacgcgcaccaacctcaagcgcataatcggtatccgtccacatacgacaagccgattgaatcgatataccgttctccctcccctaccattaagcatcctttcggagtccctcattatccttttccagccacaggtaccacaaatctctcataccttggataagcaaggatatttcccctctgatttggcacgcatcaaaatgcctttccagtgggaggattcgcgcatgctgtacgggctacagatgattgacatggctcttttcatgtgtggacgtgcgagcggcatcgatagcgccaagaaattaaatgacggagacaaagccgtgctaaaaatcgttgatgttattcgccctccatcataaatgtggacacgggttcaaggcttctcatcagatgaagtcatgctcatcaaacctacttacgcaacatccaacgccgggcattagtaccgttgctggaatagagctgaacgttggcaccattaatggtggaaccgttctccaaatcatacgtctaggacccttccagaactgccttcaaatatcgctcaatcaccaccaacacctcatatatatagtgggacatatgtctgatgcttccgatgcctctgatgctgtttctactccttcgaccgtgttctcacgagtggcggcgagcgctgcgtggaagcggctgaaccgtttgatgccggccttggcatgtcgaaattcacgttcaccccgcttctgctgctgggattcctggctttgataccgtggcatagcgccgtatccgaatctacagccgtaccttccgcagcagacgctgcacgggcttaagcaccacggtatcggctatcaccgcgaataccagcgccgccagcaacgtagcgccaaacatcagcacactgatacccgcatacgaccatccgttcgtcggcgtgggcatcctcgggccaatcagcaccttggacagcggcgagtgcaccaagtaaatcgtgtaggaatatccggcaagccaaataatcgccttacgcaaccgtgctgacgtaatgtgcacgtcgtagcggaaaaacaggaacaccgtcatcaccactatcgcaaaggcaaccgtaagcgtgcggccgacctgaacctgctgaccggtgaacagatgcggcgtggcgacggtccaggccaaggcgaatggtgccaacgcatacaaaccataccgtgcgcgtgcggaaggtgggtagtattccagcacaaagcccagcagatagtaaaccagcagtccacgccatgggaatgactgcaagaacaccagcggatatccggcaagattacagatttgttcggcagcggccacggcggcggccagcccgaccagcaaccaggcgcccgatcggcctatcgtacgcatcatcgcggccaggaacggcgttgccagcacgaaaccggcgagcatgaacacgaaccaatagacggaatcgtcatacccggagaacagatcgaacaacgttccagacacagcgccgccaaccgaacgatgatcaatcaccaggtaggcgacgaatcccatgccacccgcatacagcagatacggcacaatcagcgagacaaagcgtttgtagtagtagcgcgcgtacggcgcgaggctgctgggatcggcttggcccgcaccgccgcctgcccgggcatcagagccagagcccggcagacggcccgctgagtgggtgctcaccggccggtcggcatcgaatgtcaggttgaaccggcccgataccataatgaacagcggattgcagaccatgaacagcgcgaacagcacggatcgcgtcacttccgcgctgccggcgagggtcatcttgacgggcatgtagttgttgatcacgtggacgccgatgaccaggcacatcgccaccacgcgcagcagatcgtagttcacgtcgcgcggcttgccggcgacgccggaaacggaatcgggcatggtcatcacatggatcccgccagggacttcagatcgaccgggcagctgatctgactcttcaacttgtccaaggcgtccaggccggccgagggatcggaggacgcgtccttatgcgcgtcgttcttgccgccgtccgcgccgccgttcgcgccatcggcaccgttcgcaccatcggcgccgttcgtatcggccgggcactcatcggtcacattaccgttggagcccgtctcgacgccatccgcattcaccaccggcgtggttaccacgttcagtggatgtgtggcatcgctgctgacccgaacggtataagcaatcgtcaattcttttccgggctcgatccactgctggttgaacataatgtactgacggtcatacaggctcgcggtgttggtaccccatgaatctatatcagcctgcacagcggtgatctcgccaccgtacggagcggtaagcaccacgcggtacaacatgccgccgagcactggattctccgagccgccattaacgaaatcaggcaacgattcggccttagccttagtcagcgtgttcttcatggtgaaggtgaccgtgtattcgtcaccgagctgatcttccgtaaactgacccagatgcgtgttacgcacggctgtcgtgatgcgcttatccagcacgccagaatacagggcgttctggctggctgaggcgtcgccgcaggtttttgtgaccgtggtggaggtcttcagataccaatcctgcttgccttgctgcagctccgaaagatagatgccggcttcgggcacctgactgtcagcagacaactcgccactggccttatcgtcgataagtccggtggcaatcagcgcctcctgctcatccggatcagccatccatagcttgaaatgaccgctagcgctggtatctctaattgccttcaacagcggggatgcggtagaggcattcgcgttgccaagcacatggttcataattgcttgagccgcttcggaaacgaagttgttctgctgctcgaagtccgggtaatccgtgtacaggtctgaagcgaagaacggcaccgtggtggtgctatccagcactcggccgtccgaaagtttgacctcgcctgtggctcccagcaatgcctggagaaatacgggatcgagtgacaatacacccgctacgttctcgtcttcgttgcctttctgatacagccacatgtatttgttcatctgtgccacacgctggaattcggggtcgatggtcgtggtggccgggtactggtcaaaagtgccaccaaatacctggcgctccttcagcaccgtatcatccattggctcctcaggaatgtcccaaccagaagtggtggcgaaatcaccgatggtaatcgtgcccttatctgccgtgattgcggcgatggtgcctaccatgccgcccgccgaacgtagctcggccgggttctgcaccatcaccaaatacgtgcgcttgccgtcctcgccaagcagttgcggtagcaagttaatgaggccatcgtattcgccgatcatcgaatccacggtcttgagcgcagccttttcggtttcgagcacggtggccaccttggcgacgctcggagtcggcaccttgttgagcttggtgagctgctgcgagatatccttatgcgcctgcttgacgatatccggcatatccatcagggcgctgacgtccaccgagccattcttcagggagaagccctgcaatcgtttggacaggttcagcagatcagtgaacggaccgttgaccagcgtatccacggaagccagcatttcgcgggcggcggtgatgtcgcttccgaatcgcgaatggtcgcggaagaagtcccactgtgggccgttcagctccgcattgagatcattggtggcattgaccagctcttgggagatgtccgacagactcttatcgctgccacagccaagtgccgaattggccagactttcggcggatgtcagcacgcgctgcgcatccgtggccattctcgagacggatgccgcgtagagcgtgcccacacaggtgacgctggccagcaacgtcagcagcagtacaaccaccactcgcgcccatatcggcgtacggctgatcagcgaacggccgttaccacccacgtgctggggagtcttcaggtttacgggacccgtctgctgattcacagcgctattcgtagatgcggagcgattgaattttccgttaccggcatgacgtcttctcctacgccccacagccttatggctcgaatgccctgaagtgaatcgcatacttaccctgcccgaaaatctgctcagctcatactcttatccagcggcgcgaggccacgcttccggatgccggactccgggcaaatccggaatcgcagacatgccggagcacacgtgacgccacgcatatctcatgccagtgtaccgatgccaccgaaatagaccgaggatttatcccatactgggtgcaaatccccgcatgaccaccacatcgctgtcagaatgttctcagacttcattgaggggtataacagtattgcgcaagaaaacggtcactaaacgcaacaatagttagagccgtattgatttgttcggcttaggagaacgggagaggtaattacatgttcgtcctcagcaacgcctggcgggccctgacacgttctaaaggacgtacggccctgaccgcgttcatcaccttggcggtcaccttcggcacagtcgccggactggccatcattcaagaagataccaacgcacacaccaccgcgtacgatcagcagaaggccacgttggccattcgcccgactgcggctacgtggaagaaggtctccgctacggactcggcttccaccaagcattacatgacgtggacctcatacaccgaatacgccacgctcgtccagtcggccaccaactcgttgaacttcacggttaccgaaaccgtgccggcccgcgtgagcggtgatttgaaggccctggacggcggatcgctgggctcggcctccgatgacgagaccggcggccagctcatttggcgagccttctggaccaaggattccgccaaggccagcgacctcggcaccttcgaaatcgtggacggcaaggacctgagctacaacaaccagtcctccaacccgaacaccaccggcgcactggtctctgaagcgtttgcctccgccaacaacctgaaggtgggcgatacgctcgaggtggcggccgcctcggacgccaagaccacggccaaactcaaggtgcgcggcatctacaagtacacatccgaatccgccgtcgccaatccggtgacggccgcccgcaaccgcgagaacgcgatcttcaccaactatcagaccttcgccaaggccggactcgacccacagtccaccgacaagaccgtctccggctgggcagtcccggatctggacgtggtgttcgacgccggtgattccgctacatacaagtccttggtatccaccctcaagaagtccaagctgcccgccaagggttacgagttctcttccccctcgctggaatcctacaacgcttctctggagccgctggatacgctatcctcgcgcgcgaagaccggcaccattgtgttggttgccgtgggcggcgtgctgttgctcatcctcgtgctgtcgggcgtgtgggcgtccaagcgtgacgacgagatcggcatggcactggtgtccggcgtcactcgcgggcgtttgggatggcagttcatgctggaagtgttcatcgtcaccctgcccttctacgtgattggtctggtcggaggcgcgttcgccgccaagccgatcggacctgctctggcatccggccatgccatcccggtgacatcggacctgatttggaccatggtctggtatggactgggttcaatcctgatcctggcgattcttgccgccctgcgccttgcgttcttcagcgcgaacaaactgttcgccgccgatggcgactggggcaccgtgagcgagaccaacaagacgaccaccacaaccgacgatgcggaggcacaggcatgagcgacaggaacaacgatcaggaactcgagaagaccactgacgcaacggctgacgaagtgacttctgagactgagacgaacgacaccattgaatccgttccagctgactccgtgcagttcagcgtgaccttcgatgacgttgatgacgaaggcactgttgacgatggtatttacagcgcactggcatctgccgaaaccggagaaaccgacgagaccagcgaggccgaagcagacgccatcgcttcggtcaacgcatccgccgaagtgaccgagcgcaatgccgcccgcgtcaacgaaacactccgactggccaaaaccgatcacaaagacgcattggccgagcatgcggagcctcagggcaaagcgtccgaacccaccatgacgctggcctcgcgtatcgatcgcgtgttggtgggcggcggttccgacgacattctgctcaagacctacccgacctttgccctgaacaaggtgacggtcgccggccccaagggcaaggtcaacatcctcgatggcgcgaatttcttctgctattccggacacgcatacgcgctgctgatcagcgacgaccccgattcgggcatcaccgccgacgccaaacgtcgcgcgctgatgggcgtgatgagcggtttggccacgccggcgtctggcacggtgatgaacaagagcgccaacattgttgagctcgagcccgtggaactgcgcggccaccgtctgggcatcgtaccgcagctgcacgccgtgcagccgaagctcgacgccgaacaaaacgtgctgtacgccatgaatgcgtccaaccgcaacttcctgaagcccaagccggtgatcgcccgcgaactgctggccaaggtcggcttctctgaggccaccagcggcgtggctgtcggcacattgcctttggtgcagcagcgtttggtggccatcgcccgtgcaatcagcaccgaggccgaggtgctgatcctcgacgagccgacacgagggctgaacgcggatgacgaggtgaccgtgttcgccgcgctggccaagctggcgcacaccggtgacccgaagcactgcgttatcgtgctcactgcgtcgcgcgagatcgccgaagcagccgacacactcttcgaaatctgatgttcagaccatagagccccctgtgattcgtattgccgaatcgcaggggtttttcaatgctgcggctcattgccgcgctaatctgaggataaatctgaccgtacgaggcgaaacctgataattatgaccggatatattcccacactggagcagatcgacgagttgcaccgcaaaatcgcgccgtccaaggcggcgtacgagctggtgcacacgcattgcgtgattgtagcgaccatcggctgccagatcgtgcgccggcagaacgcgctgttcacgcgccgctgcacattaccgaaggacgcggaggtaccgcccaccgcaggcgtcaccggcggccatgtgccgccgcgtctgctcgacgagcatttggtactcatcggcggactgctgcatgacatcggcacctaccgcgtgttcaagcatgacggctctgacggcgaaccgctcaaattcagcaagaaacgctacattctgcacggtcttaagggctacgagtatctgctcgacgagggcgtggacgagtccatcgcccagttctgccgcaaccataccggcgtgggacttacgcgcgaggatgtggtgcgccaggagctgccgttgccaccagccgactatgtgccgatgaatctcgagcaggaagtggtgatgtacgccgacaagttccatagcaagtcagtgccgccgaagttcctgcaggtcgaggcgtatacggcccgagccgagcgatttggcggagagaacaaacagcgatggctggatctggtagccaagtatggcgtgccggatattccggcgttggcggagaagtatgggatgcggatgatttgaggctctaggggtctcccccaagtcagcctgtcggctgacagccccctcgtcagagggggcttatgaaggtatttcagatggaacggagacggtaggtgccgttgcggttggagacgatgatcatctggtcgttctccagcacgttccagccttcctgcttgtagccggaagaggagaccacgacaccggcggagtcgccgttgtcgtcgcgcagctcacggtagcgcatcacacggtagtcggcggcctgctcgccacggccgtactcatcgtagatttccacgatgcgcgggctggtcttctcacgaccggcggcgcacagggcgatgagctggtcctcggactgaatcatgcagttgtagctggacttcgggtaggcttggcgcagttcgcgcacggcctgggccacggcctcgtcgagcgagaagccgaagccgatgtattccagaatcaccgcgaagaagatggcggagtcggaacggccgccggtggagaggaacacgctgtggttcaccgggtatgagcggttggtgacgatgttgcggccattggcgtccgagatatcgccgttgtggatgaagctcaggccgttcgcatagaacgggtgctggttctccatgatgagcggcagattggaacttgccaagcgcaggtgccagatggcaccgcgagacggttcgtcggccagcgcctcaaacgtgctgtcatgacgggccgcgatggtcgacttgtagattcgggtgccggtttccggggtgggtgcgccaccgtcgcgcacgtgcggtgcttcggcaggatcggaaagctgggctacaccccagccatcattgtggatttcagacagttcacggaaatcctcgacattgtcttgccccaacacagcgttgagactcaggttgaagcctgccgtcgcgtatcccagtaatctgcacatggtatttcaacttaccgaaaccgtgtggcgacgtgcggcgaccgttataggcattctttatagagcgcatcagcgccgctgcaaactggtatgttatcgcttctgtttggcggagcgctgaggcttggcggcggatttgccgttctcggccttgcccttatcgcccttatcgccctgctcagcgggcgcatcggcggcagcggcctcagcggtcttccgcgcctcggccgatacggcggcatcgagctcctgtaccaatcgcccaagcccggacgtggtgtccatcgggtcagggacggcggccgggtcggccactgcacgagtcggcgtgggcgtcgggatggtcttggccgtatcggtgcgcttcagacgcggtgggcggcgggtggagacgaacagcggctgcacctcgaccaacgggttgtaaggtgccagaccgaaccacttaaccggcgagccggccatgtggcggattgcgtacttggcttgcaacgacagggcaccgcgtgcggaaaccttggattccggcatcagggccttgtgaatcagcacgtaacggatggtgccgatgtccggatcggcgtcgaccttggggtaaatcgacttctgcttaggcagttcgccggttttggacaggtcgtgcatgatctggtggatgtacgccgggatggactgcgaaaccttgaatcccagacggaagcgcacgcggtagatgtagttcgtgccgaagtcctccaccgagtattcacgggtgaacggctcgtcggtggtttccacgctgactgcccaccaagcacgggcgcgcttggggtggtcggcgaagatggagaagaagatgtccgtgtcgagtcgcttggtctccgagtcggaggtcaggtacacgatgttgtccgcaaaatacgggatgcggaaatcactgtgcagcttgtcgagcgcgggtaggaagtcgttgggccgcatgtgacggcgttgcgcacgttcgagcttggtgccctcattccacgtgtacatgacgaacagaatcgcggcggtcagcaacatggtgaaccaaccaccatgcaggaatttggccatagacgcgatgaagaacatagcctgaatcgccaagaacagcacggtgaacacgatggcaccgacccgcttgccggaatgccataggtggacgccgagcaacacggtggtggtgatcatcgtaatggtcaacgccagtccatatgcggcagagatgtgttccgaatccttgaagatggcgagtacggccagcgtggagatgcacagcacgccgttgaccaccggaatgtacagctggccacgcgtgcgggccgggtaccgcacctgcagatgaggcatccaattgaggcgggtggcttcggagaccatggtgaacgcgccggtaatcagggcctgggaagcgatcacgccggccgaaacagacagaatcacggccagataacgtacgttcggagacatcatctggaagaacgggttgagtgactccatcgcagtgtattgcgggttatcgctattggccagcatccacgcgccttggccgaagtagttgagcaccagcgcaaccttgatgaatggccaagtgaagtagatgttgccgcgccccacgtggcccatgtcggagtacagcgcctcggcaccggtggtcgagaggaacacggtgcccataagggcgatgccggcagcattgttcgggctgaacaggaatttgatgccgtacaccgggttcagggcctcgaacacagaccagtcgttagagagattcgtgacgcccacgatggcgaggaagccgaaccagaccagcaccatcgagccgaatactttgccgatgctttcggtgccgcgcgactgcacggagaagagaatcacgatgatcacgacggtgatcatcagggtcaggcttgggttttcgtcgaacaacccttccaatggcggcagggtctgcaagccttcgactgcggaactgatggaaaccgccggggtaagtaccgaatccgcgaggaatgccgcgccgccgagcatggcgggaatcgcgagccatgcgccgtacttgcgaatcaacgagtacagtgcgaagatgccgccttcgccattgttgtcgatgcgcatggcgatgagcacatatttgacggtagtgatcagcgtaatcgaccagaagaccagcgacagcatgccgagcacggcctctcggtctacgctgccaagccctccctgaccggcaaggaaggtctgcgcggtgtacaagggcgaggtgccgatgtcgccgtacaccacgccgagcgccacgattgccatgccccaggtgaccttgtctgggctggattgcaggcgggcccaccatcgaccgaggccgcctttcgaccatgcgctggcgattttctcggcttctttggtttcagcttccctctgcttggcgagtgcctcgcgctcctccttggtgagagtgcggcgggacaccttgggagcgttggtaaaggtgtcggccctcagcagtgcttcttcttcctgtcgggccttggctttggcggcaccagactgggctttctgggcctttgaggctttttgggcacgtgcggtcctttggttcgactcagccatacgttcagtcctccattgaggtggagatcatcccctcgcttatgtcaaacacatcatgatagacctcgttcacaattctgacaaattttacaagtcaacacatcgtctctacacgcgccgcgacggccgcacacccggccctcacagtccgtatacggcgcgggcggtatcgcgggtgccgcgcgccacatccgcgatgggcaagtcgagcgtatcggccatggcccgcaaggtgtagggaatcatgtacggcgcgttggtgcggccacgatacggcatgggcgtcagatacggcgcgtcggtttcgaccatcgcatggtccagccccacaatccgtagcgattcgcggataccgtcattgcctttgtagctcacggtgccggagaagctcagataccagccatgttcgcgcgcgatctcggccatctcacggtcgccggaatacgagtggaatacggtgcgttcgggcgcgccgtcggccagcagggtttcgatgacctcgcgatgggagtcgcggtcgtgaatctgcatgggcaggcccagttccttggccagggcaatatgcgcgcggaaagcctcgcgctgcagttccttggcaccttcgccggtgcggaagaggtccatgccggtctcgccgatagccaccacttgctcggggtatgtggtggcgaggcgatgtacttcggcgagcgcgtcctcgaaagacgtgtcatggtaaggcttgtatttgaggggcagaccatccggccccggcacaccgcgatgcccgtggagcacggactcattggggtgtattgcgagcgccgcgtgcacattacccggatgatcgagggccatctggacggcggtcatcaggtgcggcagctcgcaaccgcagtcgataataccccaatgccgacagattgcgcctgcgccagcaattggtcgacgtcgtacaccgggacttcgggctgtcccttctcctgcgcctcatggctcatagcgcgcgcgaaagggattacggaggccacgtgagtgtggttgtcgatggtctgggcatcgtccggcaatgcttcaggtgccggagcccagctacggtcgcgatggtggtgcttgctcatggtttctcagtgtaggctgtttctcagtgtaggctaccgccagcaacgctcgtaaggcagtccggtaagacgttcgactacacgacgggtatcgtcggtcacgcccgcctgaacttgccgtttcttgccacgagcgcaacattcccgggagagtagcgcaaccggcaagcgagacggtcgccatcctgccgcctttttctgcatcatcagcccattttctgcctcattttgataaaatatgatgcagaaaagttcgtatgatgcagaaaatgaggcagtatgagatcatttgactacatcgaatcaggtaagacgttgctcaccccgcacaccacgagtttgcttgccgctattcacgaggcaaaagggcgtcaaagcatacagacaacgatcagaccggatatattggggacgctggttgccgtcgcgcgcatccaaagcacagatgcctcaaaccgcatcgaaggtatttctaccagcgatagcaggctcaacgatctcgtctcggagaaagtcacaccgcgcaatcgcaatgaagaagaaattgccggttaccgtgacgcgctatcggttattcacgaaagccacgactatattccgattaccccgaacgtcattcttcaactgcaccgcgacctcttccgacacacaccactgacctttgcggggcatttcaaggacagtgacaacgtcatcatcgaacgagatgcacacgggaccagcaccgtgcgattcgccccaccgtccgcacttgtcacaccggaactgatcgaacgcgcgtgttccgcctacacgcaagcaatccgagatggacataccgatccattgcttgccatcgccatgttcattctcgatttcacctgcatacatccgttcaatgacggcaacggccgcatgagtcggctactcacgctcctgatgttgtaccgcaatggctatatggtcggcaaatacatcagtatcgaacaccttatcgagcaaagtaaacgcacttattatgaggcgatgaccgcaagcacccaaggatgggacgacaacgccaatgattatgcgccattcacgaactacctgcttggcatcatactgtccgcgtgcaaggaattcgacgaacgcatcaatctcgcggcaggcggcagagcgcagggagcaccgcgagtagccaccaagggaacgcggattgaagcactgcttgatcaatccctagtgccactctccaaggccgatattctcgctcgcatgcccgataccagcaccaccaccattgagcgcacgctgaaatcactgttggactccggtacgatcatcaaaatcggtgctggtcgcagcacccgctatgtgaaacgccgctaaacgcatccttgtgcgcaacatctcgtcactcttccggcgctccgctggccacgcgaatcatcgcgtactgggactcgtagaggcggtagtacgcgcccttggcggcgagcagctgcgcgtgcgagccgtgctcgacgatctggccgtgatcgatgtagaagatctcgtccgcgttctcgatcgtcgacaggcggtgcgcgatgatgaagctcgtgcgccccttgagcagatgctgcaggccggcctgcagcgcctcctcggtgcgcgtgtcgatgttgctcgtcgcctcgtccaggatcaggatacgcgggtcggcgagcagcacgcgcgcgaaggcgatgagctggcgctggccggccgacagggtcgatccgcgctcctccaccaccgtgtcgtacccgtcgggcagttccatgatgaactcgtgcgcgtgcacggccttcgccgccgcctcgatttcctcgtcggtggcgtcgagcttgccgtagcggatgttctcgcgcacgttgccggagaagatgaaggtgtcctgcagcatcacgcccatctgccggcgcagcgatgcgagcgtcacgtcgcgcacgtcgtagccgtcgatcgtcaccgagccctcggacacgtcgtagaagcgcgacagcaggttgatgatcgtcgtcttgccggcgcccgtcgggccgaccagcgcgattgtgcgccccggttcgacgtggaagtccacgaggttgaggatgttgcggccgtccttctcgtagcggaacaccacgtcgttgaagtcgacgcgcccgcggatctgcggcaggtccgccgcgtcgggcttgttgcggatctccggcgtgacgtcgagcgtctcgaagatgcgctcgaggtacgccgagcaggtgatgagctggttgtagaagttgccgatgttgatcaccggattccagaagttgttcgcgtagccgacgaacgcgatgagcacgccggtggtcacgttcacgccccgaagcccatcacgccgacgaagtagatgaacgagatggtcatcacggagatggtctgcacgcccggccacatgaggaactggatgtgcacggcgtgcatccacgcggaacgcacctcgccctgctgttcctggaaggtcctgaactgggcctgctcctgtgcgaaggtctgcgtggtcttcacgccggcgatcgactcgtggatgtaggcgttcaggttgctctgcttgttggagagcttctggaaggcgcgccgctggaagatctgcagcacgcgcacccagatgatgagcaccgggaacaggatcaggctccacagggccagctgccagtcgatcacgaacatcacgatcagcgtgatcacgaaggtgaacacgtcggagatcacgttgatcagaccggagctcagcgtgtccgaaagcgtgttcacatagttgaccacgcggatcaggatcttgccgtgcgggcgcgaatcgaagtagctgaagggcagcgtctggatatgcgtgaagatatcgcggcgcatgtccttgagcatgagctggccgacgcgcgtgatcgccaccgtgcggtagcgcagcccgaactcgtacagcacgatcagcgcggcgaggatcacggcgaggatgccgagcttgccgaggtccttgttcgggatcgcctcgtcgatcatgatcttggtcaggtacggcacggcgacgacgatgcagctcatcgagatgacgacgacgagaatgcgcgccacctgtgccatatacggtttgagatatttgccgacgcgcaggatgtcccggaagttgatctgctcctcgagttcctcatcctcgcggtatgtattgcgttgtgccataagtcctcttctaaaaaccttgtgcgacgccggactggagtccgagctgcttgtggtagatgtcccagtagcggccgtgtgcggccacgagttcggcgtgggtgccgcgttcgacgatacgtccgtgctcgagcaccagaatcaggtcggaatccttgaccgacgagatgcggtgggcgatggcgacgatggtcttgccgccgtccatctccttgaggtgcttctggatctccgcctcggtctccatatcgacggccgaggtcgtatcgtccataatcaggatcgacggattgtccgcgagcgcgcgggccagcgacaggcgctgcttctgcccgccggacaggcccacgccgcgttcgcccacgacggtgtcataaccctgtggcatcgacctgatgaaattgtccgcgccggcgatctgggccattttctggatatatcggtcgtcgctatcaccgctggcaccaaaaccgatgttgccgccgatggtgtcggagaacaggaaggtatcctgcgccacgatgcacacctgcgagcgcaaggtggccagcggccagtcgcgtgcgtcgatgccgtcgatgagcacatggccaacggtcgggtcgtagaagcgggagatgaggctgacgagcgtggacttgcccgcgccggtttcgccgaggatgccgagcttggagccggcgggcacggtgaagtcgaggtccttgaggatcggggtctccgggtcgtccgggaaggcgaagctgacgtggtcgaagcggatgtcgcccttgatgtgcagcgggcaggacttgcgttcggtggactgctgggcaccggatgttccggaagccacgggcgctccggtagccccggtagcctcatcatcgtgcttgacttgctcgacgatcgtgaccgcctgcttgacggtttcgaccgcgtcgggcttctccacgatgcgcggctgttcggtgagcagcttgcggattttgatgcagctggcgttgaatcgctgccagtcgttgatcagccagccggactggcgcaccgggccgtcgatcatccacaggaaggagttgaaactcaccagattgccgagggtcatgtagcccttgatgaccagaaagccgccgaggccgagggtgatgagctgcagcgagaagccgaggccgtccagccacggcatgtacttgcgcgagttgtaggccaaggccatgttgcactgcatgtaatcgtcgttgtgctcgtcgaacttttcggtctcgtacggttcgcgcacgaatgccttgaccacacggttgccctcgatgttctcttcgaccatggagttgagggaggccagcgagttgcggatggcgaagaacagcgggtgggcgtgcgtggacaggccgcgcgtgagcacaaaaatgaacggcgtgacgcaggccaggacgagcgcgagtcgccaatcgatggcgaacatcacgcacagggcgcccacgaacatgaccacgcagtcggcaatctgatagctcacccaactcaggcagtggcggatcgcgtcggtgtcggaggtcaggcggctcatgatgtcgccggtgcgtgtgtggttgaaatacgtgaagtcgagctcgtgcagcttctcgtattcgtcggagacgaggcggtagaccgagttctggccgaaacgctccatccacatctggtagccgtatcgcgcgcccacgcggatgatggtcatgaggatcatcagtccacacagacgtggcagttcgtcggcatgtccgccgacgatgacgcggtccacgatgataccggacagaatcggaatggtcagggccatcgtgttatttgcgatgaacagtagaagcgcgcctaccacgcggggcaggtctggtttgcagtatggcagcacccatttgagattgcttgcgctggtattgattcccggatcgacgtacatgtgaggagatcaccgtttcttggggattgtttgcttgtggtatggtgcggcatgctcctgcgccgcacgcggcaatcgctgccgccgcgattcacgatcagccgtgcttcgcactgcgcctgtcattggccgcatgaccgaagctctccttcatcggtcgaagcacgttcgactttcgcaaacgcgtactagtctagacggcctgcgtctaatcgcaacggcccgcaactctgcgtgttccccgcattagcggcgatacgcggctctctaagcgcaacattccccggaatgcgtcgctgcacacctccgaacaggtccaattcgcaacgcattcccgggaaagtggcgcatgtcatatcacgctcaaacaacccagcatagtgagtggttcattcacgttttacgtattgtgcgacggaatcggcatctcccgcaacacgtgagatatgcaaaagtgccgcacgctgaatggtgatcagcgtgcggcactgcgcgaaacgcgtgaaatccgcagaacgcacgaaactcacgaaacagataaaacgtacaaaacgcaagcaaggcgaagcaacgaacagacagagacagtccacctacaggtcagaacgccagcgaacgcacgtaggaaccaacttgcgggcggaacagctaccggggattgttcgtttgcgatgttcgcattcatggcaggtttctccatacgattcgggcggtcggttcaggaggttggttggcggaggcaggttcggtttcagcgtcggtccagggccacccagagcacgccgtgcggcggaatcgtgccggtgatgacgcggtcggcacccacgccttcaagacgcacgtcggcgggctcgcccggcgcgtcggcatacagatcggcgagtgtccaatcgtcattgcgggcgtcaagccccacgatggattggagctggatgttgcggccgatctcgtatgtgtcgctgccggtccagaacagcgcggcgtaatggccgccgtgatgcgcggaacgtgtgccatcggcccaatcggctgcgtcggcggaccagacgatgaactcgccacggcaggtgctctcatcccaccatttgccaaaaatccgttcgcgcacggtctcgcggttattggtggagccggcaagcacctcacgcaacgcgggattctgcagcagcgcgatggcgtcgctgttgctggtgggcagatcgccgccgaccataagcgggctacgccccatgcaccatagggccagcagtgtcttctgctcgtccagcgtaaggcgggattggcggtcgtcgccgcgttcggcgcgcaggcctatgtgcccgaacggcaccatgtcggcgtcggcccagtggccggtggtctggaacggcgcccagcgggccaggcgggcgaactgctggtagatgtcttcccaacggtcccacagatcgtcggaaatacgccacatttgggcgttctcgcgcaggaagtcgacgtagctcgtcgccacccagccgccgggcgagagagacaggtcaatcgaacggccgtatttggcttcggctttggcgatggcgcgatgataggcggcgatttcgtcggagtggaacggggtctgcatgtcgtcgaccttgaggaagtcgaggccccaggaggcgaacaggtcgagctgcgcgtcataccaggcctgcgcgcccgggtgggattggttcaggccgtagttgtccggattccacttgcacacgtggtcgaggtcggccacgtccttggcggtgtagttggtgccgtatacgggcaggttcttgtccacggcgatacgcgggatgccgcgcatcatgtgcatgccaagcttcaagcccagttcgtggacggcggcggcgagcgggccgaatcccttgccgccggcagcactcgggaaacgcaccgggtcaggcagctgacggccgtattcgtcgagaatcagcggcgcgttgtcgttgtaaccatgtgcgcgggcggtcgggtcgtaccagtcgatgtcgatgaccagcgtatcccagccggcgtttttcaggtgttcagccatgaaccgcgcgttggccagcagctcgtcttcggtgagggtcgtgccataggaatcccagctgttccagcccatcggcggacgccatgcctgaggaaggctctgcggaagatccgtcatcgtatcctgctttcgttgatattcgcataagttgccctacggcggtatgccagccgcaaaccaatcggcatcgcgcacgtacggataggtgaagagtgacgccactccccggagagtcccatcccaacgtacgacgaacttcatggcctcttggcacaccgacgtatgtaccgttacatattcttccaccggaacgatatcaagcaagcgcatgttacgctcggcgcgtcatcgcctaagcgcagcattttcagcgattccggcacacagccaccatttgccaaaacacgatgttgtgaataccgttacaaccattggaagcattacgggcatgatccaatgcccatcacaggcgaaacatgaggtgacgttatgccgagcggcaaaccaacattgcgcgacgtagcgaaagccgccggggtctcccccatgaccgcctcgaatgcgctgcacggcaagccgggtgttaaggattccacgcgcgccaaagtgctggcagtggccgaaaagcttgattaccgcatcaatctgacggccagcatgctgaagtccggccgcagcaacatcatccacatcatcgtcaacgaattcgattcgccgttctactccaaactcgtcgaatcgctcgtcaccgaaaccaccgagcgcgggctgacgccgttcgtggagcaaacccggtactctccggatgccgccaaacacgcgctggccaacaacccgttctccgggcagttgttcgacggcgagattatccacgcttcgggcctgaatgccggtgtgccgctttccgcgatcaaccacggccgaccgctggttctgattgacgcctgcgaggaaacgcccacgttcgatacagtgaatttcccgaacgaggacggtgcgcgggcggcagtgcagcatctcatcgaatgcggatgccaccgcatcgccatcgtcggcgacgggtattcgccacgaaccgaactggcgcacgtggaaagttccagcggtttgcgcctgcgcggggccagcggcgcgttgctcgatgccgggctgccgtatgacgaatcgacgaacttcattggttacggtagcgacagcggcatcgaagccggtcatgccatcgccgaggcgatgctcgaggctcgtgcgcaatcggctgatgacactgctgagtcccgttccccgggcaccacgcgggcaacgggaagcaccccggccatcgatggcatcttctgcattaacgactatgccgcattcggagtaatccgaggccttgccgactacggcatccgcgtgcccgacgatgtgagagtcatcggcttcgacggcgccacggccggctcgtacaccacaccgacgctgagcaccgtccaagtggatctcgatcagctcgcccaattcgcgcttgatatgatcacccgccgcgtggagcagcgcgaccagggcgacggcaggtccgacgaatccgctggcatgccggccacgcgcgccaccattggatacacactggttccgcgcgagtccactgtcggttcggcaaacaggtaacgctgaaacgccgaaatagggcggcgattcccgactgccgcgcccactgcccaagtgccgtgcagcgtgacgtgcgaggtttcggcatgcgtcaaaccgttcccagcgctcccacgtggtagtggcgcccatgcgcacttttcctagggttaggaccatgaccttccctaatcacacggtgttgtagaggcgggcggggaaagcgtcgcggtattggccgggggtcaggccagtgcggcgcttgaagacgcgcatgaagtacttgggatcggcgtagcccacttctcgcgcaatatccgccacgctggaagcggtagaactcagcagttcgcgcgcacggtcgatgcgatattcgatgatctgctcggccacacccacgccgaacacgcgccggtacatcgcggtcagatagctgggtgaatagtggaagcgcgcggccactttggccacggtgatgtcgtcgaaggcattggccataatccacgagcggatggccagcatcggcgccaggccggacgaatcgccagcggcaccggccgaatcgacatgcatggcccattcctgttgctgccggacgcggtcggcactggtgatgggcttgccgtcgccccggtagccggcgagcgtacgatgggtggcgaagtccgccttcagccgctcctgcgcgctgacctccagcagcaggccggtggcgaagtaatcgcagtaagcgttggaatacgggccgaatcgcgcatagatgtcgatgagctgcccacacatcaccgccagccggtcggggtcaggcagggtgcgttcatcgggcagcagcaggcaatggtcatcctgcggcagacccgcgtcatcggggagcatgcgcgcatccggcaatttgaaatgcatccagtagaagtccacgtcagacgtgatgatgtcggcgcccgcatgctccacattcggcggcaagagtgcgatttggccggcctcgatatgcagggtctgctcccccacccgcatcggcaggacgccccgacgcacgaacatcagctcgaaggtgtcgatggtgcgccgcagatggcgccagcccggtccggacacaaactgcccgaccgagtaaaagtccaccggcccttcgagccgacatgtcgtgatgcccatggctaccagagtagccgagagcaaatatcagccgcgcagccagacggtcatttcgttttcgccgcggttggcccaggcgaagtacgggatgagcgtggcggtggcgggctcgcgcttgaccggcgcgtacacggcgtagagcggtgcgaacgccggaacctcggccgcgccctcacccgcggcggccacagcagccggcaacggctcgcgccaagccggcacctcaagcttcaccatgcggcgggtcacatcttccacctcgccctggcccttgtcgtcgatgcccttggcgccggcgtggaagtcgaactcctcgaccttggccacgctcggatcggccagcagtgcctccgtatccgcgtgcagcaggtgcaggttcgcaccattatccttttcttcagcgcagaaagtaatcgggccgcgcacgaacgccaccttgccggcgtcctcgcgcaccagcgggttggcggccagcatacgtaccggcatcgggaagtcgaacgtcacggtgtcgccgtcgcgccattcgccggtcaggtacaggtagccgtcgcggatttcgcgggtcacgcgggaactatcggccccagactcagactcgcccgtggccgtaatcgcggcggcagcagcggactcatcgcccacccaaccgggcagacggaaggccagcgtaaagcgagcaggagcctgagccgaggtgccagcagcgtcaccgcccaagcgcacgacagccttgccatcgccctgccacggcaggttcgccgtaacatccagctccacagccgtaccattcaactcagctttggccacgccgcccatatacaagtgcgtgaacagcgtaccgccatcctcggcaaccgtgtaggcatattcctgcaccgactcaacgatgcgggcgatgttcggcgggcagcatgcgcagccgaaccacttctgacgcaccggcttgacgtggcgcaggcggctgtctttatggcaggcatacggattgacttccagcgggttcacgtagaagaagctcttgccgtccagcgccatgccggccagcgtggtgttgtacagcgccgactccataacgtccgcgtactcggcctttggcgcgagctcgagcatgcgacgggcgaagaacgccagcgaaatcgcggcgcaggtctcagagtaggcggagtcgttgggcaggtcgtagttgtaggagaatgcctcgccgtccaccgtgccgccgatgccgccggtaacgtacagtttcttatcgacgatattgcgccagagccgctcggccgcatcggcgaggtcctggtcgtcggccagtcgggccacgtccgccagaccggagtagaagtagccggcgcgcacggcatggcctacggcttcgtcttgttcggtgaccggcttgttcgcctggtgataggcgtaccggttggggtccgtgttgggtttgtagttggcgtcggcgtcgcgctttgcgttctcgtctgcctgaatatcgaagatgtacggctgccggccgcgctcggtcacgaaatattcggccagatcaaggtaccgctgttcgccggtgacctcgtacagcctcaccaaagccatctcggcaatctcgtgaccggggtaaccacgcagctggcccggcttgcgaccgaagcgctcgtctacgtaatcggcgaaacggcaggcggccttgagcaacttgtctttgccggtgccctggtagtaggccaccgcaccttcaacgaggtggccgaggcagtacagttcgtgatggtcacgcagattggtgaacgcgcgatccatgtcgttcagaatgtagcaggtgtccagatagccgttgtcgagttgggcggcacacacgacgtcgatggcttggtcggcggtctgttccagtgcggggtccgggtaatgggcgagggaatagccgactgcctccacccacttggagaagtcggtgtcttggaacacgaagccgtagaacttgtctgggtcgggattggccgggtcttcggggagcgcctcaaatccgcggaacgtgtacttcggcggcacgaacgccttgccctgggtatccttacgcttgttttgcgcggcagcggccttgaagttgtgcatgcagtagctgggggccgcgccggggacgttatcgttcagggcgttccactgatagggaatcacagccgtgcgcacgagttcctgctcggtgcgccagaacgaatcggtgacggtgacgtttttcagggccagcggcttgctatgcagcgaagtcatgacgtactcctttggactatgcgacattcgtcaacaatatgtatcggtacatatgatacgtgcgcccgcgcgagcagcaaggtggacaaatcgttggcggggtggaatcgccggcgcatatccgcccgtacgatttcgcccggtgaatcgcccgacgaatacacggcgacttatactaccgacggaccacaaacgtcgcctacatgaatggaagatcaatcatcatgacagcaaacgccagcgcacgggccatcaaacccgaacttctgcgtacgtacaccgaagacttcaacaaagaccgcgccaacctgatcgcggcggacgcggcggtttcggccggcgtgctcaaggcggccaccgactatcgcggcgtacgtgcgctgccgcgcgacttctccatcgaactcaagcagggttcgatcaccaatcaggagcgttccggccgttgctggatgttcgcctccctgaacacgctgcgttacgaactcatgcatcgctggaatcttgaggatttcgagttctccgagacctacctgttcttctgggacgcgatggagaagtcgaacacttatctggagaacgtgctgcgcacgctcgacgaggcgaccgattcgcgtctgttcgaggccatcaatgagtcgcctgcagacgatggtggctggtggcagatgttcgccgcactggtgaacaagtacggcctagtgcccaagagcgcctatccggagtccgagaactcccgcaattccgacgatttcaagcagtacctcaactccaagctgcgcgagttcgcggccgagctgcgccgccgttcggctgccggggcgtctgaggacgagctgcgtgcgttgaaggacgagtacatgggcaccgtgtaccgcatctgcgccgtggcgctcggcgaaccgccggagaagttcgacttcttcgcgcgccccaaggatgatgatgaggataagaagggcgaggctcgcaagtgcaaggccgaggccgacgcagacggcaaggccgaatcctgcaagtgcggcgaatcctgcaagtgcgagggcaaatccgacgccaaggcctgcaagtgcgataaggacaagtccgacaagccgaaaaccggcaaggacgagcgcccgcagattcgcgagatcggcatcaccccgcttgagttctacaagaagtacgtgccggtggacgtcaacgatttcgtgacgctggccaacgccccgctcaagaaccgcccgttcaaccagcgctaccgcatccgcttcagcgcgaacgtggccgaggctggcgatatggaattcgtcaacgtgccgctggacgtgttcaagaaggccgcgcttgaccagctcaccgccggccacccgatctggttcgcctgcgactgcacgcagttcgccctgcgcaaggacggtttcttcgaccagtccgtggtgcgcgtcgaccagctgttcggcaccgaattcaccggcgacaaggcccacggcctcgaatacggcgacagcccgagcaaccacgctatgaccttcaccggcgtgaacctcgacgaggacggcaagccgaaccgctggaaggtggagaacagctggggcaaggacgccggcaaggacggctactacgtcatgtccgacgcctggttcgaccgctacgttaccgagctcatcatccgcaaggaatacctcgacgacgccacccgcgccctgctcaccaccgaaccagtcgagctcgatccctggcagcccctcacccgtcgctgccgctgacatattccgcccattggccgcggctgaagtgctcctatgttttgccgacttctcacagagtgagcaaaacataggagcactttagttatccacagagttatccacatcctcagcaagctagaaccacataccccgtttttcatggcgaacaagcgaccgctacgctacggtggcgttatgaacagcggatttcccaccccgccacccggcgtattcgacgatgaaccacccggctggaccaacaatgccgcggcaccgagtgctgcgtccacgcacgccgtcaagcccgagccatactcaccaccgcgtatggcaacccccactgcgcccgctatgagcgaagccctcacccaacgtaagcgggaaatgcttaaacgatgcacggacgccgcgcaacagctcggaaagccggtgctcttcggcatgaccacatcgctgatactgcaatccgtgccgcttcccaaggattgcgatctcaatgccaccgagctccataccgtctctgactcgcatcgcacccggatacgcgccgtcgttccgccaacaacaccgcacatctggaaaccgctaagcgccgcgcacaatgcacgtatcaacaagcatgtgcacgcgctgaatctggtacatacttgggcgcagctcgccgctcacatgtcattggaatcattggtcatacttggcgacgcaacccttacggcaatagcgcgcaagccgagcctatcgggcggccgcaccgccgacgaaatttatcaggactttgtgcggcaggtcagcgaacttccgaaattcaacgcgaaagccacatgcatgatcgcacttgaatttattgcaccgcgcgtggattctccgatggaatcagagacccgtatcacaaccacgcaatacgggcttccacgagccgtgacaaattacacagtgcccggcgcgacgttcagcaatggtgagccgataacactcgatctcgcttggcccgaattccgcgtcgccatcgaatatgacggcgatcatcatcgcacagacaaggcccagtggcggcgagacaacgacaagcgcgaactgttacggcatcatcattggatcgtcctcatcgccaccgccgcgaatatggctgatgaaccgtctcaagccgaactcgcctaccgagccgggcgacagctggcgttgcgaggtgccatattcgatttcaccttgacagcgacgccgctcaatgaacttgcccggcggaaacgacggaaatccaccggggcgcactgagctgacatcgatacgattgcgcgcgcttgctgcaacgcatatgccattcatcgcaccccatttggtcgcgtggccccgaccgcatggcactgttgtgtgtcacacgccatgttacgtccggcgaatccgcacatcatctgcgttgcgtactgccatattatgcggttcgcgatatacgtcacggtgtccgatgtcctggtaacgacgtcaatcgatttatgtgtgtaccgggccagattttgttgtcccggttctccatttcgcctctttttgagcaaccgggacagaaacaccctcgaaaaatcgccaattcggccctaccgcacaatatccgccatcacacatcggcggaattccgggcttctggatttgcatacattgagcgctcacgggatggtctgtcccggttccccaaaagaggccaaaatcacgaaccgggacaacgaaatctggcccggttcgcacgtcaatcggttgccgtcaccaccgggacaccgactgcgcatagataagatgcttcaatgcttaacaggcatgcgaccataccgcgatagcaacgtttcgctggaagtagaggaatcaagcagcaccccccaaaccggaagcatggagggaatcctgcaatgctccgaatcaccgcgccccgtgcttggtgtggcggatcacggcttcgagcggcgtggatgtagctggacagcagcgtaacttgcgttgcatgatgcggcccaaaacgaagaaacccggcggaggggccgccgggtgagagagaagagagaagaagggttcagttatggggttcggaagaacctcgccaccggtatgaacttcattccgttgacatcttctatataaccgtctctttcttggggattcgatgtgcttgtctgggaaaagtcttggcaaactgtgacgggcttgtaacgccgcccgacaaccggcctcgctctgtcggggcttggccgcacatacggcaacaggccaccccgcagcacttcatgtgcgaggtggcccgtcagctacgagctagcaatgccgaatcactcggcggcgagcttggccttctcggcggccagacgttcggcttcggcggcacggcgagcagccaacgcttcatcgaagcgagccagctcctcttccacggcctcggtcggaatcttggcgaagatcggtgcgggcttaggcaccatggcgccgacctcgattgcctcgctcttccacgggtgcacgttcacaccgagctcgtaatcgccggtgataatcgggtacgtgaagccgggcttgtcgagatcctcgacttccttgagctcaggcagcggcgagaaggtgccggtgccgccgagcgcctcccacaccttctgtgcggagtgcggcaggaacggcgcgagcaggtggttcgcgtcagacacggcctgagcggccacgtgcagcacggtgccgagacgagcctggtcgtccttaatcttccacggttcggtggcggaaatgtacttgttgatgtcgccgaccacacgcatcgcctcggacagggcgtgcttctggtggtgggtttcgatggaggagccgaccacgtcgaacgcggcggaactctcttccagaaggccacggtcttcgttggtcatcgaatcctcgtccagcggcggaatctcgccgaagttcttgttgatgaggttggccacgcggttcaccaggttgccccacgaggaggcgagctcctcgttgttgtggcgcacgaactcggcccacgtgaagtcggaatccgaggattcggggccggccacggaaatgtagtagcgcacggcgtccacggggtagcgggcgaggatgtccttgacgtagatcacgatgccgcgggaggagctgaacttcttgccttccatggtcatgaactcgctggccaccacctgctcaggcaggttgagcggacccatcgggccggtttcgccgcccttggagcccttgccgttgtacgccagcatttcggacggccagatctgggagtggaaggtgatgttgtcctttcccatgaagtagtaggccgggcagctcgggtcgttccaccattcgcgccacttctccgggtcgccctggcggcgggcccattcgatggaggccgacaggtagccgatcacggcgtcgaaccacacgtacagcttcttgttcgggttgtcaatccagcccttcaccggcaccgggataccccagtcgatgtcacgggtgatggcgcgcggcttgacttccttgaacaggccgagcgagaagttgatgacgttggtacgccagcccttgcgggtctccagccatgccttgttggcttcggcgagcgccggcaggtcgaggaagtagtgctcggtctgctcgaagcgcggggtttcgccgttaatcttggagacggggttgatgagctcgtccgggtcgagctcgttgccgcaggcgtcgcactggtcgccacgcgcaccttcggcgtggcaaatcgggcactcgccctcgatgtagcggtcgggcagagtgcggccggtggacgggctaatcgccacctgctgggtgcccttgtagatgtagccgttctccaagcactgcttgaacatctcctgcaccacgtgctcgtggttaccggtggtggtgcgggtgaacaggtcgtagctcaggccgaggtcgcacagatccttggcgatcacgcggttgtaacggttggccagttcctgggcagtgagaccttccttctccgcctcgacgagaatcggggtgccgtgctcgtcggtgccggacaccatgagcacatcattgcccttcatgcgctcgtagcgcgcgtagacgtcggagggcacaccaaatcccgcgacgtggccgatatgacgggggccgtttgcatacggccaagcaacattcaccaaaacatgactcataaggcttgattatccggcgcggcggggacacgcccggatagctgccgcgccgccatcctcatcccactcacctatccacccgcaacttccccacatacttatccgtacacctcttgcgcgcttatccacatacgcattcgcacacgtatccgcgcacccatccgtacgcacgcccacgcacatccgcacacacttccgcctgccaatatccaccgagttatccacatcatttgcgcacctagtaaagttatgcacttatccaccgttttcgcctatccggtggcgcgcaagccgcatttctgcatattgttcggtcatggatatcacagcaggtccgatgacggacatcacaacagtcgcctcgccggcaaccgcgcaacctgcggtgccgccgatactgtttaccaaggatctgccgggaccgctcagccttaaccgtctggccgccttcggcacgttacataagctcgacgattccgccggctactggatcgagcattcgggcacactgtatggtcgcgcgaaaatcgtcgcggaggtcgccccgtttggcactgtggtgtgttcgatgaccgccgcttgggtatggctgggaggccccgactttccgagtaccatagacgtgatttccacatcgcacttccgctcggcatccgtcagccgccgtatccgcgtattcaaaagattgacgttgccggagcaaatcatcaagctcggcgggctgcctgtcaccacgccagcccgtacggcttgcgacctggtgatgagtcctgaagacatccccgatccttccaccgtcaacgcactggtgtgccagctgatgtccgcgtaccagtttcggccaaacgactgtctgcaaatcgtcaaggagcatcggcatcacaagtacgccggacgcgcacgcatgttttttgaatcggtgcagcaggagatggacgaaccggctttggagcaatgcgcatgacgagggggttcattgtcagaggccatcgcagaggccgccatgccgctcaccgtttacggcatttgcggcaggcgcaacggttgcctcgccacgcggcggcggcacactcatccgaatccgcatcgcgcgcaatctcggatatgaccgcgccgcctgaaccgcccatcagacttacgcccgcggtggcatgttcgcccgatacggatgttgccgtgctctggcacatcgcatatcacgtgcccgaactgcgtaaatggctggttgccaatcccaaagccgacgcgcctttgctggaattggtctcgcagcgtggtgggcccggggtccggcaggcgttggaaatattgttcgagtcgatggaagcgtaacggggagataatcgccggctgctgcgctatcccttgattttcagcacagccgcatacacctgcttgcgattggccaacgatccgtcagccagtggatgctcctgcaccacttgcgcgatggcgtccttgatacgcaggccgtcctccaaagcacggtcgatggagagcacggccatgtcatccacgctcaacgtgctgggcgcggccgcttcggcctcctcgttggacgcgccgccgatgaccagcaccatctcgccacggggcggatcatcaatcacactttggcgaatctcgtcaatcgggccgcgacgaatctgctcataatccttggtgagttcgcggcacagggccatcgggcgattcgggccgaacgcgtccagcagatcgtccatcgaatcggcaatgcgatgaggcgtctcgtagaacacgatggtgcggcgttcgggcaacagcgtgcgcagatactgcacgcgctcggaatgctttcgcggtaggaagccttcgtagcagaagcggtcggtgggcaggccggagagggcgagcgcatcgagcacagcggaggggccgggcgcgcaggtgacgggcagaccgcgttcaatggcacggcgcacgatggccaagccggggtcgttgatggtgggcatgccggcgtcggatacgacgagcacggtggcgccggtttcgacctggtcgagcaggccgtcggccttgtcgcgctcattgtggtcgtgataggcgatgacgcgaccgttcacatagacgccgaggcgacgggcgagatcgtagaggcggcgcgtgtcttcggcggccacgatatcggcccgttccaagagggccaccagacgggctgaagcgtcgccgacattgccgatcggggtggcggcgagcaccacggtgccggcggggatggtcacggccgattcgcgggattgggcgacggcggattcgccggcatgaacttcatcattgcgttcaggcacttgcgtcacgctaccgtcagcgtcatactgctcattcaactcatctgcgcttgtcatactcccagtattgcccatgccacagagcaatccacgacaatccatggcgaaatcgaggcattctccctttgcaggggctgatttcacatgttccggaggtctacttccgtttcaaggggctcctcatccggtgaagcaccgatacaaacggctttgacgcaacgctattccgccattttggcggcgtatctacttgaccatcagcccctcgaaacgcaagtagacctccggcaaaccccaaatcagccccttgaaacgcgagatggcagaatttcaacgaaaacaaatgaaaagaccctctgcggtggaatgaatgcagagggtctcgtggagctgacggtagtcgaaaccgcgacctcttcgatgcgaacgaagcgctctaccaactgagctacagccccttggatgttactttgctccgcaaagcaactcgcaacaatatagtacggagtacggtcaaacgcaatttgacgccgaagtgtcgcacgcgtgtcgacacggtaacgtttcggtgtcgcagacggggcaagtcacccacaccgctccgtatggataccgcggcggcacccggcaacgccatcacgtctccagcacgcccaacaccttcttctcgttgtagaacgcgaacacgatgccgcccaagccgcacagcacggccgcgcacacggcggcgatgcggtagcccgcgccggacgccatgccgatggtggagacgccggtgaacagcagcatggccacggactggcccatcttcatcgcaaaggtgcgggccgcgtagaacatgccctgacggtcctggccggtggtcttggaactggcgtcggcgatattcgccacgatggcctgcggcaggatgccgaacgcggccatcggaatcgcgccgaccaccgagagcaccaaaccctgggccatcgccggaatgaagccgagcacggccgaaccaagggcgccggcaaatgcgaacgcacaggtgaagatcacgaaggcaaccagcagcagcctcttcttgccgaccttattggccagaatattgaccggcagatagaacagcacagagacgccggtcatgagcacgaagtagatggtcgtggtggtttccggcagcttgagcaggctggtcacgaagaacggcagaccggtctggaaggtggtgatggccacccagtagaccacgtcggagcatacgaacttgcggaattcgccgtcgccgaacgtctgcttcagggattcgatggtcgattcggaggtgggctgggagttgacgtagtccttctcgcggatggccagcggcggcaccagcatgcacacgaacgccacggcggccatgatggtgaaggtcacgcggatggcggtgatgcggcccatcatcggcacgaacgcgccccaaatcaccggcgccacgtacgcgatggccgtgccggccacccaagtgaaggagatggcggtggagatggtgagttgctgcttggagtcgtggccgagttcggcgatgagcgcgttgtacggcgtgcagtagaacgtgagggcgatgtagtagccgatcacggtgacgaacaggaacgccgcgttcacccagctggtgccgttgatcgggctccagaacacgagcacggtgaccaccgcgagcggcagggcggcaaatttcaggaacggcatacgtcgtccggatttggcgtcgcaacggtcggagagggacgccacggccgggtccacgaaggcgtcgaagaatcgggcgaaggcggtgatgccgcccaccacggtcacgatgccgagcacaaccaggccttgcggcacgaacacggtctggccttgggagatggcctcctggtcgggctgatagaaatacacgagccagttggagataatgccggaaagcagtgcccagccgaactggccgaccgcaaacgcccacactttggcgatggggagatctctgatggctgacttcgccggtgcaacttgcgcacccgttacacttgctgtagtcgtattgcccattctcacaacctccgaatcaacattgacacagtgtcaaaatccagtatacaccggcacaccatgcgttctacgatagtgggcatgacaagtctgaccgagcaactgccatacgtatacgcttttcctgatgcgttggggaccggattactggtgcacaccgagagcgtattggacgatgagatacgcgatcgtattggctcgttcatccatgaatatgaggttgtattatctcgattccgcgatgattccatcgtcggccggatgcgcacggccgcacatggcggcacgttcgattttcccgactgggcatcgggtctgtttggcctgtacgaccgcctgcttgcggcaaccgatggggcgatcgacccgtgcgtgggcgaggatttgattcggcttggctacgacgagtcgtattcgtttgcggctacgcccgatgccgccgaacatgcaggcgcgatccacggacgagccgtttggtcagccgacgttgagcggcacggcaccacacttatcacccacagcccagtcgcgctcgatttcggtgcgtgcggtaaggggtatttggtggatttgcttgcggggatgttgggtgatggcgcgggccaccctcaacccattcaatacgtcatcgacgccgggggtgatttgctagtgcacacggacgaaccaatcaccatcgcccttgaagatcctgccgatccggccaacgccgtaggcgcggtcgaaatcagccaaggtgcattctgcgcgagctcccccagccgccgccactggtctgacgccgcaggtcaccaacttcaccatctgctcaacgccatcgacggactaccggttgacgatgtagccgccacatgggtggccgtcacgccgccatcgagcaccataaccacgaagacatcgacgcatggcagcaatgcctcgacaacggcaaaccgcgataccgacgattcgtcgaacaccgttgcagcacacgtccctgtcacactggccgacggactcgccacagccctgttcactacctcggccgcccagttacgcgctcacttcgatttcgaatgcgccatcctcaacgccaatcgtgccgccgcacaatcccccaattttccgggcggttttttcacacactaatgtacgaaatcatcagtatcacatccagtggagcattccctcgggtggaccgatgggttgctcccctcagtcagctacgctgacagctcccctcggagaggggagccgagtatagctaatccgctaatccgctaacgcaggaaacaatccgtcagtcagcgagcgcgaactggctgttgtagaggtcggcgtaaaaaccgcccgccgccagcagttcgtcgtgcgtgccgcgctcgatcacgtcgccgtggttcatgacgaggatcatgtcggcgtcgcgaatcgtggagaggcgatgcgcgatcacaaagctcgtacggcccacggtcagcgcatccatggccttctgaatcagctcttcagtacgggtatcgaccgaggaggtggcctcgtcgagaatcagaatcggcgcgtcctgcaccatcgcgcgggcgatggtcagcagctgcttctggccctgggagagcgacgacttgtcgtcgagcacggtgtcatagccgtccggcagcgagcggatgaagtggtcgaggcccacggccttgcacgcatcctcgatctgcttgtcggtcacgccgggcttggagtaggcgatgttctcgcgcacagtgccgcggaacacccacgtatcctgcagcaccatggagaactggtcgtgcacgttccagcgcggcacggacttggtgtccacgccgtcgatcgcgatcgagccgccggaaatctcatagaagcgcatgagcaggttgaccatggtggtcttgccggcaccggtcgggccgacgatggcaaccttctgcccggccttgacggaggcggagaagtcgtggatgatcggcttgcccggttcgtagccgaactgtacgtggctgaattccacgtcgcccttcacttcgtggccgttggtcccaagcaaagcggacttgccggattcgtcctccatctccggctcctcaaggaagccgaacacgcgttcggcggccgccgcgcaacgctgcaggttctggaaggcctgggcgaactgcgccaacggctgggtgaacaggcggacatacatcatgaacgccacgatcacgccgaactcgatctgcccgtcgagcgcgagcgccgcgcccaccacgcacaccaccacgtagccgaagttgcccacgaaattcatgagcggcatcatcaggccggagaggaactgcgacttccagccggactcgtagaggtccgagttgtacttctcgaagcgacgaatcgaatcggcctcgccgttgtatgccttgacgatgaggtgaccggcgtacatctcctccacgtggccgttgacgtcacccagcgccatctgctgccgggcgaagtacttctgggaggacttcatgatggccatcatgatgatcaggccgatgaggctggcaccgatggcgcacagggtcatgatcacgttgttgtagaacatcatcaccagcgcgcccacgaacagcgtcaccgaggtaatcagcgagccgagcgactggcccagcgtctggccgatggcgtccacatcgttggttatgcgcgacagcacgtcgccgtagctaaccttgtcgaagtatttgagcggcagtttgttgattttgaccgagatggactcgcgcagtcgctgggcggtgcgctgggtgacgttggccatcatccagctttgcacgtagccgagcacggcgtagcccacgtacagggccaccaaagtccaggcgatgtggcccaccgtgccgaaatctaccgagttcatcaccggtctgccgttaacgatggcgggcagacctttgacgatctcgttggtcatgtccttgagcttgtccgggccgacgatctggcagacggtgccggccgcgcccaggatgagcgcgatgatgatgacgggaagatagttgcggcagtagttcacgagtttgcccatgactttgccgaaatcatggggcttttcgacggcacgcctgccgcccattggtcctcttggcatttgttttactccttaaaagtccgtattgacctccctctgatgagggaggtggcgcgaagcgccggagggagagaagccgtacgcgactacccctcagtcagctgtgctgttttattcgctcgcttatcagctcgtcttcgcctgggaacagcccactgggctgttccctttacggctcagcccctgacatggggagctaccgctgccgcccccctatgccgtaagctccgactggctgagctgggattcggcgatctggcggtatacgtcgcagttgtcgagcagttccttgtgcgtgccctgacccacgaccttgccgtcgtcgagcacgacgatgcggtcggcgttcatgatggtgccgatgcgctgggccacgatgagcttggtggaatccttggcctcgcgggcgagcgcgtcgcgcacttcgcggtcggtcttgaagtcgagcgcggagaacgagtcgtcgaaaatcaggatttccgggtgacggtacaccgcgcgcgcaatcgacaggcgctgcttctggccgccggacacgttcgatccgccttgggcgatcgcggcggaatacccgccgtccatgcgcgccacgaactcgctggcctgcgccacgtcggcggcggccttgacgcgattcagctgctcggccggtatatcggcaccttccgcggcctcgccagcggcgatcaacgcggcctcgcgcttgcgcccggccggggtggaggtatcggccatctcgacctccgccgggtcgcccggctgatcgccgtagctcacgttggaggccacggtgcccttgaacagcacggactgctgcggcacgtagccgatcttgtcgcgcagggccttcaggtcgtagtcgcgcacgtccacgccgtcgaccaacacctggccttggctggtgtcatagaagcgcggcacgagattgataagagacgacttgccggagccggtggagccgatgaacgccaccgtctggccctgctcggcggtgaagttgatgccttccagcatcgcctcgcgcgaatccgggtaggtgaagctgacgttgcggaattccacggtgcccctctggccggttttggccacgtcggcggcggttttggtgccgttctcgacgattggctcagtgtcgagtacctccatgatgcgctgcgcggacacgtcggcgcgcggccagagcacgaacaccatgctcatgagcaggaagctcatgatgacctgcacggagtagttggagaacaccaccatgttggagaacacggtgagcttgtccttgagcccggcggcatcgatcaggtaggtaccgatccagtagacggcaagcatcagaccgttcatgatggtgttcatcagcggcatcatgaacgccatgacgcggttggtgaacagctgggtgtcggtgaggtccttgttggccttggtgaatttggcttcctggtagtcctcggcgttgtaggcgcgcaccacacgcaggccggtgaggttctcgcgggccacgaggttgatgttgtcggtcagggcctgcatggccttgaatttcggcatgaccatggccatcatgatgacgatggccgccagcagaatcactacggcgattccggtggcgagcgtccattcgaagccttcgccggcgatcttgcacacggcccatactgccataatcggcgatttgacgatgagctgcagacccatggtgatgaacatctgcacctgcgtgacgtcgttggtggagcgggtgatgaggctggcggtggagaacttgctcatttcggccgggccgaaggactcgaccttgcggaattcgagcgagcgcagacgctgggtgaacgaggccgccacgcgcgcagcgatgtagccggtgatgatggcacacgccgcggatccgagcgagatgagcagcatcttgccgccggcaatccaaatgtccttcatgtggctgcccggcgtttcgaccagcgtggtgatgtctgacatatagtcgggcagtttcaggtcgaagtagacctgcccgacgatggtcaccagagcgatgagcatctgaccgatctccgctttggagaggtatttcatgatgcgaagcattggtttccccttgtgttggttgggttggttattggttattgacgattggttcttaagttggctgggttatcggcgattatcggttcacgatgtcttaatagtttctattgtttgattacttacactgtgagatattacgcgcacttctgcatgttcgctgtgagcgtcctcaattagccttgccgattagttctccgcgcgcttagctgccatgtgttcagccacgcgcttgccccgctccacgaatgcctcacgcacctgttcagcagtcggccgaggctgtcccggatggcaaatcgacatatatgtggtgaactcagacaccaggtcaacgaattcgcgcgtgcgccgctcccccatttgcgagaaaatccagcaaatcgcggaacgcatttcctctatcatccgatgagactgctcgcgcccggaatcagtaagattcacgcgaatgatgcgccgatctttggggtcaatgtcacgcgtgacccagcccttcttctccagagacgacagcacggtggagatacgtccggagcttgcttgcagcgccgatgccaattgcgatggcgtttgcgtccccttcatggacagctcccggagcacgaactgctcaccatgggctccacgagtgaattccctctgcattgtcgaacgattgccccacacgctggcatacagttcactaactgcttcctgctcaaatcccataagagcaccatccattcccattcgccacacggcagagcaccgcaaacaccccaagaatatctcacaccgtaaacaattcattactagaaactatttttggaacgcataatgcacacactccacgctctttgatattctgaaagccgcatagatattcacttcggggcgtcgtctaagaatatttgctgggccaacggtagcgacgttggcattgtgctccatgaggtatctggtcgaaaaggcggacgaagacagaccagttgggcggagcgcgcccatacctcaaaaccattgcaattattggctttgaccattttcgtggagtcacgaaaatggtcatgaaaaacataaggacacacccatgaaccgcgacgaaatcacacgcaaaaccagcgaactcagcactatcgcacacaccaccgaggactccaaagttgagtattggtatgcacgcgagctaatgacctatatggggtacgacagatgggaaaacttcagcaaagctattacacgagccaagcaagcttgcgacaattccggcgtatccgttgaatcccatttccgtgacactacgcgagacgtgactctcggcagcggtgccacccgctccatcgcggacgtcaagctcacccgatacgcctgctatctcattgctcaaaacggtgatccaaagaaagaagaagtggcacttctccagagctattttgccgttcagactcgcaaaacggaaatcattgagcaacgcatgggagaaatcagccggctcgccggccgagaggcccttgccactgcagagaagaaactctatccgtatacccaaatcacacacaacaaaaccgcacaagagcacatgtacacgcccaaccacgccgcagaacgccggcaaggatgtgatacaggccacagaaagcgttgtaccgcccaggcaatgcaacaattgtccgctatgctctgaaggcagatggcggcacggatgccatcccaaagagggggtatgaccatgattcggggtatgaacctatgcagcatcgccggctgcacgcacgaagcagaagaagcgggcatgtgcaacatgcatttcacatcagcgctggttcacggagcgctgcactacactgcgggcggacgtccgtcgcactgctgagcgcaacaacaaagcaaaacaaccagtaacgctcaacggcttccacatgttcatgctctaattgcatgtacttgcagacacaatggccggtctgagccagctgccctcgcatggagcagctggctcagaccggccattattgttgctttgtactgtttgcactgtattgcgcctgcattgcgcaagctcgggcgcactcgctgagtggcgtgaatcgcagattgctcaatagcaacgcaatccacgctactcagcagttgccatggttatgcgcggcgtttgcggatgacgagcaaggcaccagccgcagctgccagcgccacaaccacgaccgcaatggcagccacggcagcacccgtattcgaaaggggcgcagcgccattagcagccggctcattcgtggcagtgttaccgggcttagcagtgttgccaggattgttggtatcgccgggcttctgctctccagggccgggagtgacctccgtggctgtgaccgtgacttcgaacgtcgcgttcacgccacgataagagacggtgatggtcttcgtgcctgcggtggcagaatcaaagccagtgaacttcagatcaccatcagttggatcaatcagcttgcgcagcgtttcggtatcgccgactttgtaaatggcggataccttcacatcggcagcgttgaacttatcgcctacctgataggaatccttggtcacttccacagcaagctcggccaactgaggcagttcgccgaatgtcactgtgtaggtttccgccgtgccatcctcagcagtcacagtcaccgtggccacgccactgttctcggtcgaagcctgctccacctgcaccgtagccttcgcgtcagcagcagtcgcctccaccgtcgggtaagaagcagcgtctccggccagcgcaccggcatattcggtgatatccgcggagaatccgtcaaccgtcttgccatccacagtcagatcagcaagattggcgttactagacggctgcggctctggcgttgcttcaccttcggcgatgcgtacttcagcgatcttggcatagtcattgccatcggcataggtgaagttgaggcgaatgcccttggtggcgggcagagcgctcacatcggcttccgtcacggctccagcagcaccattcacagtgactgccggcagcgtggcatcagtccacgtggcgttgtcttcagctaggtacgatacagtgaagctcttcggagcggcctcgcccttggccttatccaccgcaacgctgagcttgcccagctgatatgccttatcgaaggtgtagctgagccacggcgaggtgtcgccggtgccccagttcgaccagttggtgctcagattgttgtcgcaagtcaggtcggccgtagaagcggaggcccagctgctggccggctcatacttcgaggctgcggcggacgagcagaacaaccgggcaaggttgctttccacagtcacggtgagcgtggcagttactgaagaatcagtgacaaggcgtaccgtcacggtttgctcgcccaatttggtggtgtcgaagccttccaacgtgtattcatctggctccagtacacgcgtcttgccattggtgagcgtagcggtaaccgtcacgtccttatgcgcgagcgtctgcctcttggcgatagtggtttcagggcccttggccgcgatggactccacagcagcagtctgcgaaccgaacgcagtgccgttgaaggccacggtgaatgcgccggcattgctgttcgacgtggcgaaagcaccggcatcgagcccggttacgtccgcaccggtcagcgttaccgtagcgacatcctgccattcatcgttcgcggaagcacgccagtagcctttcagagtatcggttgagatgcgctccagcttgagctgcacttggtcgccgaagccggtaccaacatgcgatgtttccttatcgatgtagccatcggcattggaatcgtactgcatgtaaacgccgcttaggctggcaagtaacgtggcatatcccttgccgccgttagcgtcagcaagaccgttacggaccaccagaccggcgcgcggatcgccattaccgcccaagtcgagcggcttgaccgtggtttccagcgtttcgttcacgtccagagcatcaggctggtacaccgcactgccctcgttgcgatccgtccagacgccacgattggcgttgtccgtaatcgtgaagtcataagcaccgccggacgcagaaacctggcacgcgctgccgcccttccaatgagcttccttccaacttccggaaatcgggttggagcaggaaacatcgatggttctacggaatgtacggcccggattgaagttactgctctcggcaagagtgcccgtaatggtgtaggctcccggcacattgaatgcgtaggtgttaccagcagccttggtcgacttgctgactgccgtaccgccttccacattccatgtcaccttggtagcaatggtatcgtcgccttccttgacgttgacggtgtccggcagagtaacggttccgcccgtgttcacggtcttcgggagatcatcgccggtttccacagtccagttgaccagcttgcccttggcgctaccatggttgccccaatagctcagatcccaaccgtcgggctcgccttcttgagcaggattgtgcatttcgatggtgccgttctcaccgatggtcagcggcagccaaacataggtggaatcggctttaccggaatcccaacggtcaccaaggtagatgaagtgacctttctcctggtctactgcgagcacactagccgactgcgaaccgaatgtggtgccgcgggtatcgcccacggacaacagaccatccgcgccttccggcatgttgttgtaccacgtgttctcgttgacatcgtccttttccacgccacgggtccagtttcccagcatggagtcggcggtgtagtaggtctgcttgttcggggcccagccggttgcaccagatgcgatgatgttgtaacgcccgtcatattggaatacggcaggagcttccagcgaaccattttgtttgacgatttggaaatcttcgccacgcaccggggcatccgtagtagcgtctgcaagaatgtatgggtactgcccgtcagcagagtactgcttttgtccctcggactggtccacattcgtggtcttgactacattggtgtaatcatcgttgagcttggcgatgtacagcgtggcattggcttcggaagaatacagtacataggcactgtcgtccttcgggtccacgaacacagtcatatcgcggctgtcaccgttctcaccccagctggggttacctgcggcttctttccaattgttctggttaggcaaacgataggcacccaccatagtgaacgggcccgccggattgtcggaaacagccacgcccgcaagtgcacgtgcatagttggaaccgcccggcgtggtgcttccatcggaatgccaccacagcacgtattgcttgttcttcttgttgtagatgatcttcggacgctcgaaaatgccctgtacggaatcaaccgcgccatcaccatcctgatcggggttggtgttgaggtacgggaagattgcgtcggccttggcagcgtccacactgccgtcggacttggtcaggttgtaggccttgtcgaagtaggcgtaatcggcattgctcttatccgtcaactgagatttgctggtcaccgcacgcagcgccacaccaaggtcagtccagttgtatagatctgtcgacatataagcatgaacaccggggctgttgtcgtaaccgttagaacggtcttcgccataccagtagtaggcgtcgccaaccttgaccacttggccaccgtgcgcttggatgtgtgtgccgccattatcattggcgttcttggcataccaatatggctggaagtaatcgctagcgttcttgcccggatcggctgtgggctggaacttggtgtatgtcggcacttggccgatggtaggcaggtaatccacacctgccgcactggcacttgcagcggccagcccgcatgacaatagcgttgccgcggcggtaattgccgcgataagagcgcccttgcccttattgtttatcttcattgatttggttccttgattgatgataacggttttttgaacaaacagttatgtcgctatccgcgaagccagaaaaggttcgacaaatcaatataccgatactgaaaactcagtattcaacttgtcggaccaattatggtcaaagagcggaggaaccggccggcaatagtcaatattgccggcttgttccttcacccattactgcgcgagggtgctatgcacgcttgcgcagcatgaacagtgcacccgcggcagcggccagcagagcgacagcgccagcgatggcggcaacactggaaccggtgttggccaccgtgttcttgttgccgttgccggtggcaccgggcttgttggtgttgccgggcttctgttcttcagggccaggggcgactgcgttggccttgaccgtgacgttgaaggtcgcggtcacaccacggtaggagacggtaatcgccttcttgcctgcggtggtggagtcgaacgagccaatcgcaagctgcgggtcgtcaagagcgaccggcacttccttggtcttgtcgccactctggtagacggcagtcaccttcagaccggcggtatcgagcttgtcgccgatggcgtactcggtcttcgtgggtccgatcaccttgagcgaagccaaagtgaaggcgttgaaggtcaccgtgtaggtcttcgtctcagactcgtcggctgaggtcaccgtaatggcggccttgccgccaagcttgccgttctcaaccgcgtcgccagtcaccttgacggcggcggcattgtcggtggcgaaggcctgcagcaccgggtttgcctcggcgtcgaccggcagatcaaccgtgtagtcggtcttggacgggtcgaagccttcaacggtttcgccgtcaagacgcaggtcgcccagcgtggcatcggatgctggctgcggggtgagtaccgtgctgtcttgtgcgaacacctggatctcagccacgttgatgtacaccttggtgtcctgcaatgtgttagtcaggcggatggccttggcctttaccggggtgccgagcacgaagtcaacggtcggggtgtcggcggcggtgatgccgtcggagccagagccggcatcgccggcctgtatcttccagccatccttggtaccgactccatgccattcgccagcctcatcctggtattccagcgtctggctcttcggccaagacgcacgaccatcgtagtagaagaaggtcttcacttcggtgatggtctgagcttcgtcgaaggtgaacgtggcgaccgggtccaccgtcgaggcggtggaagcccaagtggaccaaccctttgacgtagtgtcaccatcgatggccttggaagcggaggcaccctcctggaagttcaccgagaagttcgtgccagaggccgcggcgatgttcttcgcagcaccctgaaccggcgtcacgaatgcctgaatttcggtggcgttcatgtagtcgttgttcacggtgttcacaatgcgcatcttcgtggcattcactgtgcccttatcggccttgaacgtcaccgtctggcctgcggcaggcttaacatcgctaccgaattgcatccacgtctcgccatcagtggtgtactcggccttggcggaagccggagccttgtcaccatacgtaatggtcacgctgctaagctcacactcagagccgaagtcaatcgtggcggtcgggctggcggaatagtcaccagcagagttccacgtcacccaggcttcagctgacgtgtcaccatcggtgagcttcttccactgatcgcccttgctgtattccgtctgctggttggtcacggtcaggttggaagcagtgtcggccacattctcaggcgtggcggcggtgacatagatcgcgcccttcagtgcaatcgtggtcgcgtcgtccagctggtaagtaccggtcacggcaatgttgtcgccagccttggcatcggcgagcttggtatcaagcccatcgaagttccacgtaaccttagccgcatcgccctcgaatgcaggcgatgccttgacgtgtaggtacaccggcgcagcctcaagcgcggccttcgcctcgctcgcactggtgccggccagcactgtagccgataccggatcggaaacggtgagcgcgccaacgtagaccgtagcggtgacgttgaactcgttgccgtacacatcggtggcggtagcggtggcttcgtaggcgccttccttggccacatcgaccttggaagtatcccagttggcaaccgtggccttgccttcgccccaagtgtagtagagcgtgacttcgaccggaagcacggccttctcgttaacggcggtctgcacgttcacggtcttctggctggtcggcgttacattgcgcagagtccatgtctggttggcggacggcgaagtgccgctcggtgactgccacaagccaaccttcgtgccgactgtggtaccagagttatccacatcaaggttcgtcttagtcgcggcattgagcagctggtaggtcgaaccatcggaagtgttgagaatccacttggcagccgggtcggatttagcggccccaaccgtttcgttggaaagcgcgttcgtgccatccttggacaccagcaccttgccttcggcgttagtaatcacataagccttgagatcagggcgctcggagtcggtgggctgctcgatctgggtaaaggtccaagtctgcttcttggcgttctcggcatcggaagcgacgttggccagggacagcgcggaatcaccagaagtggtatcagccacggccttgccggactgcttaccaacgagctggtaagtgtcgccggtctcgacggcagcatccttagcgtagccggtcacgccagtgagctggatggaggcgatagaacgggcgggcacagtgaccgtagcggtcttggcagccttgtcaatcatcacagagccttcagcttgcttgacgttgctggtcttggcgaagacttccggagtggcggaatcgacacccgcgttcttgtcttcggcagaggtttcggtggtcaggtagagctcaccgtaagcgttgtcggcaatctcgccgtacttcgacaggtcgatgacgaaggtctggtcagaggtgccggagttgcggtggatgacggtctgcgtcttgccatcgtcggaggtggcagtcatgttgttgtcttcatcgttgttggcgatgaccttgtcgcccgcgtggatgaagtgggtgatggccttgacgccgttgtacttggcgtttgcaataaccgtgcacggttcaagtccatcggtggtaccgccgttgttgttcacgcggcgctcggagtagagcttgccgtccatgccagccacggtgcagtcgaagtcgatgagcacggtgccccagttggtgttctcaccggccggattcacattcgagcccatctgcatgttgtagaggtcctcgaccacctgccagaaggtgaagtccttggactgcaggcgggtgacgttggagctgatcttgctcatcatgcccagcgcgttgtcgaaaccgtacgggttgtaggagccggactgccaggagccgtccacctcgctcatcgacagcttcttgccgtctgcctgagcgatatcgcgcgactgcatctggttgctgtcggagtaggcgtgaacgttgtactggccgataaggtccttgatcgcctgcgggtactggttgtacgacttgacgaagtcggcggagttcgtggcatcggtggctgcgatgatggtgtcatcattgtccttgagcgcctcagcgagtgcggtaatcgtctgctgctgctgggcgttgctgacatgcataccctcctgcggcttcttcagcgcgttggagtatggggtgacggacctatctttgtcggagtagtacttatcccagtagttgttaatgagcttggtgttgtcatcgctctcatcggtgtacttcgaagccatgtcgcccggagtgccccagtaactggtctcggactcgttgaacggctcgaccgtgtcaacgtttgcgccaaggctttcgaggtgctcgacgttcttggccatgtactgagcgaatttctcagggtttgcaagattattgctaccggagttgcgtccaccagtggcgtaaccgctgttggtcaggaaccacggagcggagttggcgaaggcctctacatcggtgatgtcggggttatcgccggtggcaccgcgctcaatccaccagtcttgggcggcggacttggagaagtcatactggttgtcgtcagtcgggtcgaatgccgcagccagcttgtctttgtcggcctgcttggtggttacgccattgccatacgtgccggagccggtggcgtcatctttccacgtgccaggcacggcagcgccttggcgcatgaatgggtagccgtaggcaacatcggaggcattgccgccgcccacgttgtagcgggccatgttcaggtccagtccttcatcaccgaagatggactggtagaactgttcgcgcagctgcttgccgtattccacagccttagccttggaagcgtcatcgccgagattggtggtgatggccgattcctcgccgaggctgccggtggcgttggcgaaccaagccagcgaggtgccccagccatcgaaactgttggcataccacgggttcggggtcacggtaatggcatcgttatcagccgcatacgcagtgccggcaaccgcaaacgcccctcctcccactagtgttgccgccgcaaccattgcagcaagcgatttgctcagtaccctcattggtctccttagtgttcctgctgtccgccttataccggaaaaatcggcctttgcttcactgagccggcctctttgcctgatacatgacctacgtcgactccttctttcggcgcagccaaaatgtttacgcaaacattttgatatgagcgattttatcacaaaaccgtcacccagcaaacaacttcagagaccacaaacgacgcacaaagtcatgagccattcgaattgcgctggcccaatcgctacgaatcatatttgccgtagcccttaagtgaatcccactgcatcgagatatcgcgcccgctatcccttccgataacgccgaccacgcgtgttgccttcagcaatcagctttccttgcgcaactaaaccgtttaggaatttgcggactgttctgttatcgagctctgttatcttggcgagttcaggtacagtcacatagtcaacctctgtcaagcgtcgattcatcgccgacagcatcgctgcccgcgaatcaatttcacccgatgcggttgcatctgctttcttaccatccacacgttccccgccaatgagcctcgcaccctcttcggcatctttctcaactacagatctcacgctagcaaaaccagaaccatccacggtcttcagcgcaggaacaataggaatcgtcgcctcgaatatgtcaccatcgcggaactcaggctctcgctcagtatattgccgggacgctcttatcagattccgcagtccgctacccagctgctcggctatgccggtctgcacaaacacattagcgataatcggattctttggcattggcgtgaactcgcccagcttcattcgaccttcaaagaatgagcgcgaagcattaaccgtccggatggattcattatcaatggtgacacgcgccaccaccggactggaatactcccgatgcatgaggctgtttgccaccaattcacgggcgatcatcgtacgcgggctcactcgcttatcgccctttaacacaaagcggtcaggcagattccgctcagtaaattcacggagttgctcgtacgaatcgaacaagttggtccgcaccataagtcggtcatcgtatcggtcaatattgtctcgccgaaccacggcatcagtaatatacgctgggcaaaccgaggaaatgacttcatccttgcccaagagcagcactgcagcaagattaaagccctcttcgccggtcgtgtaatcacgatcgtatagcttggcgctgcggaacagttcttcgtcagacatggttccccaagggtgcccagctcgctgagcgaccgccagctgccgcattcgcgcaatcagctcaggacgcaaatcaaacggagtcacgtaacggaaaattcgccgttcggaatagtagttctgcttgcgaatatacatttgactaatctggatatcgctttcgatgtgtgtatccacatcagcaatgcgatcaaacactgcgcccttgaaccgcacaaccgaagaactcggagctacccaaatacgaacaataatccgttcgtcgtactcgatatgttccgtttccaccattggagccggttcgaacatcttacgattagacactacgttgacaacgttgcgctctatctcactaacgcgcttagaatcgacgccgagcacttgaccgtcatcgtcaacgccaagataaatgctgccaccagaacgattggcgaatgagcatacagtctcaaaagtatccgtatgaggcaattcgctgcagcgcttgaactcgaccatagatgattcaccggcctgcagcacttgcataagttcatcctgcgtcatcgcattccgcccttcatagcgataattcatacattaggacatggcacttatcgtattttagcatctaattagtacattaggacattgttttatgtcctaatgtactaattaggcggctaattgtactaataattgcacactgatgtactaatccgatgatcgaatgcactaattgtccgcacaaatgcactaatcggatgaccgaatgtatcaatgagacctataggcagccgattggctgacgatcagcccagtcattggctatcggccgctagccagtcagccgccaacagccaacagccacccaaccaatagccgccagccaatcagcccgtccaatcactccttgtgttccagtgcggccttcaaatcgcggctacggtagcgttcgcgcagcatagagaatccaccgaagcccacaagccacaccaggccggcaatcgcggaattgcgcgtatcgtccgcaaggaacaacgtcaggtagatgaacacgaagaacacgattgccaccgtattgagcaccttccacgcgggcatgacgaacccgtccggaatgaaatcagcggaacggcggtacctgcgatgcgccagcagcgtcaggatgtagatgaacaggaacaccgcggagctggcggacgagaacagcacgaacgctccggacacaccggggatggcgttgacgatcggcgacagcagtatcagcgccgcggacaccaggatggcgcgggccggcaccttgcgatcggacaccttgccgagcttgttcagcatcgggttcggcgacacctcggacagctggtacaggtggcggccagccgagtacagcagcgagttcagcgcggaagatgcggcggtgatcaccacgaagaacaccagcgcggacgcccaattcagcccggcgtactggaacaccataatgaacggggaggcaaaggagccgtcctcgttcggcttgaacgaggtccacggcacgatgcacatgatggccaccagtgcgcccacatagaagatgagcacgcgcacgataatctcgttgatggccttgggcagcaccttgcgcggattcttggtctcggagacggtgacgcccacgaattcaatcatctcgtaggcgaagaacaccatctggaagctcatgaggaaggccatccaaccgttcggcgcgaacgagaagttggcgaacaggttgtcgaatccggcgtggccggccgggctcacgtggtccacgccgtgaatctgcacggctgggtaatggtagccgatcacgatcatgaccacggcggtggcgatcatcgcgcaaatcagcgtgatcttgatcatcgagaaccagaattccacctcgccgaacaccttgacggcaatcaggttgatggagaccagcgacaccaggaaacacagctcgatcagccatttccaatgggtcaggtcgatgccgaacgtgtcgaagaaggtgatgaagtacgtggagacggccgtgatctcggtcatgcccagcagcacgagcgcggcccaatacgtccagccggcgaaatgcccccacccgttgccaaggtaacgggtgatgaaattgatgaaggtgtgctggctggggtcacggtacatcatttcgccgatggcgcgcatcaggaagaacatgatgacaccgaccagaatgtacacgaagatgatcgaggggccggttagcgagattgacttacccgagcccaggaacaggccggtgccgatggtgccgccaatggcgatgaactgtacgtggcgattgctcaggccacgctccatctcgttggtctggtccaggctttcgacagacttgagtttgcccgtagcctgctgtgtaccaccattcacattcgtatcggccatactgatttcatttctcttctctgccgcccgattgttacgcaccagacgcgatactcgttcaaaacaagttcaaactgtatcaccgaaatatgtcacgaaaaccgctcagctcaagaatacatgcgatgatactgtaaatattccgccaaaaagttcaattcatcaacaccaaattgaacttctacctctattccacggacttgagcgagctgaccgggtctacgcgatcgagcactgggttggtgaacagctgcaccagcagcgcgaacgccagcgtcgccaccacggcaatcgcatagctgtgccagtgcacttccacttcgaaatacagcgacggcatattcaacgcagcagtcagtaatccgcctatccacctgccaagcggcagaccaaccaccacacccataccggtcaatatcatcatctcgcggttcacgtagttgtgcacctcgcggtcatagaagcccagcaccttcagtgtggccatctcgcggatgcgttcggacacgttcgtattggccaacgtaaacagcaccaccagcgccaggccgccggcgagccccacaatcagcgccaccacggcacccatcaaatcgaacttaaacgtggcggccagatgcgcacagctcacggccttgagcaccgacgattcctcgcccaaccgatccgcatattcggcctgttcggtctcggaacctttcagcttggcgagcatcgcgttccacgtcaaggtcgaggcagtgccatctcccgaagccgaagacgtcacaccgtcggccgcaaacttctggtcgtacagtcgctcactgatgtacacatcagagccgatgaggttgcgcgtcaccgccgcaaccttcaccttggcccgcccgctgccgccattgctcaacgtgacggtgtcgcccgcatgaatatccaacgaattggctgcggacttcgccacaatcacaccactatcgtccagcgctacagtgccgccacccgctttgccgaagatattgggcagctcgaaccacccatcgtcaccggcctcttccagcgtgaccatgtcgttcagtttgttcaacgaattgttgggcaccgtcatcagctgcacggtttcgctttcctgcgccgcattgctcatctcgccgctatccacgcgcagattcagcgtttcggtggcccggccatcttgtgccacctgcttgcgcatcgcggcggcgtcatcgtcattggccaccaccatcaagtcatactggtagatctgctcatattgcttgacgccagtcgtgtcgacggtgtcgttaatcgcaaatccgcagataatcagcgctgtgcaaccagccacgccgcccacggtcataatcaaacgcgacttgaatcggaagatattgcgcgcagtgactttgccgaggaagttcagccggctccataccgggcgaatccgctccaacaatatgcgagcgcccgccttcggcgccttcgggcgcatcagcgcggcgggcgtgtgccgtatctcctcgcggcaggcgagcgcggtgaccacgcccacaccgaccacgaacagcacgatgccggccgagccgtacagccagtcgtattcaagtcgcacaccgggcaatatatacagtccctcaatcaccaccatcaggaatgccgggatgccgaggaatccgaccagcagaccgatgccgccgccgaccaagcaggcgagcaacgcgaacagcagataccggctggacacggcgagtccgccatagccgagtccaaggtaggtgccgataagtccgcgatcttcctcgaccatgcgggtcatggtggtcaggctcatgagcacggcgaccagcaggaacacaatcgggaatgcgcggccgatggattcgatggaactgacatctgatttgagcgagctgaatccgtcgatcgaagcgcgcgtctgcacataccaacgtgcgttggccacatcgtcgatgcgccgttgctgcttggcgaattcgctttccgcttcgcttcgcatcgcatcgagtgcagactgcgcatcatccagtttcgccttgccgtccgcgagctgttgttcgccttcttccagctgccgctcgccttcttcaagctgccgcttgccgctggccagttgggcggcctgcgcttcaagttgcgccgactgggtttcgagggttgcggcattcgcttcgagttccgcggatttggtattgagctgtgcctctcctgcagccgcttcctgttccttggcggtcagttgcgcgttctgctggtccaaggtggattgtgcgggggcaatggtttcgtttaatgtgcgctgcaaatcggctttctgctgggccagactgtctcgctgcgtttgcagttccgtttgcttggcggtcagctgttgccgcagatcgctgattgacggcacttcaggcagggtaatgccaaggcgcgcgagcagttgcttgatggcctgccatgtgggtgagttgaggtcgatattcgggtcaagttgcgccagtagattgtcggcctgttgaatcatggacagcatctgatcaatttgcgccatgccttggtcgatttgggtaatgccctgttcgattttcgtgcgattggcagtcagttccgtttgcgccgcatcgagctgtttgcgagccgaggtgagctgcgctttgcccgattcgagctgggtgcgcgcttcggctatctgctggcgaccttgcgcgatctgttgacgggccgatgcaatctgcgcacgtccatcggcgagctgccgttcgccatcggtaatggttgtcctgttgttctccaattcggtacggctatcttgcaatgtcgttttgttggcttccagctcggcccagttgtcgtcgatctgcttctgggcttcgtccagctgctcgttggcctcgtctttggcatcatccagtttgcgctgcgcgctggagacgatctgttgacgacgggctttctggcgtgtggtctgtatctgatgttcgatacggtcggccacggttttgacggcttcatcgtaggcatcggaaaacgtgtcaaaatcggacgcaccagtgacggcaaccgatatcgcagtgtatatattgccggtcacgccgtcgctgggtgcaaagaacgtatagtcctcggatgaggtggaccggaaggaggtcatgcccgaatagccgtctggattgttgaggtcgcgcgggtcgagtacgacgccggtgatggtgagtttcgtggggaactgcggggattgctcggcgtcggcgtccgtattggcggcggacttcgcatcggatgccgaggcattggcggcgacacctaccgtatcggcattattggaatcgtcagtctccgtggccgctaccgatatgacggatgaagaggtgtcttgtggcgtcacagtaatggtgccgccaatcttgagtccgctatcgttcaggaattgctgcgtaaccgccacttcgccggccttgttcggcagtttgccctgccgtatgtacggctgatcaagcccttcggtaccgatttcctgcatggtcacggttttcttggtgccgtccaccaacgtggtcaccgtctgagaacgttcgggctgcacggtttgcacaccgtcgattcggcgcagtgccgctgcatcatcaccggtcaggccgtatgtggatagcacctgcaggtcatgcagtccctgctgatcgtaaaaacgaccggccgccagaaaagcatcgcggcatccggcgtagatgccggtcagcacggccacgccaagcagcgtaatgacggcgatcgagacgaacctcttccagctgcgcagccagcaacgcaacgtatctttggcaaataccgcagaaacgcccgctcctcgaccgccgctatcgtcgaggttccgccgtttcacagaatgtttcacaggttgtttcacgaatcgcctcgcttgtttcacggggcgtttcacagagtgtcttgcagtgagcatcgccaatcacctaccattcgatatcggcgatgggccgcggcgttgcgttgacctcctcgctggtcaccttgccggagcggaagcgaatcactttgtgagccatcggtgcaagcgcggaattatgcgtgatgatcattacggtcatgccttgtgtttggcaaatatcctgcagcaactgcagcacttccttgccggtctcgtaatcgagcgcaccggtcggctcatcgcacaacagcagcttcggctttttggcaatcgcgcgggcgatggatacacgctgttgttcgccgccggacagttgcgctgggaagttccccatgcgctcccccaacccgaccttgtacaaggtttccaccgggtcgaaatggtcggggcaaatctgtgaggcaagctccacgttttccagcgcggtaaggttcggcacaagattgtagaactggaaaacgaagccgatgtcgttgcgccggtaggtcaccagtccctttttccgcaggcccgtaatatcgcgcccgccgaccactacgcggccggttgtggcggtatccatgccgcccagaatgttcaatgccgtggttttgccggcaccggactgtcccagaatcacgcttaattcgccttgttcggcggtaaagctggcctcgtcgagcgcgcgaatcacactgctaccagaaggatattccttgaccacatggtcgaattcgatatacgccatcgcacacctccaacgcgctcgtggcagccacctagccccataggccccgccaaaacttcctgctatactcaagtaaaacaacactgtgtcggttctgcaaccaacagttggattgtgggttgtcggaatttggggagaaggccatggccaaagaattgacggaaagccgccgcacccgctacacgagacgtgccatgcaggacgcgcttatcgagttgctgcgcaatcagccgctcggctccatcaccgttaaagcgttgtgcgagcgggccgatgtgaatcgttccacgttttacgcgcattatgcgagcatcgaggaactgctgcacgacattgaagacgaaaccatggcctgggtcaccaccgcactcgaacagctactcgcccagccagattctgccggcatcgagcatgttattgagcgcatctgccagtacattgccgacaatcgcaagcatctgcaggtattgatgagcccgaaagcggatatcggcttccagcagcagctgctgggattgatttacagccagcgcggcgtaggcgaacagttgcaatcttcggcgggttacccagccgaggcgcagatgcgtatgcgattcgccgtgtccggcagcattgggcttttgcaatattggctcgccaccgatctcgcggcctctcccgaatcggtgtcccacaccatcttcaccatgtgtatgcctgccacgcagtgaacacggtgaattcagtgaactcagtgaagcgtgcggtttcataagcatcgctcgctatagcttcgcctgctcaccggccgcgcccacgcccgcgcttgcgatagcgcacaaatagacgattgaccatttctgagacgatacggcggcatagaataacgaacgttgcgcatcgcggcaagccccgcgtgcgccaaaacccaagaaatgtgagagaagggcacaatgagtactgctgatgcgcctaagaagccgcgcgaaaccgacgacgtgccggtgccggccacgctgcgcaagtcactgaagaaccgtcatatccagctgattgcactgggcggcgccatcggaaccggcctgttctatggttccagcgaatccatcgcgctggccggcccctcgattctgctcgcctacttggttggcggcttcgcaatcttcatgatcgtgcgcgcgctgagcgaaatgtccgttgaggatccgaaggcgggcgcgttcagctactacgccactcgctactggtccaagcgcgccggcttcatctccggttggaactactggttcaattacatcctcgtctcgatggttgagctgtccgtggtgggcaaattcgtaaactactggttcccggcgattccgacatgggtgtcggcggccgtgttcttggtgattatctgcgccgccaacctgctgggcgtctccaagttcggtgagttcgagttctggttcgccattatcaagattgtggccgtgatcgccatgatcgtcggcggcctggccgtcatcatcttcgctctgcccaccgcatccggcatcaaagcgagctttgccaactggttcaccttggaagggggcttcttcccgaacggtctcatggagcagactaaggacggcacctggaccggcctgttgatggcgcttgtcgtggtgatgttcagcttcggcggcaccgagctcatcggcatcaccgccggcgaaaccgaggaccctcgtcgtacgattccccgcgccaccaatgacattatctggcgaattctcgtgttctacattggcgcgctcggcgtaatcatggccgtaataccgtggaacaccatcggcggagacgatgttcccagcccgttcgtgcaaatcttcgattccgtgggcatccacgcggccgccggcatcctcaacttcgtgtgcctgaccgctgtgatgagcgtctacaactccggcctgtacgccaactcccgcatgctgtattcgctggccaaacaaggcaatgcacccgcgtatctgggcaagctcaacgctaagggcgtgccggtggccggcgtgctgacgtccgccgtgatcaccgccatcgccgtggtcgtggtgttcgtgtggcctgagttcgcgttcaactatctgatgtcgattgccaccatcgccggcatcatcaactggacgatgatcatgttcaccgaaatgaagttccgtaaggtggtcgccgcgggcggcgctcccgaggattccgaactggcaggcaagtccggcaaggaagcgctcgacgcgattcacttcaagctgccgttcgctaaggtgaccccgtgggtggtgttggcgttcttggcactggtggtggtgctcatgtgcttctccgccagctaccgcgtcgccgttatcgccggcgtgatctggctcgccattctcttcgccgcctaccagatcactcaggcgaagcgataagccccctattgcaaaaaactctcactgagggatgcccagcgagagttttttgcaaaatcaggccactcgttgcaaatttctctcactgactaagcgtcagtgagagttttttgcaattggggtcagatttgacgcttgcgccagatgatgagggcagcgccagcggcggctaggagggccatgagggctactgcgccgaggatggcggcaccggtgttggcggtttcgtcggccttgggctgttcggcggtgggcttggccacgttgaccgcgtcccagaccagcgaatcgtcagcgaactggacagcgaacttcgtggcgcccagcttcaggtcggcgggcacagtcaccaccacagtgccgtccttggagacggtcacaccggaggcgaccagcacggccttgccgttggagaaggcgtacacgttcaccgtcttgcctgcgaatgccttgcccacgttcaacgtcagcttggcacccggctttatggattcggcggtgatgaggtcgtccacatggttcgcgtcagtcagatccttctctgccggggcgggctgctccggcttgctcggctgctcaggctgctctggctcggtggtggtcttcttggtgacggtcaccgcgacggaagcggacttggtggcgtcttcggtagacgtggcggtaatagttgcattaccttcagccacggccttgacgttgccgttcgcatccacggttgcgatcttctcgtcggaggaggtccaggtcacggtcttggcgatatcaccggtcaccgtcacgtcggcggtgagagtcgcttcgccgccaaccttgagctccagcttgccgtccttgacctcgctacctgtgatggcgacggaatcaacggaaggtgccggaggaacgaccgggtcggtaacagtcacggtgatggaagcggtcttgccgcctgcggtcgcggttactgttgcggtgccagccttgacggccttcacgagaccggtcttgtcaacggtcacggcatcgccctcgaccgaccacgagaccgcagcatcatctgcatccgtcggagtgacagtagcagtgagcttcacggacttgccggtttccagagccaacttgccttcagccacaccgtcgccgaaaatggcgatggactcgaccggtacagtcttcttgaccagcttgaccgtgtaggtctcggtggtcttgccgtctgcggcggtgacgatgaccgtcaccacaccgtcattgacgttcaccttggcagtggcgccggagtcgttggcctcaaataccacatccgaagccttaacagcggtcggatcatcaacggtcagcgaagcaccgtcctcagtagcggcagccgcaaggtcaactgtctgaccggccacggtgagggacttcagcgtggcatcgctggacggagtcggagtcggctcgtcacccttgtccgggttgaagagatcggcggcggtgacggcacggttccataccttgaagttgtcgatctgaccaccgaagtacgggtcgttatagaacgacttaccgaggtaaccggcaatgttgtttgtgccaacaaagtcggcggcggtcagcgtggtcgagacctgcttgatcagttcgccgtcaaggtagtaggcaatggacttaccgcccttaaccaccacatccacgtgaacccacgtgttcttggccggagtggaaccggcaagctgagtctgggtaccggacttcgaggcctcgactcgtgtattggaaccacaggagacgatgttcaccaaataatccttggtgtccttgcccaacgcccacgggtagatgcaggtgttgttgccgtcccactggtagtcggcggaaatggtgatgtccttctggctggcatcaatcaggccggccggaatctgcacgtacggagacgcggagcccttgtcaccaccggtcagggtgagcgccttgccattgtcggcatggtcgcttgccgatgcgccatcgttcacgaccttaccgtcgagcttgtcgcctgcggtaccagtgttgtcgatagtgccgtccttgacgatggtgtccgtgtcgaaggtgtactcaagcaccggatcactggcggcgggcacagtggcgtcgccacgcacgatctgcaccgagtagtgcttcacggccttgtgatcctgcgcgtaggaagtgatttccacagtggtcacgtcgtcggtcagcgcgatggtgcgggccttggtgtcatcgatgatgatgccatcgaccttgacgtaggcaccggcatccttcacgccgatggtggcatcgacggactcagtaccggccggaacggtgagcgtgtactgggtcttggaaccatcgaaggtcgggtcaagagtgcccttgtcgaaggaaagcgacttcagcgaggcatcggtagacaacgccgcagcgttctgcatgcgcacgccgtatacgccgccgacgagaccgccggtggacttgaacagcacgcgcaccttgccgtccttggcctcggcaatcaggtcggcgggcagttgctggacatcccagtagaaggccttcaagcccttgttctcgatcgtgacggtgtaggtcttcgcgttggcggagacctcgcccttcgagttgtcggcgaccggggtcggatccacgatcatgctgaacgtgcggcccgcatcggcggactggtactggacgctcaggtagttcttggcatcggcctcagtgttcaccttgagatcgtagctgaaccagccgtcggccttggcgtcacggtactgcttgtcctcgtaggtgccggcgttggagtcgtcggacttagcggcgttgtgagcgagctcctgctggaactcgttgtcgaaggcgtcaaccgcgtcgatgatgatcgactgggttgcagcgtcggtcttcttcttgaagatgttgttctggtaggtttcggaatcgacctcggccatatcccagtagatcgcgtacgtggtcttgtacgtggagtagtagggttggagcgtgaggtcggcggcgtcaccgtcaacattggcgaacttgaagctcagggtttcgcggttgccggtgttcggatcgtcggtacgcacgaggttgctgccttcggacgcgtcctccttgatgcccttgagccagtcagtgaccgagccagaggtcgggatgaccgcagccttggcgttggcctcggaatcgtagttggccacgcgcaccttgacaccaccgtaggagtagttcgtcttgtagttggtatcggtcagcgcaccggcgagtacgaccgggccgtactggaaggcgacccaatccttgttgtcggcggcatcgatggcctgcaacttagcgggcaaggtgtaggtaatcttggcgccatccttgatggcgaccgtcacccaaccgttctcgtccttagtcagagcctgctcagtaccgtcaacaacgagcttcacaccattggtgatggcccagtccggcacgcgcaacttgaggttcgcggaaccggtaccggagacttcgaacgtgacgtcctcggttttcggcacattggcggtctgcgtgatggtcaggttgtggcgtgtgtccgtgtaggtggacgaccagaacatattcacgtaaacattgttctcgtcggtgaagtagaaagaatcgttgagcttggcgaagttctcgataccggtaccctggcagcaccaatactcgccaatcgcgccgccgaaccagtcggcgtcgtagtcggtgccggtgatgccgaataccttcgggtagccggccttcatcggctggaagtacgtggtcataccggtttccgggttctgggaggccacgatcgcgttgatgaacgtgtgctcgtagtactcggagtacttggaatccttggtcacctggaacaggatgcgggccagcttgagcatgttgtactcgttgcaggtctccacggtggagaagttgcggtagccgccgttctggtcgccgttctgggtggcgtccttccacagttcaccggccacgtggaagtgctcggactgcgagttgccgccgttcacataggtgtgatccttcacaacgatatcgaagaagttctgcgcagccttcaggtacaggctggtgagcttgcctcgctcgtcggcggaaaggctgttgtacaggtcctcatcctcggtgtaggccacgtatcgctgcatggcaccggtgagcttcggaatcgtggtgttggcgtgcaagccgttgagcggatcctggccattggcgagcttctggaacagcgcggtctcatcgaacaggtgcgcggccgtgagcacggtctgcttgtcggatgcatcggcgatttcggcgacctgatagagggcgtcattcatgccgccgtattcagtgcgcagcatgtcggtggaggcgtgtgcggacttccagttgacaacccacttggcgaagtcgaccgcggcggccttggcggtttcgcgagtttcagcgtcggtggagtagtcgtatgcctgcaccatgccggcctcaaccttgtgcaggttgtagaacggcacgatcaggccgccgccaccgttcggcaccacgctcgcggagaatgcggggaagaaaccagcgttggcggtgtccttcttggcataggcttcctgcgcctcacggatgcccttgactacagcagtgaggtttgcggagagctgggccttctgatcagccgtggcaaaggtggagcgctgcgcctgcgaggccgcggaaatccagtgacccacgaagtgaccggtgaagcgtcccggtttgctgctgccgtcagggttgcggctctcgtccgggccgttctcccaaccgccgtagttcttcgcgcccttggtgtcgagaccggcctgtgcacggaactcgaccagcagacggtccggctcaaagctcagcagatactcgacttccttcttaccggcgttctgcaggtattcgtcggctacggtgacgttctccatgccctgctcggagaggtagttcttaaggtattgcacgtcgtgtccaccaccgttttcggtctgcgctggcacggtgacggtcacggttttggaaacggccttggagccgtaggaggcagtgacggtaatctttgcggtgccatcggcctcgcccacagccggacgggttacgacaccctcattggagataaccgcttcgttatcggaagcgtacgtcagcgttgcaccattggccgcttcagtgttgaaggtcaggttggaggttgccgaagtagcgatattcaccttgtcgagcgcggcctgagccagcgtggtagcgtcaaaactcttgtcaccgaccttgacttcacgctccgcatcggcggtgttggccacggtattccacagtttcacgtcatccaacataccggtgagctggccaccggaagcatgggcaccattccagccgatgtacttggtggtgtcgtcggccacgatggtgccggcagaagcggtgttatcagaggcagcagtctgcgcctcaccattgatgtagaacttcgcggtcttggtcttggcatcgaacgtgaccatcacatgggtccacgtgttcacagggaagacatccgcgcgcttgcctgacaggttgaattcgagcggctggccggagccggagccgccggagcccacgccgaccgacagcacgagcggcttagtatcagaattggaactcaggtaccaaccgttttcgttgtacttgcccttgccccacatcagaatctgctcgccggtcatcgtcttgctggggttccaccagaacgagagcgacaggctttccggctggagcttctggcttgcgccaaggctgagcgcgccttggctcagcgtaatggccttgccatccacgccgtcaacataggtggcggtgcccttatattcggtgacggtgtttgcagcggcactgttgtcggtcaggttgccgtcgaaaccgagatcgagcaccttgttagtatcacttgtggccggctgaatgctggagtccacttctgcagccccagccgttcccgcagtcatgagcgtgaacaccatcggtattgcagctaccgccgcaatacctttgcgccacgcgcctttccctttatcgatagttctcatacgttgagagcctctcctactttgaccccattgttatcaaattgttatcaggctggatgctgcgtccatcgaacacaacagcggcggctccttccaccgcccaacccaatatgcacccgcatcactgtggggagcgtgacaccaagccaaaaacccacgaaacacaagagattcgcagaatcccagcgcagcatcagcacactgtgtaagtgtttatgcattataccgttagcgctcactgaaatacagacagggaggcagggggtatccgtcgaagcaatttccgcacatcacatctgtgcgtttggacagcatataccgcataaaccatatcggacataccattgattcttctctgccagaccggcgaccctctcataagccggtcttcttcgcgcagctcacgcgattttcgcttatgcaccgacgtgtggcatgcagttcgctctgcttgccacacactagcagccactgaccgacaccgacaacgaatctcaatacggacttgcgagccaatcgagtcgctgcaatgaacacgcaatcgcgccgccgaggcaacctgaaaatctcaaacacaacgtcaaaagatgacagagtacgaaatctacagctacgaagcgtttcgccgcaaatacgaggacgaaatacgcatcgtggaacgcgccgaagccgatgacctcaaccaagactccctactgcggcatgaactcgcgctcaaaagtgagcgcccacattttgcgcggatggacgaatcacacattctggaactcaccagcgttttgcggaacggaaagccgacactagccgggattatgctattttccacgtatccacaggcattcttccctcagttatctatcatcgcaacgcgaatccccggcacgcaaatcggcgatacaaggccaaacgaagaacggttcatcgacaatgctcgcattgaggggccgcttgacgaacagctgcgcggagccatcgcctttatacgcaagaatattcgcacaacaactatcatctctcccgaaaacggcgaaagaatggatgccgctgaatatccaattgaggccgtccgcgaattgatattaaatgcactcatacaccgtgactacagcatccacacacagggtatgccgatacagctgcagattctcgacgatcgtatgaccatcatcaatcccggtagcctatatggaaggctcaccatcgatcagcttggcactattcaaccagatacacgcaatccagttatcgcaaatgcgctggaggttctacgagtgacgaagaatcgttattctggtatccccaccgtacgcagacttgcttcagaaacgggaatggccgctccattattcgaaaacactcgtggagagttcagagccacgttgtattcgcctctcgcccgaactacgttgccatccgttatgagtcacgaagcgttcaaccgactggactatcaggcaaacggtcagaggcctaattcccggcgcagaatccggcccgaagagcgtaatgccgcaattctgcaattctgtgcaacaccgagagcccgccgacaaatcgcaaacttcattgggctggatagcactgcatatgcaatgcgcacttatgtgcaaccattggtcgtacctggtcaacttgttctaggcttgcccgacaaaccgcagagcagtaaccaaacctatcgcactgcatagccgtaacaagcgcccccaacgccagataggtatgagccctaaggcccaattgcaaaaaactctcactgaggagtgctcagtgagagttttttgcaaatgaggggtcagatacggcgcttgcgccagatggtcagggcaataccggcggcggcgaggaccaccacggcaccagccacgccgaagacggcgacaccagtgtcggagatgacggcacccggcttcttgccatcagcggagaccttcacgagggccttgcgggcctcggtcaggtgacgaatcgcatcctggacctcggtggaggtggcgttctccttggcgagcaccttcttcgcttgggccagcgcattggcgtaggccttccacgaatcggcggtgtaatcgtcctggttcagcttctcggcttcggccttggcaatggcgtcttcgagctgcttgagctcttcctcagtggccagatcgggatccggagtcggcgtctcgtcggcaacgaccttcacggtgaacgtggcggtcttggtcgaatcggccacagactgcacggtcacggtcaccttgtcggaggccttcgaggagtcgaagccgagcagctcgtactcatcggcggcgagctcacgggtggtggagccgccgttgccatcggccacggtcgcggtgacgaccagaccggcaacgtcgagcgcttcaccaaccttgtactcggccttggcgggctgcgcggtcacggcgatggagaggatcgtgcctgcggccgggtgctccggctcgggctggctctcctccaacgcattctgcgcgtcggtcagggccttggcggcggcatcgacatcagcctgagacaggccggagtcaaggaaggtctgcttggccgtcttggctgcggcgagcgcatcctcgaatgccttccagctggcctcggtgtaagcagagccatcggtgccgagcttgtcggccgcttcaatcgcgccatcaagcgccgtcgtatcggccatctcaatggacacgccttcgtcggtcgggtgaatggtctgcatcaggccgtccgcgtcgaaggtgatctcgtcgatggcggtttcacggtggtagccgaggccggaggtgaacacgccgagcggcgtgtagtggcgatggtaggccatgagccaacggtcgttgccgtccgcgtcggtcacatgcacgtcggactggtgcgcggtaccttgcaggttcttggaggaatccttctgcagcagcacacccttgtaggtgatggtgccgtcgatggaatcggagacgccgtacctcacatggtagttcggggagttggcgtcgtcgcacgaccaggtccagtggtacttgccgtcgcggtaggcgacgaccacggactcgcggaagccgttcagaccgttgagcttcttcaccgtaccggccttgatgctcaccatgtcgtcgttgagttcggcgatggcgggcgaaccgttgccgtacaggatgtacgacttgccggtgttcgggtcggtgaagatggacgggtcgatggcctgtccaacggtgacgccttccatcgtgcgagtgaccagcggctgatcggcggccttgaacggaccggccgggttgtcggccacggccacgccgatggcggatgtaccgttcggcaacttcgcgcagtagtagaagtagtacttgccgttcttcttctcgatggtcggcgcccacgcggagcccacggaccacggggagatggcggtgttctcatcgccatcggtggtcggctggtggtccttattgacatcgaggatcacgccctcgtcggtccagttcaccaagtcggtggagctgaacgcatggaagtagttgccgctccagccggagaagccgtcggtggtcgggtagatccagaacttgccgtcgaagtagtcgatgtccgggtcggcgtactggccgggcagtaccgggttgttgcccacggtgaccttcttcagcgtccaggtctgcggcgcaccgtcgcccaaatcaacgaccaaagtacggtccttagccaggtcggccgtaccaccattggtgaacgcctgaccatcaagggtgagcttgatggagtcgtcgctacggttgacagacaccttgacgggcaccttggtcgcgccgccacggcggttgagcacggtggtgacggtcttcgtggaccagtcgagggtggaacggacctgagagtggtcgtcagtgccacgcagcgagttcgggtcagacggcacagtgcccacagaaataccctgcagagcaatcgggctggtcttctcgacctcctgagcagtgagcgcgcggttccacacgttcacattgtcgaacgaacccttgaagtatgggtcgttgtagaaggacttgcccaagtaggccagcagatcgttacccaaatcggtgaccttgttcttggtcgccttgttctgagccacctgcgcaccgtcagagtacacggtcatcacgttgtcgtccaacgtgaccgtgacacgatgccatgcgccgttgccagacaacgtagcgttagccgcgtcctccgcaccatacgagttggtggtgatgcggctggcgagctcgccggagttgttgtacttcaggaagtagtacttggtggagttctggccgaaagcgaacgtgaactggtttttattgatctccgacttgacatccatctgcacagtcagcttgtcacggccgtcgaacaggcccttcgggaactcggcgtaggtgccgtcagagccgtcgagcttaagcaccttgcccttgtcggcatcctcggagaccttggcgttgccgttgaaggtcaggtcgttgttgttctcagtggtgtcggtacccttgctgtcttcgaagtcatactcggcaatcggaccggagccgtcctcatcgggagtgactggcccagcgtccttgttcttgtcgaacaccttcaggattgcgttgtactcggtttcggtgacaggcaggatggtgccgtgacgcttcttcagggaaccgaagttcacatcagaggcaaagccccaatcagccttatcagtgctgcttaaatcggcagaacggtatggggtgtaacccttaccggctgcgtactggtcccacatcagaccatagagcatcttcttgcccgcatcactggcctgcacgtcatcttcattgtagaagaacagctccgggccttccagctgcgcaccggtcagaccggtaccagtcaggtctccgaaggtaccgacaagcgtccaccggttcggatcactgtcagtgttgtagtaaccattcgcgattgtgtcaccagtggtgagcgttgtggcatacggatccttgctacgctcgatgccgaggtacgtgtcgccggaaacacggtagtagtaaccgtcatcggccttaatcatcgtggtatcgataacggacttgactcggtcgatccacttgacaggcgttgtgaagttcacgaaatcacgcgtggtggagtagtacatgttggtgcgatcaccggacttgttgtcggagtcggatgcggtggcccagtacaccatgtactgcttgttcacatcatcccagtgggcttccggagcccaagccatgccggctcccggaatctgagaggcaacgtcaacggcgcgcggttcgctccagttgacgaagtcatgcgactcccacacgatcaggttggtgctaccggtgctggtggccgcggccgcgccccaaccgccacggttgcggatgctcagctcggtagcgatgaggtagacagtgtcgccttccggagagcggaccagatacgggtcgcgcacgccgttgtccttgccacgagagttgccggtctggctgttgttccagctgagtaccggatcgccggactcgcgggtgtcatgccagctcaggccatccttgctggtggcgaagtacatctgctcgtcggtagtgctgccttcggtgccggtgaagtgcgcgaacagatagtccgtggtcttcggctgttcgacggcggccttgacggtcagctcgaattccttggtttccgtgttgccgtcagcatcggtaatggtggcagtgagcgtcaccttggcgtcggccttctggcgagtgacgacgccggctgcgatgtcgccatctgcagcatcagtaatgaccttggcgtcgctggacttccatgtaatcgcggaaccattaaccgaacccttggctggaagtgtgatgtcggaatacgcatcggtgctgccgttgttgatggtcagcgcgttagcgtcggccttggcggcatcggacttcgtggaatcgtaggcttccttgatttgctccgcagtgtgcgcggagccgtaaatattcaggttgtcgagtgcgccggtgtagtactcgccgttcacccagttggccttgccgatctgcagcacgccgccgtctgcgccgagaatatcggtgagctgagcgaagctcgcgccatcagccggggctacggttgcggcctgctcaccgtcaatgtacagcgtggaagcggccttgtcgatgaccaaatcgacgtgacgccactggctggcgagaccatccttgctcacattgccggtggtgtcgcgcttaccagcgttgttgtaacgctcaacgttcaccgaagtggtgcgatccatcacgccgaggtaacgctcttgctgataggtctgcgcattcgtattcggtgccgcaaataccgaccagccctgattggtgctggcggacttggaatcatacgaaatcgtgaccgcatccaggcccttgagcacagccgaatcatccgacttagtcacattcagccagaagccagaaccgagctgagctgcggtagtgccgtctttactggcagttactgcggcggcaccgttgatggttgccttggtgccggttgcctcatcggtgaaggtaccagtggcacttgccgtgacgttgttgaagtcaaggctggcaagcaaatcactgtctgccgatgccttggcatttgatttcagggctgctgccagcgcccgctgtgcggccgatgaatcggtggtatccgattcaaccgcatttgctgctggcgccagcgccatcagcatcgggacagctgcaagagctgccaccgctttcttccacttacccatatgtctcctctgattgtgggttttggttttgtgttcagttatggattgaagattgaagttatggtgatactaggtgctccctctccgtccgccagaagccgactgagagggagcatttggatccgctcaggcgcgacgcttgcgccagatagtgagagagatgccggcaacggcgagcacaaccacggcaccaccaaggccgagcacggcggcaccagaggacggcagaccggagtctgctcccgtaccagcgttaccgttatcgctgcctgcaccatcgccggaaccgtcgcccgaaccgggcttaccgggctcggtcttggcactcacggtcaccacgaacgacgtggtgagctgatcgttggccttgagcgtgacggtgacggtcttggtgcccacagcggacatgtccacgtcgccgaccgtgtagtcggcggcatcgagcgtcttcaccgtgccgtccgacatcgtcgcctcgatcacaagaccatcggcggagaactgctcgcccaccgtgtacttggtctttgtcggctcgctcttgacgcggatgccggtgatggacggctcaaccggcgtatcgggctcgccgacggtcaccgtaatggtcaccgtgcggttggccggagcaacctcctgatccttggtcagcgacatgtcgagcatgccgttggcgcgcacgttcacggccttggcccacgtattgcggtcctgatcgaacaggccacccgctgcggaaccggagtgaatttccgggtaggggcgtgcgtggtaggccatgacgatgttgccggcctcatcatgtgcaagcgagatgtggccggggccggcctgcttgcgctcgtacgaggcctcatccgcaccgtaggcaccggtgtaggtgtcgttggtgtcgaacgacgggaagtcggccgtggtccagctcgacagatcctgcaggtcggcattcttggcggcacgcatcacgttggtgttgtaatacttatccaccgtggcacccgcataggcaatgtagacgtagtcgccatgttcgaacatgaacggtgcctctacgattgcctgatcagaaccttcagagttgtctccgggggtaggcgcatacttgccgtactcgaactgctggctggcctgatagatgtgctcaaggctgccatccaccagcggagtgacgccatcgcccatctttgccttggcaaggtacaggcctgcgctcttcgggaagagccagtagccctgggccttgccgttctcctcgcgctcgaagtacgtcacgtcgaatgcggcgccttccagcacggtcggctcgccccagttttcggcctcgaggaatccgccatccttgatggaccgctcgtcgccggtgtacgggatgaggatggtgttgttgcaccagccaccgttcgtggacgaggcacccctgtggaagccggccacaatccaccacttgccgttaatcttgtggaactcctgggcccaaatgaacgcgctccaaccgtagaacgagttggggtactggtcttcgtggcccggagtgccgttctccggcttgatgatgatgtgttcctcagcatccttcagaccgttgatggtcttggcgcgcttgaggccgatggaacggtagctgtccttctggttgttggtcgaatcagtggactttacctcataggtggaaccggtgaggtagtagtagccatcgtcttcgttgtagaagatgtccggatcggcgcgagcgtcgttgtacatggcctcggtggtctgctgaacagtgcccttgacctcatacgtgccggcctttgaggtgtccacggcggccagatcatcggcgttccagtcgacgttgaaggtcttcgtggagccgtcgttgtaggtcattgtggcctgcgttccggaaaccgctgcggtgacgtcctcggcggaagcaccgttctccacggttgcgccgcccagagctttaacgccggtgttctgcagatcgacatagttcttgtagaacgcatcgaattcagaggagctcacagcgaatgcgcgggtctggccttcgccggcccatgcgggcagaccttcggtcacgtcgcccacacccatcgcaaccgcgtcggccttgagcgtctcgccgaccgttgccttggcagtcaggtcggagagcgtggccatacggccttcgccgctcaggccatcggtccagaagaccttgtagcccttggaggcggcatcatagacgatgcgcgggttggtgaccatggagctgtcggtcacggtgatggcgcgctcgttggtgaacgtggcaccgtcgcccttgccatcccacacgtaaatcgcaccggtggcgttgttctgcgaggaaaccacaccaagggtaccgtccttcgcacggaagaaagcgggcgagcccatctgcgcattcggcttggcagactgcgagccgtcccacttgaccgacagaatcgactgcgaacggttcagggtctcccatttgctgccatcggcggccttggcggccacgtacagcgagtcggcgcgacgatcgtcgttgtaggcgagcgggtcgtacttggcaccgttctggtcggagcgatcgacatccttgacgtaggaagcgatttcgccgccgttgttgaggatttcggattcggcggtgatggccttatccacgccgtcgatggtggcggtgagcttgaccttcacggccttctcgccggacttcggctgcgtgaccttgccgtctgcggctacgagcttcgcaccgtcgccggtcgcggaccaagtaaccgtcttgcccagcacagtgctcggcaggtcgccggtgatttgcgccgggatggcgagcgcggcggcgtagtcggtcttcgcgctttccacgccaagctcgtcgtcgctcagggccttgccccagatcttgaagttgtcgagcagaccggagaagtactcgccgttgctccagttggccttgccgatctgcagcacgccgccatcagcaccgaggatgtcggcgagcttctggccgttgttgttcacggctaccagcttggagtcgatgtacagcttggcggttgcgccggaaatcacgatatcgacgtgcttccagtcggcgttcgtcttggtgtatgagacgttgccggaggaatcgcgcttgccgtcgttgttgttgtagcgttcgacggtaataccggtggtcttgtcgagcacgccgacgtagtgttccttgccgtactcctgcttggtggcgttggaggcggcgaagaaggtccagccagtgttgttggaggcatcgggcttgacgtcgtagctgatggtcacgtcgttcttgcccttgagcagagcgtcgccgttcttggcggtgacgttgagccagaagttcttgctgagcttcgcggccttgccgtccttgccgtcggcgagcgtggcggtgccctgcgtggtgcccgtcgcgttgccgccgtcaaaggtcttatcgccatcatcgaacgtgaagtcggcaagcagatccgggtcggtcggctcggtttcgccggtcacggtcaccttagcggtcacggtgatggcggtggagctgtatagcgtgcggttcttgttggcggtttcattgtccacaaagccaccggtctgcttccagctgttgttcgcgttcgcaccggagttgatgaggtcgtcctcgtcggtcttcgactcgccggcggcgttcgtccacttccaatggttctcgttggcaccgatggtgtcgaccgtgccggtgacggtgtattcgccgggcttggaggtgtcgacgttggaaacgtcccacgtcacgtcgcgcttggcagtgccgtaaccgttggcaagagtgacctgctgcgtcttcggcagcttggcagtgatgtccgtatcggcagcacccttatccaccgtcacatcctcggccttcaggtcggcgttgtcggaagccttggcgtcagccgcgcggatcgcgtcgtactgggccttggtgagcgagaccacgccaccgtgcttggtgttggcggtgaggaagtaatcgtcggccttcaggacgctccacggattctcggaatcgaggttgtcggcttcgagtaggttgtagccgtagcgggcaccggaggcgacagatccatagttgtcgacgaacatgtaccacttgttttcgccgttgaccttgaaaccgttggcaccttcctgcgcgctgccgagcgtgtgtccgatgttggtctggcgcaacacccagcccttggccgggtcggtcgcgtactggccctggtcgttggcacgccaccaatcggcacgatcggtgtattccatgaagatcacgccggaaccggtggtgcggtatgtgcgggaaccgttctgcagcatcgtggtgtcgatggtgttgccacggttgtacttgctgttaggcacgaagacgccgccaaacatgtaggtctcattggtgaagtccttggtggcggcccacagcacgtgagtcaccttcttgccgggctgactgttctcgccatcgtatttggcggagacagaccaatacacaacgaatgcgccgccctgctggttcttcgggttgtccttatcggaaccgttgagctgaccgtcgtcgttgagatcatagaagttcggcacccacgtagcctcaggagcccatgccatgccgatctcggagatggtcttgccggtcacggaatcggtgagcgtctggctcttgttcggattggcagtgtacttgtcggcggtggcggtctccagttccgtcatgtcgttgaagtgaatgagatctttggacgaccacacatgcaacttggtgctgtaacctgtagcccacgtgccccaaccggcattatcgctgccgaacacacgcaaatcggtggccagcacgtagtaggtcttcgactcggggttgtaggcgatgaacggatcgcgcacgccggtggtggattcgttgctcacaagaatcggctcgccgccgttgagcgtgtcccactgggtggcgtcatcaccgcgtgagatgtcgaggtagaccttttcggcgtagcccttgttgttttcgatgaagtggaccatcacgtagccgtaggcgtcatcggccttgacctcggtgacggtgaccttgagctcggcggtcttggcggcgtcagcttcggaagccgctgtaatggtggcggtgccggccttcacgccggtgaccttgccgttggtatccacagtagccacagccggattattggattcccatgtcaccgtaggctcagcgccttcaggggtgacggttgcggacagggatgcggagttgccttccttgagactcagcttgccgtccttcacattggaaccggagatctcgattgcagtaggcgatgcgatgccgagatcggccgcggaaagcgcggagccataaatcgtgagattgtcgagcaaaccggtgaagtattcaccgttgccccagttgcctttgccgatttgcagcacgccacctgagccgccaagaatgctcttgagatcctcgccgttcacgttgctcgccacgaacttcttatcgacatagagcttcgcggtcttgccggagatgacgagatcgacatgcttccaagcatccttcgtaccggtgttcttgtcgatggtggcgatgtcggatgcgcggccgttgagatagcgttccacgcgggtcttgtcggtgcggtcgagcacaccgacgtaggtgggggcgctgccgttcaccgcaccggcggtcggcgcggcaaacacagtccactggccaccggtcgcagccgccttgctgtcatagctgatcgtcacatcatcaagaccgttgagcagtgcactgccatcggacttggtcacgttcagccagaaaccgctgccgagctgggcggccttgccgttgtcgtcatcttttccgttgacgagattcgccgtgccttgcacggtggccttagcgtcaccctgagcactggcgaatgcaccatcgtccgggtcgctattgaaatcgaagccggcaatcgggtcagccgtcgctgtattggccgccgccctgacgttcgcactggtcgtggtcgtctgcaccgcaggcgtcgcgtcgtcggccacggcggtgatcggcatgatcaaccccgcgcccaacgtcgacaccgccgtcaggcaggccgccaatcgtgtaactctcctcactgagtttccttccttgggtccttgcttctttgcaatactgtgatggatcatcgttgcgccatcgcaatatttgttatcgaattgttatcgagtgacacccggtcgctcctttatcgaccgcttctcgctcctgcttccgcttcgccggagcctcttcgttcgccagcgcgacccacttccgcccgaacgacggccaccggaaatccctacgaacgacaccgttcgtgaacaggagcaccgatgtgcaatcgcacaggtttctgtaagcactcacaattctaatgtgagcgttcacctaaatttgagcacgctttgagcgacgacgcgaaagcggtaacgcacatgctgattccttgccatacctgaaatacccggcacccctcttaaaaccggtttcatctccccgaatgaacatttaccccttctcagcaccccacaacaaacaaaatcgcacatcatctgtgtgcaatattggcttgttgagccgcgtggcctgcatgtccgcgttatccagttcacgggatcatgctggtaaatcccgtgaactgaagacatgtgcaatcgcacacgcaaaagattggaatcaagccgaactcgatggccggccatgtgcatttctgtaagtttctggttcacgggattttcagccgaaatcccgtgaaccagaaacggctccgtaccgagcgtatttccgagttgtagggcacgcgcccgggtactcgccactcccagagccgatcaaccacccgaaaatggcggaataccaacgggctctcatcggccgcaacggccaatacttcagccattgccctacaactcggaaaatacacctccacacgggccgatttcgcgattggaggcttacgccgctcaggcctggcgcttgcgctggagggtcagggcgatgccggcggcagcgagcgccacggccacgccgctgaggccgagtacggcggcaccggtcttagacagaccgagcttgttgcccgtcttatcaccagtagcaccagcgtcaatgctcgagccgtcgcccggcttagtcgaatcgctcgagccatcgcccgaatcggaaccgtcgaccttcaccaacgcggcctgcgccttgttcaacgcggcggttgcgtcgtcgacgtccttctgcgaagcgttctcgtcggcataaaccttctcggcggaggccaacgctgcggcgaacgccttccacgaggcggcggtgtagtcggactcgcgcagctgcttggcggacgcgagcgccttggacaagtcggtcttgtcgaccgtaaccgtgtcgtcgaccaccttcactgtcacggaaacggtcttggaggccagctcctcggaagagctcatgtcgaacaccggcataccgtcggcagcccagtgcacgcggcgtacgaacatgtcgcggccggtggcattcacggagccgaggttcttcgtggcataggcgtggaacacgtagatctggttgccatcttcgtcctcgctccacatgccgtgaccggtgccgagctgcatctcaccgttgaacggaccggacttctgaatcgggtagttgagcaccgtccaactggccgggtcggtcaggtcagtaccggaggcatccgctacggccagcccagtggtgtatgtcttacccacgccggaaccggagaacatgaggtacagcttgccgtcgcgcagggtcacgttcggaccttcggctatggcggcgttccacgcatactccggggtgacgatgcgcaccggggagctggtcacatgggccgggtccttcggatccatcgtggcgatgtaggtggcgccgagctgctgccaggcgtagtaggacctgccgtcggcatcctggaaataggtcatgtcgagcgacatgcccactccgccggacgctgtggctgcgagctgcttgttaccgttgagcagcgaggcgtcattgcggtagatcggtgtcggcacagtccagttatcggggtcggccgggtcgaggtcgtgaccgtcggcatcctgcttgagctgcatgtacaccgacttgccgttggaccatgtgttgccgtatccggccatgaacagaatcgtgagcctaccatcaatctcatgaatttctggagcccagaagctgtgcatgatggcattaccctcggagtccttgtcgccagccttgagcagcgacacctccttgttgttgtagccgttcgactgaatcagggcattcgggttgcccggctcgtcggcgagaccggaaatcgtgtcggccatgcggaacggcatgtggggcgaaccatgctgccaagtgacgtcaccttggatgtcattggaagcgatcatcaggaacttggtttcggtgacttccttgccgtcggcctcatgcgtccactgccacttatacaccgatggatcggcgcggtcctcagcgaacggaatctggtattcggtctgcttgacggtgccggtgacagtgtaatcacccaccttcgtcagatctatgccctcagtgttccatgaggaaatcggcagggagccggtagaaccgtcggagtaagtgaggtccacgttcttcggcagttgcgcggtcacctcatcgattgaggcgcccttcttgacggtgatgtcagtgagattgctcgtgccggtgttctcagagcggccgtaacgggtgttgagcgccttcaccgtggcctcgtccaccgcgatggtggcaccggagcggaagttcgcgatgccctgtacaccgtcggcggcgagtacgccggacttggcgacggaaccgtacagtacgctgccgtgcttggatgtggagcccttgagcgaatcgaacgtggtgtacttggccacgccgttgtcatcggcccagccgacaacatactgcttgctggcggtgtcgtacacggcgtacggagcgttgacgccgttggtctcgccaaggtcgacgatggaaccggagttctcctgttcgctataggtgagcaggtcttcggaggtggcgatgagcacgctggacttcgcggtggagtcaccggtggcggtgccgcggttggtacgcacggaaatcacgccataggtgccgtcggccatgcggaacaggctcggatccttgagactgcgatagtcattgccgtcgaggttctcgttgagcttctgcgccttcggcgagcgtgcgaagaaaatgccgtaattctcgttgtacggggtgtacgagccgtcggcgttctgcagcgcgaggtgcatgctgtaggcgacgtcgccgttgttggcctcattctcgccggtggcgttgcgatcgtaggcggcgatggtcgcggacttcgcggcgggcagcacctttacggtgaaggccttggtaatgggctcgatgccggcgagaccgttcttggagaactcgacggtgatggtaccggtcgtggcctcgtcgccatcgatggtgatcttgccatcctcgacggctacgtccttagtggacgtaaccgtgacggtagtgccattcacagccgccgggagggcgtctccggaacgcacgacggacgggatcacgtagccggccgcgacttccttgagctgttcagcggcagttttcgtggtcgggttgaccgtgaccgtgaattccttcgtagcggtctggccacggaccgtgacggcggcggtcagcgtgacagtcttggctgcctcgcccttggcgggctggttgaccgtgccgtcagtcgcgatgacgctgctatcggaggacgcccacgtcacgccgttcgcagtgggcagcgaaatgaacggatcgtcgaccgtcgtggggatgatgatgccgttcagcacggaaccggtgagttcaccggcatgaattgaggcatcggcagtgctgatcgcggcgacctgatcggcggtgagcgcggcatcgtatacgcggaagttcgagaccgcgcccttgaacaggttgtcgggccacggcgaacggccgatggtgttgagcgactggtccttgacgctggacagtttggccggcacggtgccggatgccacctgcgtgccgtcgatgtacagtttcgcggcggtgccatcaatggtggcggtcaccgacaaccattggtcggccttggccacgcaggagctggactgcacgagcgtctccgtaccgcccgatttcaggccgacgagcgggttacgcgaactgccgcagttgagcgtggcgaagaaatactccgtatcggagctgtcgttaccgatgttccacaggaaatggaaagcattgagcatgctggaatccgctttgacctccaactgcaccgtggcggcgtccttgccggacagcagattcgagggcagcttgacccagtcgccggtgccggtcttggcaccgccggaaagggtgagggcatcatcggcccaaagcgagtcggcggagttctgtacttcggccgcgccaagcgtagcgttcggcgcactgttggccacggtcttgccgtcacttggcttcgtggtgaagtcgtaggcggcgatgagattattggtcggaacggtatcggccgcgaccgccgtggtcgcgccgattcccatgccggcgagcgccatcggcactgccagcatcgcgccgagcaggcgtttgcctatcgatggtttggttgtcattggtttcctctttccgcgcggtgatactgcttgtcgcgcaacagatctagatgttgagtggtgaagttcggtaatggctattggagctatggggctatagagcctatgcgtccgacagcgtcgtcggacgaacgtgcgatacgcccctctgatggggccgcgccatgaagcaaacaatccagtaggctgcttgcttcacagctcgactcatccagaaggggcttggtctacgctgcaaacagttcaggcgcggcgcttgcggaaggcgtaggcggcgccggcggcggcgagcagtatgaccgcggtgatacccacaccgaacaccgaggcgccggtgttggacagagcgctgcccggcttggcggcgggcttttgcgtgccgtcatccttgccatcggtcttgccggaatcgccggacttcttgaccagcttgtcgacggcggactggagccgagacagcgccttgtccacttcctgctggtcggtggagctctgcaacacctgcttcgcgtcggcgagcgcggcggcgaaagcatcccaaccagactggtaatcagccttgttatagcccttcaccttatcgacaagcgcctgcaacttggacttgtccagcgtggagccgggctcgccggccttgatggtgaacgttgccgaagcagtaccggagtacttgccagcgccggttacggtcactgtggcggtgccgggttcgatgttgttcgtgtaggccaccgtgtagtcggcgccttccttgagcgtcgcgccatcgagcgtaacggtcacggccggttccttggcagcaccgtctgcggtgaactcgttgggttcggccgtgacgaccgccccggagatgtcagtgccagtcacggtgacggtcgcctcgaccggcatacgggaatcgtcctgggcgacgcccttgacggtgaaagtgccggtcttggcataggaagctgcgtcaatggcatcccactcaactgcaacgtcagaaacggaaccgtccgcatgagtcagatgcgcggtttccggcagcgtcggcgccacaccaaccgtcgtctcggcagacagcgcgtcaacggacttcacagccacagccggagcgtacgcctccagcaccttctgatactgggcgcgggtcacgggcagcacagtgccgtggcgcggcttgccgccatcggaattggtcgggaagttcacctcaggcatcttattgccgataacggtccactgaccgctggcgatatcctcagtcgccatcggcacatagtggtttggaccttgatgatagctcggctggtcggcgaacaggtagtactggtagccgttcacgtcgccatcgttggccttgaatagcgatggaccttcgccggaagtgaaggttttaccgtaaccgttagcctggcctttaccgatgttcgtggcaacttcgctccatgcactacccttaagcgcatcggcgtagttcttcacgccggcaccaccaattgcggcagtcaaatctgtggacttctcctgacgcaaagacatcgtgttttcatctttgtagatgcggtagtaggtatcccctaccttttgcacggtcacatcgatggatccactgcctgcaccacctcggcgatcaacgtcaatccacactgtcgggtcggagaagttgacgaagtcatcggtggtgacgtacaccatgcggttgtaggtcagctgcttgcggctgttctcgtcggtgttgtcgtacaggttcgaggcccaatagaccacgtacttgccgatttcctcgtcgtagtaggcctcaggcgcccaagtgttgcctgcgtaatcagagctcaccttgacgtggctttgcttggaccagttgaccagatcgtcggacttccaaatctcaatgtacttggaaccgttagcctgtgcaccagcaaagccattcagcccgttgaggggagcacgaccgtcaatcttcagatcggtagcaagcatgtagaacttgtcaccatccttggacttcatgatgaacggatcgcgcaaacccttctcgccaaactcggaagtgaacagcggagtgccattgttcagcgtgttccagtcgagcgcatcgttgcccttggaagccgcgaggctgattttctcgccgcccacgccctcgccggtgaagaacgcccacacgtaggcctcgtccttctcttcggcggcaggcatcggctgaatggtgacggtgaaggtcttcgtttcggtggcggtaccgtacttggcaatggctttgagcgtcacagtgacggcatcgctaccggcggcagggcgcttaacagtgaccgttcgagatttgtcgttcacgccttcgcctagtgtggcgatatccttgccaccggtcacttcccacgagatggtcgaaccattgttgcccttggtgggcacggagaagttgctacggatgtcgtcggagtcctcgatggtgacgacgtcaaggtcggccttggcttgctcggcatcggagagctgcttcggcacgaggaccgtgtagtcggcggttttggcgttgttgccaaacgtggcggtgaggatcacctcggcatcagctgcggttgcggccggacgagtgactgtggccttgccggtagcgttgtcaacggcgatggctgcgttgtccgacttccacgcgatgctcacgccagcggcgctggtcggcagcgcgaagtcctcggtagcggatgcgggcacagcggccttgacagcggcctcggccttgtcgagcacctgagcgtcatacagcttggtcacgtctgcggcgctgatggcagtgtcgtatacggcgtaatcgtccacgtcgagcttggagttcgggtcagcgtaggaggacttgccaatgtaggcgacgaggccgccgtaattggtcaggccaccggccggaatggtgtaggtggcgtctccaacctgcttgccgttgaggtagaagctcatggtgctgttggtgccgctgatgacggtggtgtacagagccaaatcgctggtggccttggtgccggtggtggcggcgttcgtcgatccagggccgacttcggtgccccacgggctgttattcgggtcggccgcagtggcattggtcattacggatttcgcgtagccactcgggttggccgggttgagcagccagtagccgttggccggataattgccggtcttggccgcgccgatgtacgcggcggcggtattgccgttgccgtaattgttcttgagccagatggagacggtaacgtccttcttaccggcgatggccgtggtcggcacgctaatggtttgcgagccggtcaggttgatctggccattggccaccgtggcgtcgccggatagggtggcatcgctgttggccgcgctgccctcgttggcgatggtcttggacgtcagtgcgttatcgaatgaatagtggatgatcggactggcatcgattggcgatgcgctctcggcactggccgtcatcggcagcaccagaccagcgagcagtgttgccacgccgaccgtgagtccggttgcctttcgtatcagctttcccatgtttctcctcattgatagggttgattgtggttgcgccttcagttatggagcgaagttttgtggccgccctctgatgagctgagccgtgaagaaaacgccagagtcgtttttaggcgaaggcgaacgacagtgagcaaatatgaagccagctgaaagctggtccttaattgcgttcgaggtggccgccgttaggcagtcgggggagagacctgcggcggcagccgcgggatacagaatcggccgaaggccatgccgttctttcggtggcttcgccgcggtctctcccccagtcagccttcggctgacagccccctcgtcagaggggggcttggttgccgtagcagctcaggcgcgacgcttgcgccagagggttagggagatgccggcgatggcgagtgctaccacggcaccacccaggccgagcacggccgtaccggtattgctcagcgcgctgccgggcttgttgacgttggtcttgtcgccggtggtcggggtagtcggcttattgccgtcgcccttatctccgtcaccttcgcccggattggtcggagccttctgcagggcttcgattgcggtcttaaggtcggctgcggcggtatcgacctcgccctgattctcagcggcgagcgcggccttggcagtcttcagcgcggcggcaagcttggcccaggaatcggccgtgtagtcggattccttgagcgcttcggcggcggcgatctgcttgttgagctcagccaaatcgaccttgccctgttcaatgccgtcaaccgtagtatcggatggattgaccaaaccatcggtgtagccgtcgtaagcaaccgcaacagtgccagagacgctggccgggagggtcacagtggccttgccttcggcgtcgagcttcacggtcttggaccagtcgccagcagagaacttcaccgaaccggcgagcgtgcccttatcggcggaggtcaccgtggcggtgagctcgcgggtgccggcgttgtacacggccttggtggtggagtcaacagcctcgatgtgcgtcgggttggcagcggtccaggacttcgtcaccttgagcacagactcaggcacgttcacgaacgcaccgtgacgcaccttgtccggcagaccgccgttagcaccctgagtgatgtagccctgagcgcccggctcggctttgaccggcttcttttcgttgttgaagtccgggtaacgcttggtcatcgggttgtcccacgtggtcttggaaagctcggcacccgtggtcataaatgcacggtaggcgaagttgtcggacagcagaatgtagccgtcgtcgtccttcgtgttgagttcgtcatccttgttgagcttgatggtctctggtccttcgaacggcagcaacgcctgctcgagcagctgccaaccggtgttcgggtcctgacccggagatgcctcggtggtcggtgcagtcagcaccttggaacgctcaaggaagatgctcttaccagtggtgatgtaatcgccagcggcaccgccctgctcattcttggtgaatcggtagtagtagccaccgatcttacgcacggtggaatcaatgcgcgagtagccggtgtcctgccacatctgcggctcggtgaagttcacgaagtcgcgggtgatggcgtaacgcacctgagcataggagctattgccggttttgtcgttcttgaccggagtggtacgggtgtcatcagtgaacatgcgggaagagaagaacaccacgtaagcgttcaggtcatcatcccagtaagcttccggcgcccaggtcataccggcgttcggcgtgttgatggtgatgccgccgttgccgtcgccgttggtacgggtccagttcatcatatcggtggactcgtagacctcaactttccgagaaccgttaacctggttctggctccagcccattgacgagaccttgagatcagtggcaatcaggtagtacttgtcgccttcgtgggaacgcagcacgaacatgtcacgcaagccacccgtgtctgcatcattggtaagtaccgcctggccattgttgcgagtcttaaacgtgaagaaatcgttcttctcagtggaagccacccaggccttttctccaccgttgctgtcgctctcaaaagtgacggccgcatagccggtgtcaggcgcgatgcgggtcttctccttgacagtgacctcgatggtcttggtgaccttctcaccgccgttgtaggaagcggtggcggtcagcgtaaccggcttggaatcaccgtcgccgtaggccggacgattgatgatgccagcaccacgatacgggtcatcggcaccagtggtcctgttttcgtacttctcgttagtggacgtaatgagcttctcgtccgaggacttccacgtaatcgccgagccgttcttggtgcccttggcgactagcggcagattctcggccgccggaactttcagcgcagcaatcgcggcatcgaggtcggctgcggcggcgttctgggcgttcatcggctcaacggtgacgggcagttcggccttcacaccacccagctcagtggtggcggtgatggtggcagtaccagccttgacgccggttacagtaccgtctgcggcgaccttggccacggactcatcggaggaggaccaggtgacgttcttgctcacggcgtcgtccggagtgacggtggcggtgagcttggtggagtccttctcaatcagggtgagcttgttgttcaccacaccggtaccggaaatcgcaacggcggtcggcatggtcaggtcagcgcccctgtagaccttgatatcatccattgcaccattccagtactcatcgacggagtagaacgacttgccgatgtaggcggtggtcgcaccgagatcgctcatcttgatgccggtgttggccttgaaaatgatcagggcattgttgcggaacacggcaaggttggtgccgtccacgacaatcttgtaatcggcccagctgttgtcgttgccggaaacggtgaccttggatccctgttcgttaccccagttgttgttggagataacgcccttgatggcggtcttgctgttgtagaacatcaggtacttgttggcgttggcctgatcggtggtgttggcgtcgttcgagccgtccttgccgacgatgaacgagaagaacttgccgctgtcgtcgtgacgagtcttggacgcgaactccagagtgaaggagtcgccggcgtccttgaacagctggtcatcgatctgggcgtactggccatcgccgcgcagtgagagcgcctcgttgttgctgcggtcaccgtactgttcgatcttggcaccgtccttcagcgtcaggttgtacttgccggtcgaatcggcaatcgcgctgttcgtggtgccgtttttgcccgtgaagtcccagctggcgagcagcgtcggttcagcagccttagtagtctgcactgtcgcggtatcggttgtctgtggttgggaatcttccgattccatggcatacgtcgtcggaactactgccaccatcgttgatattgcaatcaacgatgctgccatcttcttccaatgcttcaccgcatctctccttgtcctttgcctcgacccacttgtcgggtgtctcgttcgcctctacgtgaacgcaaacattatttgcgatgataccattacggcactgagactcagtgtgccagattccttatgtatataagcacttacagggggcaaccgcccagcccgaacactccccgtatgccaaaagcccccttccaagccaatcactaatacccctcaatcggcaccccgctccgccagccgccccaaactgttatcaatttgttatctttaccgcgcttgcgtggacagagaacgctcagacctcgaagatcgccacatattcgtgagagaacccgcctagtcaatgagatatggattgaaaacacgctcggtaacggggatatggagcatcagcatggtgccgtaaccaaggatcaccagcaggaacagtccaccgggcatgtggaaccagctggccgccagcagtgccacgaacacggcatccacgatgaccagggccacggtcatcgcgatgtgggagatgccgaagatgaaggcgttcttcaaggtgccggccacggtgttctcgaagcgtgcctgaagcgcgaacacccattcgaaaccgataagccagaggatggtcagcgcgaatttgatgatgagcagcggcgtgatctgcaggacgatccatgaccagaccagtgcaatcagcaccaccaagaacggcagccacagcagtgtggctttgatgaagttggctttgaatgacttgaagtagttggcggttacgcctttgccctcgccctcgatggagcggcggcaagcatcatggccggcggtcagggccgcaccgatggtgatgagcggaatcgaagtgaccagcatcagaatgttgatccatacgccgtcaacaagattgctccacgcgcgcatgaatttcgagtccggtgccagccagttcatcaactactcctcgtacagcttttggctcccctcagggaggggagccaaattgtcgggctcaacccttgaccgctccgccttcggccctgcaattacggactcgcctacgacgaggctcatcattagcttcgccgctgtcgcggctcagcctggagcctgctggaagcccactgggcttccagccatgggctgacgacgcgagtcgtcagcccttgacggctcccgccatgacaccagagactatatacttctggcataccaagtagaagacgatgatggggatgatggccagcaccaggcaggccatcatggcgcccatatccacggaaccgtagccgcccttgaggtattgcacggcgaccgagacggtcttgtacttgccgaggtcgagcgtcaggtacggcagcaggtagtcgttccagatccacatggcttcgaggatggccaccgagacgatcgacggcttcataatcggcaccacgatctggaagaagatgcgcggcactgacgcgccgtcgatcatggcggactcctcaagctcctgcgggatgcccttgatcacgccagtgaagatgaacacggccagaccggcaccgaaaccgaggtacacgatgcacaggccccacggggtattgagcttcagcatgtcggcgatcttggagagggtgaacatcaccatctggaacggcacgatcatattgaacaggaacagggtgtagagcagcttcgcggcccagttgttcacgcgcacgatccaccatgcgcacatcgaggtgcacaccagaatcagcgccaccgagccgacggtgataagcagcgtccagccgaaggaggcgaagaactgcgtggtctcgatgccgcgcacatagttctcaagtcccacgaacgccttgccggcaggcagggagaacgcgttcttggagatgtacgccttctgcttgaaggagttgatcagcaccaggacgatcgggaaaatccagaacagggagacaacggcaaacagcacggtccataatgcgccatgcttcacaggcttgttctcgttcatcaggctgccacctccttgctcgtggtgagcttgttctgaatcagggcgatgaccgcgaccaggatgaagaacagcacggccttcgcctggccgacgccttcccagcccatacggccgtagaaggtgcgggtgatgttcagcgccagaccttcagacatgttgctcggcgcaccgttggtcaatgcgaggttctgatcgtagagcttgaaaccgttggtcacggtcaggaaggagcacacggtgatggacggcatcatcagcgggatgatgatgcggaacatggtctgccgtccgttggcgccgtccacggccgcagcctccagcacgtcggtgggcagggcctgcaggccggcgatgtagatgatcatcatgtagccgatctgctgccagcacaccaggatgaccaagccccagaacccgtaggacgccttataggtcagggcgcggccccagtgggccagcacgccgttcaggagcagcagccagatgtagcccaggatgatgccgccgataaggttcggcatgaagaataccgagcggaacagcgtggagcccttgatcgccttggtcagcatgtaggcgatggcgaaggcgatcacgttgatcacgatggtggtcacgatggtgaacgcggtggagaagccgagcgcgtgcaggaattccttgtctttcaacgctttgccatagttcttaagccccacccattcaccgtcggtaacggtggtgaattcgcagaagcttaagtagacgcccatgatgaagggcaccaggaacccgatgatgaatgcggcgaatgtgggaagcgcgaacagcgcccaccatctgcgtatcgccttgccagccatgctgatcatgacttttcctcctccttgagtccgctgcgttgcgacactgcatcgtgcgccggctgcggagttcaactcaatgcgagcttgccgatcgagaaccgcatgcacggcctgttctcgttcaagcctatgttcatagtaaacgtcgaatcattatatgtcaaacgttgtcattttaggcgtttcaagttcgagcatactccggttccagcaatcttctttcacctaagataatggctatataaagccaatctaacgccgacatagacactttgcaaacgtttgtaatacaatcgttgtcatcgccgcagatcaatcaatcagcatgtacactggagtcagttgtgcatgtgtattgcgattttccattcaacgcaagggggctgcaatggctacgagcattcaggatgtcgcccgcgaggccggcgtctccatctccaccgtctcacgttccttcaccaggccggatctggtgtcggccaagacccgcgagcgcgtgctcgccatcgccgacaaactcaatttctcactctcccgctcggctgcggccctgaaatccggccgctccctgcgcatcgcagtactgatgagcggccatatccgcctgtggttcaccgcctcggtcatcgaggggctcaacgaggtgctgcacacgcagggctacgatatttcggtattccagatttccagcatcgaggagcgcaaggaattcttcgagatgttgccggtacgccgtaacgccgatgccgtgattgtggcgtctttcgatatcgacaacaacgaaatcgcgcaactggcttcggtcggcgtgccgatcgtcggcatcaattcagtcgaacccgaagcccgcggctttaccgccgccgtcaatatcgacgatgtgcagggctccacgctggccgcccgccatcttatcaatctcggacatcgccgcatcacctacatcagcaccaatcgcgaggtgtcgctgagcttctccgtgcaaagccgattcgactcattcaccgcctgctgccgcagggaaggcatcgagccgcaggttatcgtctgcaaggtcgatgacgatggacgttatgaaatcagcgacgtggtcaaccaactcataagccaagacgagatgcccaccgccatcgcatgccaagaggacggcattgctttgccgcttatgttccagctggagcgcaatggattctccgtgcccggcgacgtctcgttgatcggctacgacgatagtttctacaccggcgatatcggcctgaccaccatccgccaggatccggtggaaatggcccgcgtggcagcccgcatgacgctcgatctcattgacgaaaagccgattgagcaaccctacatcgtgttcccggcccagctgaaggtccgctcctccacctcccgcgttaagtaggctcacacaacaaagcccaccatagaaaaagtgtgaggcaaccgcacaataacgctcaatcgcacattgtgggaaatggcgaaaaatcgccaatctatggacacacagtgtgtgattgagcgggtgcgtgcctcacacttttttgcggcggacgattttgtgcgagactcagcaatacaaagcggcgcccccggagaaggaaatggcaggggcgccgcggattgttacttatcggctatgggactctatgagactcagtgcgaagcctcgtattcggaagcccaaccgtccacgaaggcggtcttgacggcatcccacttgccggtgccctgcgcgtactcgagcagtgcctggccgaccttgttcttccactcttcggacggcatcatggtgaagttccaagaaacctgggtcttgccggacttctgatcctcaacagcggcttcagtcagcgggttgtcaaacttgacatcatcgaaggtcttgaacggggtggtgaagcccatgtcctgagagatggccttcttgccggtgtcggaggtgatcacccaggagaggaagtcctcggtggccttcttgtcggcgtcggaggccttgtcgttgatgcaccagtagttctcggaaccagtggccaagccctgcttctcttcacccttgacaccggtgtagattggcatcatgcccacggattcggccttcatgccggccttctgcaggtcggtccaagcccaggtgccgttctgatagaaggcagcctcgccgagcgcgaactcggagttcgcatcatcgccggtcttggcgctcagctgggtggggtcggtggtggagtcggtgatgtacaggtcgaagatcttcttgtagttcggcagataagtgcccttgatggtggccggctgctcggtgacgttgtcgtccttgaactcatagtagagcggcaggttggccagatgggtcttgaatcgccagtcggagctggagtcgaagccggcggaggtgaacgcgcccttgatgccaagctcgtccttgcgggactgcatgtcgtcagccacggccttcagggtgtcgaagttgtcgatttcgtccatggacgtggctttggcaccatccagcgcgaagtatttgttaaggatgtccttgttgtagatcaggccgtaggtttccatcacgtacggcacaccgaccaccttgtcgccgtctttcagggccacgtcctggttggtgagttccttatacacatccgtgttggacatgtcggcggtgtacttcttccagttctggtagccgaccgggccgttcacctggaacagggtcggggcctcggtcttggcaatctcggacttcagggtctgctcgtaggtgccggaggccgcggtctggaccttgacatcaacgcccttctccttggtgtactccttggccagagcggcccactgatcagccgcttccggcttgaagttcaggtagtagaccttgcccttggagtcgtcgccggaagtggagcttccacaagcggcaagggttccgagggacattgcagcgatggccgccactgcgaccgctgacttcactgtacgattcatcatcgaacctttctctttcatcgtcgacccggccatccccggtcaggacaggtacgctaacacgcacctttatgactatcgacatgcactattgtgcaacggtttgcttctttttgcaaacgatagcaatatcggcgcgtcataaatcatcattttcaggccattgtcaacaaatatcccattaattcggtcatttttgcctcattatcgcaatgcaagcgttcgcaattatgagagcgctaacatatctttcatggcaatcgattgccacttatacccatcaaaaaaacaacacggcgacgctatcgtttgcaaatcatttatcgacataccgcaattcccaccacaaacaataaaggcccgcccgcagcagcaggcaggccagcgtaatcacagcgcaaccggggctaggcgttccaccgttcgatgacgttatctcccttatagacgctgagcaccgagtagtgcgccgtatccaaacgcagcaaccgcgcgaaatgcgggtccacgcccagccattgcgaggtgaggatgcgcaggatgtgcgcatgagccaccaacagcacattatggccgtctttcagcagcggcgtaatctcatcgatggcgctcttggcgcgtaccgctgcttcttccagcgtctcgccaggcccggcatggaccggcacctgctcgcccgaaggtaaggtctcgacccaatcgccctccagcgtgggcgtcagcgagcgcggcccgtcacgccacacatcccattcaaaaccgctggcctcactcacctgctggcgcgtacgcccctcggctcggccgtaatcccattcagcgatgccgtccaacacaccgtggcccgcaaaaccggccagttcagcggtttggcacgcccgcttcagcggactggaaaacacacagccctggctgaatccttcggggaaagcttcgcgcaggcgccttccggcatccgctgcctgctgctcgccgaccgcagtcaacgggatgttcgtgcgcccggtatgctgcccggattcgctccacacggtctggccgtggcgcagcaacaccaaaaatccgttgccgccacgagagttctcgacggcaacggtgccgttcacgttctgttcgctcatgcctccactctagtctgcgctcgttcatgactccaccattaacgcccatcttttgcgctgagatgattgagatgctattagactgagagtcatgagcgacgaaacgaacaccgacttcccctccagcgccgaccgtgcggtcgacagcctgcaccgcatcgacgagaaggtcaacaggctgcgcgaggaccggctcaacgaccctgattctctgggcgacaagctcatcaagtcggcagtcccagcgctggcaggcttggttgccggcaaagcattccagatgatatgggacaagggcacaagcaaacgcaatctgcgcaagggactggcggcagacgcgccgcaaagtctggcaatgagtctgacattcgccgccgtttcggccgcactcggcgcagtggtttcgcagctgtcggatcggggctccaaggcgttcgtcgaccaccgccatcgcaagcccagccgctaatcccccggttggatgatggtttctgttggctgactgatgactcatcgctggaatttcgtcaaggaaccatcagtcaatcgacaggaaccatcagtccagcacagttccgccacacaatatcggcatttcactgtgaggtaatccaccgtggcgtccggcgtctgccgtgcgacaataaagccatggttaccaacgcaacaatcgaggctcttctgggccgccgctccatccgtaagttcaaggacgaggccatcgacgacgatacccgcgccacgctcgaaaccgtcgcccaacatgccgcgtccagccagttccttaacgactggtccgccatccgtatcaccgacccggccaccaaagccaagctcgccgaattcggccatcagccgtatatcgccaccgcgccgttgctgtacgtgttcgtcatcgacgagcaccgcaacgcacgcatcgccgaacgcaagggtatcgatcccgcttccgacgaattccatctcaagtacagctatcgcttcacccaagctcagaacgacgcagtgctggccctgcacgccatggagaccgccgcctattcgctgggactgggctgcgtgattctcggctctctgctcaacaacatccccggccttatcgacgtgctgaatctgccggaatacacgtatccggtgctgggtctggccatcggcaagcccgatcagaacccgaccgtcaagccgcgcatgccgcgcacgatgcagttcttcgagaacacctacccggctgacgccgatggcgtactcgaccagctgcccgccttcgacgaggaagttcaccggtactacgatctgcgccaagccgaccgtccggtggacgccttcagcgatcaggtcgccacgatcagtcggcaggatgtcagccatcagacactgctcgacaaggccgccgctcagggcttccgtctggatcagtgagaccagaaccaacgagatagcctcggataggctcgtcactgagtcgtctcggtctcagcactgcgacgactcagttccaacacctcaacatttcatcaccggataccggcaaaattgcacaaccatcccgccggtgtcgcaccatcaacaaacgttcacatatcagtcccattatgcggacaaccaacggccagttttgcaagaaaacccgccaaaccagcagtattcgcaccagtggtgggaatagactgcatgtggccgcaatgactacgaaccggaaaagagggactggatgcggacagtttggcaagtctttctacgcgattgcagacgtatcttacgcaatcccgttgccgttgtggtgacgctcggcgtagcaatgctgccctcgctgtacgcatggttcaacattctcgccaactgggatccctattcagccaccggcaatctgcaagtggccgtagccaatgaagaccaaggcaccaccaacgatctggtcggccatctcgatgcgggccggcaggtcgtcaagaaactcaagcagaacgacgaactcggctggcgcttcgtagacaatgaggaacaggccgtccacggcgtggagaccggcggatactatgcagccatcgtgctgcccaaggatttcagcgccagcttggtcgaatcggtgaccggaacctccaaacagccgaaaatcaagtattacgtcaacgagaagaagaacgcgatcgcgccgaaaatcaccgacaccggcgccaccaccatcgatgagcagatcaactccgccttcgtcaccacggtagccaccaccgttgcctcggccgtttccgaagcgggagacgatctcgaccaagtcaccggcaaagtccagcacgatacgatcgatgatctcaatacggtgatgtccacgctgaacaccgttcaggattcactcaccgacttacaggacacgctggcccaatcagacacgattctcgccgacgccaaacagaccaccgcctcactcaagcagaccgtcgcggccgcgcagaatgcctcccgccagtccggcacactgttggcggaaacacaggccgggtcacaagccttctccaccacactggtcggcgcgctcgacagcagttcagcacaactctccggactggccgtccacgtcaacaacgccgccggcagcatcaccggttccttcaacagcgcgcagaactccgtcgacaccatcaccaacacactttcggccccactgaacgccacccaaacgtcaatcagcgatctgaaagacgcgctgaccaaagccggcatcggcaaagacaccaccgacccggtcggccagaacatctggaaacaaatcgatgcgctcgactcattgatcagcaaacagcagacacagctcaacaccttccataccgacaccacacagttcatcaactccggcaaagacgccaccacgaacctttccggagccatgaccaacaccaccaccggcggcatcgcggcgctgaataccgcgcgcggctcgctgaccggcaccgtgatgccgtcgctcacctcatcattgaacagtttcgccgccctgaacggcacgctggatggcacgttgacttcgttgtccggcaccttggatcaggccgacgggctgttcgaccagcttgtcgataccctgaaccaaacaaaaaccaccatcagcagcacgcaggattcgctgcgccaggtggccagcgatgtcgccaccgtacgcaccgatatcgccacgctcgatagttccgccgcttaccagaaaatccgggatacgctgcatctggatgacaagggattcggcgacttcatgggcaatcccgtcaccctgaccacgaaagtcgtgtatgccaccgacaattacgggtccgcagtcaccccgttctacacgaatctggcactgtgggtaggcggtttcgtgctaatcgccatctacaagcttgaggtcgaccgcgagggcattcgccgtatcaccgctacgcaagcatatcttggccgctggctgctgctggtcaccatcggattcctgcaagccgtcatcgccaccatcggcgatctggtgcttggcatccaatgcgagcatccgctgctgttcatcttggccgggatcttctgttcgttcgtatacatcaacattatttacgcactggccgtggcgttccgccatatcggcaaagccatcgccgtaattctggtcattgtgcagatacccggcgcctccggcctgtatccgattgaaatgatgccgaacttcttccgcgaactgcacccgtggctgccctttacctacggcatcaacgcgatgcgcggcccgattgccggcctgtacgcgaaccattactggctcgacatgctgcacctgttctggtatctgccggcggcactcttcgtgggacttgtcatacgccggtatgcgatgaacctgaacgcgctgttcgaccgtcgtttgggagataccgacctgatgatcaccgagcacaacagcatggtgaacgaacaggtgagcttgaactccgtattccgcacggtgtccgacagcaaggaactgcgcgatatcatcgcccatcgcgcgcaccggttcttcgcacggtatccaaagatgatcgttgccggtctggcattgctgaccgtactcccgttcgtattcctggtgctgctgttcgtcacccaagagaaaatcgccatgctgacctcctggattctgtcgattattcttatcgacgcctatctcattgtggttgaatacgcacgcgaaacctacgccatgcagcttggcgtcagtgccatgagtgccgacgagttccgcaatgtgatgctcaacggatatgtgtggcggcgtttccacggccacggacgtcacgaagcggcgatgggcagcaatccggatatcggcgaaaccactgaacgactcacactgttcggcgatcaggccgccgagccgactgcgcacaccgcacagtccggtcagtctgggcagtctgggcagtctgggcagtctgggcaaggaggcgcacgatgaagcttatctggaaaatattcgtacgtgacgtgcgccaagccacccgcaatgtgatcgccgtaatcgtggctatgggattggtgattgtgccggcactgtacgcctggtacaacatcgccgccagctgggacccgtacggcaacaccaaggccttgaaggtcgccgtggcaaacgtggataagggctataagtccggtctgatgccgatcaccatcaacgtcggcgaaaccgtgaccagtacgctcagggccaatcatgaccttgactggcagtttgtggatcgtgctaaggccatcgatggcgtgaactcaggcgaatactatgccgcgctgattattccaaagagcttcagctccgatatgatgacgctgttttcaccgaagatcaagcacgccaagctcgaatactatctcaatgagaaaatcaatccgatcgctccgcatatcaccgaccagggtgctaccaccgtggccacgaccatcgaccagacatttgtgaagaccttggcgagcgtggcgctggatttggtttccaacgtggccgattacgcgcaaagcccgcaaatggagcagtacgtcaacaacgcctccagtcatattgccaccatgtcgtctcgtttgaccggcactgcgtcgcagatggattcctatgccaatctgctcggggccgccaacagcatcattgattccaccgataagctgctgggatcaacaggctcagctgcggccacaaccaaaaaggcgttgaaacagacccgcaacggcgtctccagcctcgacaaggcattgtccggagccaccgatggcgtcggtacggcattgcagcaggccggttcatcctacgacaccattgccaagcaaatcgatgccgcttttgccgatgtgggctcacaatcctcacagatatcaaacaagctaaccgatatgcaatccaaagtggaggctcaggccgacagctttggaaagtatgccgccgctttacgagatctcgccaaacaagcggcttcactgcccgtgggcggagataccgttgccgctcaactgaacgcggctgcagaccaagccacaaaggcgcagcagagcatgcagcaagccgccaccgcgttgggcgatgcggccacgcacatagcaaacggtactgccgatgccgatacagcgcgtcgagatctgaaatcacaaatcgctgccgccaaacaatcgattactcaggcttcagacacgtacaagagcacgctgaaaccgcaactgaacaatctgacctcgtccatggacgaagtgaccacgcaggcaagttccgtaatcgacgggcttgcatcgaccgtaagcagcgtgtcaggtctttctggcggcgtttcagacagcctgacggacatccagtcggccttgactgacgcagctagcgctttgacccgttcggcgaagaaactcgacaacttgtcttcccaactcgcctctatcaccaatggcggcaccatcgacctgtctgcgatttcctctgcgaagcccgatgccattgcttccatgctggcggcacccgtagcggtcgaccgcatcgcgctctatcccgttgccaactatggttccgcgatggctccgttctacacgattttgtctatttgggtcggtgcgatcattctggtcgccatgttgaaagtatcgatttccgaccatgagaaggctcgtatcttagggttgggcaatgatctgccgctcggttcggaagtgggtcttcgcgaggccatgattgccgggcggattgccggaccggccgccgcgttggatgtgctgaagaagccgcgtgccgaggctcccggcaatgcgcggcagttcggtttacgcttgcaccacgaatatttcggccgatacatgattttcggtttccttgctttgctgcaaggtacgctggtgtgcctgggcgatatgttctatctcggcgtgcagtgtgagcatccgattcagttcttgatggtcgggtggttgtctgcactggtgttctcgaatattgtgtatacgctgaccctgtcgttcggtgatatcggcaaagccattgccgtagtactgctggttatgcaggtagccggttccggcggcacattccccattgaaacactgccgacgttcttccaggtcgtttctaaatggctactgttcccctatgcggtggatgcgatgcattcggccatggcaggctcattcggcatggaatactgggtttccatgggcaaactggcactgttccttgtcccctcattgctgttgggacttatgttgcgcaagccggtaattcgcttcaacgattgggttatccgcaaccttgaaaacaccaaggtgatgtaagtgttggacgaagtgtgtccgagcgccctgaacgcttagcagcctacgacctgacgtgtttggaccgtaacctgtctcagacacggcgttggcgaggtctgtggagcttctgacgctaacgtctacgtggcttgtagccctttttacgactgtgtggcttgagttgctggttcagcggtacatgccggtaactggattgcggatcgcgatgcgtgagatgccagcatccgcaaaattcgcaacggtacacccatagctcaactccgcgctcgattaggctttgatcagcggcacgctgaacctgcgccttatcgtgatacatgattttattcgacgtagcgcaacgtttaggggtgaagtaatgcatagcagaagccagtgtagagcgaccccataaccaagccagttggcagattctagtggtggttgcaacacctgaggtttgagcggccttccatggtcacgttgtcggttgttgaggttatcacgcggcgtcgagcagttcgatgatcttctcgcttggtttcatgaacccgagggttttgcgtggccggtcgttgagttcctcggcgaccgcgtcgaggtagtcctccgggtagacggataggtcggtgcctttggggaagtactggcgcaggagcccgttggtgttctcgttggtgccgcgctgccacggggagtgcgggtcgcagaagtagacggccatgtccagcgaggcgccgatccgtttgtgcagggcgagttccgctccctggtcccaggtcaggctgttgcgcaggagtttgggcaggtgctgcatcttgtcgatgatgtgttttgcttcaatgtttgttcgacaggttcggcagtgtttttccgtagtgtgggctgatggttttccccggtgtcgtcatcgtttcccggtgatgtgataggcatcggtgccgccgcctgtatattcccgagttgccaatcggttttgattcggccggttgccgccggccggcgctcgggaaggaaaggaacatggcgataccgatgcccattgtgcaagatatcaggagactcgaccggcagggaatgtcgcgcgcgcagatagcgcggcgtcttcacgtggatcgcgggacggtcgcgaagtacgcggatatggaggattgctcgcccaagccgaaggcggatcgcaggtacgggtcgaagatcgacccgtacgcgcatctggtggacgagtggctggaggccgatcgtctgctgcccaggaagcagcggcacacgatcaggcgcgtgcacgaccgtctgctggcggagacggattacgacggcgagtattcgaccacgatgcgttacgtgcaccggtggcgcgaggcgaaccgcggcgtgccggatcgcgaggggtacgtgcggctcgagtgggcggcgggcagcatgcaggtcgatttcggcgtggcccgggcccggatcgctggcgagatggcggacgtgcattgcctggtggtctcgttgccgtattcgaacatgcggttgtgcgtggcgttgccgggcgagaacgcggagtgtctgtgccatggcctgatgctcgtgttcgagcatatcgggggtgttcctcccgtgatcgtgatggacaacgcgaccggtgccggccggcgcaacgcgaagggcgaggtcgcgttgaccggggtgttctccgcgttcgtggcgcattaccggctcgaggtccggttctgcaacccgtattcgggcaacgagaagggcagcgtggagaacgcggtcgggtttttgcggcgcaatctcatggtgccgcccatgcgcgcggaatcgtatgggcagttgagccgtctcctgctggagcggtgcgacgggctcgccagggactcgtattgcccgaggttgctggacgtgcccgtggccgaggtgttcgacgaggagagggccgcgttgatgccgttgccgtccacggcgttcgacccggttcgctgggaaagccggacggccgacaagtacgggctggtcgacatcgactcgaaccggtacctcgccggccccgattcggcgcgttccagggtattggccgcgatccggtgggacacggtcacgctcacctcgcccgccaccggcgagctcttcgcggagtatcccagacagtacggacggtcgcgcaatgtggaggatcccgcgctcgtgcttccccggctcgcggtcaaaccccgcgcgtggcgggaaagctcgatccgcccggacgtgcccgacgatatacgcgcgtggcttgattccatggacgaaaagacgttgagggagagcctcaaagcgatcggggacgcgtgccgggcggccgggttcgatcccgcgatgcaggcgtgcggcgagatcctgcgctcgaacagggacatgggcctgcacgcggactcgctcacccctatcgcgttgcgcatgcgcgacggcgagtgggaataccccggcgggatcgaggagcccgacctgagcggctacgaccggttcatcaccggcacggacgacggaggggaagaacggtgagcgtcagacccgatccggtgatcccggagacccgccgccgtcgcgcgtccacgaccgagaagagcgagaggatcctgaagatgagccgcagcctgaccctgacacgcagcgtgctcgcgggcacgctcgccgaggccacgcccaaccagctcgacttcatcgaacgatggttcacggccgaactcgactcgcgcgagcgatccaaacgcctgcgcctgctcaaacaggccggcttccccgccgacaagaccctcgacggctatgactggaccaacctgaagatgcccgccgactgggggcgcgcgcagctcgagaacctcgacttcgtcgccggatgcgaggacctcgtgctctacgggcccgtcggcaccggcaagagccacctggccatcgcgatcggacggctcgcctgcgagcggggcgtcccggtgcgcttcttcaccgcgaccggactgctcatgcgtctgcgccgcgcccagcaggagaaccggctcgaccgggaactcgcgagcatcggcaaggcccgacttctcatcatcgacgagttcggctacctgcccatagacgaggagggcagcaggctcctcttccagatcatttccgattcctacgagacaaggagcatcatctacaccaccaacatcgaattcagcggatggggacgcgtgctcggcgacaagaacatggccgccgccctcatcgaccgcaccgtccaccacggacggctcatcagattcgagggccgctcctaccgaagcgaacacgccctcatgaccaaataaccaacacaacgcagacaggcagcggccgataccgcacaccctgcggaaaacccgctgcctacactgcggaaaaacaccgctcacaaagcggacgccaacttgctaaaacacagatgatggcctgctggacgtgttcggcgtcgtgcccgtcgggcaggtgcagcaggatcgtgaacctggtggtgcgctcgacgagcgtgccgatggcgcttttgttgcggctgccggtgatgagatcgccctcccagtggcccgggaccgcccggtcctcgatctccgggggtcgctccgagatcatggccatgggttcgcggaaacggggtttgcggccttggccgccttggggtctgcgggcggttcgcccctgcctcatggcgcgtttcagctcctgcttgagttcgcccctggcctgcaggtagatggcctggtagatcgtctcgacgctcgcgtgcatatccccattatccgggaagtccagcctcagccggttggctatctgctccgggctccaatgcctgcgcaacccggcggcgatctcgtcccacagtcgcgtgccctcggccgccttgcgcggtttggggcgtttgagccggtccgcggccttctgctgggcgcggtaaggctcgtaaccgccggactcgggattcctgttgcgctcgacctcgcggctgaccgtgccggggtcgcggcccagcaggcgggcgatggcgcggatcgaatcgcccagacgcagacggtccgcgatctggatgcgctcctcctggctcaggtagcgcggatggagggtcttgggtttgtccatggtggaacgataccagtccaccaggggtttctcgttccttcccgtggcgcgcgtcctgccgttgcgccacgccttgccggtgcgtttcgagacgccgaccgcgtgcgcggcctgggtgaagttcatgccttcctcgtccagcaggcgcacgtactcggcgcgtctcgcctcgcacatcagcttcctcgtcggatattcgacgccgttgaacgtccaacggtgttccccgccacggtcttcgtttcggtggcttctggtcacctgaccctccttgcggtaggtcaggtgttgcaacgatcactagaacccaccgtttctggctcccctcaggggggggagccgtccgcacagcagaccgggggaggaggcccgggcgtcgggattccacggtcacggacgtgctgttttccggatttcctgcggaaatgggaacgcgccgcgccgtctctcttcggccccgacggcggggccggccgggaatggtcccggacgtgggtctcatgagtgcgagaagccccgggtgtttttgtggggtgtgtgggtttgggtcgtgagtgtttcgggtatgcgaaagccccttggggcgtgtgctccaaggggcttcctgtacgtgtggtgcggcggcgtgctactctcccacaccctgtcgggtgcagtaccatcgccgtgccaggccttagcttccgggttcggaatgggaccgggcgtctcacctgggccatggccgccgcaaatcttctcttatacggtcagacgctggggtctgccggcctgtggcggcctgggaaccggacagcggacgcggatatgtcgatgtttcgtcttgtggccagacaatgctcattgccgtctggtgtcgtttgcaggaggaagatgcggtccaaccgccaggggttggaatgttagtgttgcctttcgtccgttagtaccggtcggctccacccctcgcggggcttccacgtccggcctatcgaccacgtgttctgcatggggactacaggaactcgaaggttccacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcagcattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatgactgttcgaggttagacatccaatgcgaacagagcggtatttcaccttacggctccgcgcgatctggcgaccgcgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctacccctggtctgtgccaccccaaaagctcccacagcaagtgtgttcaccatcgggggtctcccttaaaccgaaggaacgggagtgatttgccgagttccttgaccaggattcgctcgatcgctttggtattctctacctgaccaccagtgtcggtttggggtacgggcggctttgagcctgacgccgaagcttttctcggcagccgggatcaccggatatcgggccataaggcccccatcatcgcacctcggacccatgcgggacggatttgcctgtcccacgccctgcgtgcttgaccacggaagaccacctccgcggccggctacccttctgcgtcactcctgcgctgacctactacaaggatcggtcccaacaggccagggcatcccgcccccgaaggagcagtaagcccggacccggaggttagtactccaagcctcggttttggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctctcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaagggtggctgcttctgagccaacctcctggctgtctatgcgactccacatcctttcccacttagcacacgcttcgggaccttagacgacggtctgggctgtttccctttcgacgacgaagcttatcccccgccgactcactgccgggatacgcgtcaccggtattcggagtttggttgctgttggtacccgatacgggcccgcaagcatccagtagctctacccccgggacgtaatgacccgacgctgcacccaaatgcatttcggagagaaccagctatcacggaatttgattggcctttcacccctagccccaagtcatcccccggttttcaacccaggtgggttcggtcctccacgcggtcttacccgcgcttcaacctgctcagggctagatcatcccgcttcgggtccaggacacgcgactcaaacgccttttaagactcgccttcgctacgcataccccacacgggttatgctcgccacatgccactgactcgcagactcatttttcgataggcacgccgtcaccccacaaaagggctccgacggattgtaggcgcacggtttcagagactgtttcactcccctcccggggtacttttcacctttccctcacggtactcgttcgctatcggtcagacaggaatattcaggcttacccaacggtctgggcggattcgcacggggttccacgggacccgtgctacttgggagacgcgatcggcagaccatgcgcgttcaggtacggggccctcaccctctgcggcccggtattcaacccggttcccctgacacatggttttctgcaactgccggccggcccgtcggagccggcgcacgcgatcccgcaacaccccgcgcgcaacccccgacgggtatcacacgcgcaaggtttggccatcatccgctttcgctcgccactactcacggaatatcctttcctgcaggtactgagatgtttcacttccctgcgtacccccggccgaagccggtaccgacccatgacggtcggtgggttccccattcggaaatcctcggatcaaagccctgttggcggctccccgaggcatatcgcagcctcaaacgtccttcatcggtcctgtctgccaaggcatccaccatacgcccttgcaagcaacacacaccacgaaagtgcatggccgcaagattcctctagcaaattcccagacgacaaatcatcacactaaaaatgatcacaaaacgatcgaaacgaacaatagagttcgattcgaaatcaacagcaaaacaaagattcaaaaactcttgttttgctcgcgtccactatccagttctcaagccaccacgcaccgccacgccatcgcgccggcacacggccggcccccaggcacgacgggcatcgaatcgcgccaggcaaaaagcctggggtggcgatccgggagcccaaaagcgcatccataccaccccggcacccaccgcacgaccggcagggcaaagccaacgacgtcttccacaccagcaaccccgccgccatcgcaccatgcgacgcgcggggcgcacaccgtcggacgaacatccgactgaattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcataatccgctggcaacacggggcgagggttgcgctcgttgcgggacttaacccaacatctcacgacacgagctgacgacgaccatgcaccacctgtgaacccgccccgaagggaagccgtatctctacgaccgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactctcgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggaacatccggcattaccacccgtttccaggagctattccggtgtatggggcaggtcggtcacgcattactcacccgttcgccactctcaccaccaagcaagcttgatggatcccgttcgacttgcatgtgttaagcacgccgccagcgttcatcctgagccagaatcgaaccctccacaaaaaaacttcatgaaaagcatccgaatagatgactctcaaaacaaaaaattgacgagcacgtccttaaggaaggacgccctcaaaaaacctcacccctcatcaaaccctcccgggtacccaaccaccacgacaggcaatcaggcgaggaatgaactggcaatcattgactataaagaagtagtacaaacacgctcttgagttctcaaaccaccaccactcacccacctcgcagctccccggaggagaaccactcgctgagcggcagcaaggaaataacttacacgcattcacggactcgcgcaaatcgggcgcacgaagataagcccaaatcgttgaaacgacaggcttcgctcggcgtgtcgaaatcgacgtttcgcacgtctatatcttcagtctagaactagatatcgtcgaaaattggattgaaaattttggtcgatgggcgtgtcgcgaattacctcttacggcgcatgtggtgcaccgccaattatcggaatcatcattgatccagtacaccgataagaaccattatgttcggattactatatgctcgccagtcgtgcgccaatcaaccgcctggtagcgatgcggttgccgtatcgcttgccttggcacgaccaacgaccgaatggcatcagcacattcagaaccgccggtccgatccatgcatcgcagcacagatcagtcgtggtcccacgggtatggggaggccccgttgccgtgtgggtgccggaggtgtcctgtttgtgtccgggcatgcgagaagccccgggtgtttttgtggggtgtgtgggtttgggtcgtgagtgtttcgggtatgcgaaagccccttggggcgtgtgctccaaggggcttcctgtacgtgtggtgcggcggcgtgctactctcccacaccctgtcgggtgcagtaccatcgccgtgccaggccttagcttccgggttcggaatgggaccgggcgtctcacctgggccatggccgccgcaaatcttctcttatacggtcagacgctggggtctgccggcctgtggcggcctgggaaccggacagcggacgcggatatgtcgatgtttcgtcttgtggccagacaatgctcattgccgtctggtgtcgtttgcaggaggaagatgcggtccaaccgccaggggttggaatgttagtgttgcctttcgtccgttagtaccggtcggctccacccctcgcggggcttccacgtccggcctatcgaccacgtgttctgcatggggactacaggaactcgaaggttccacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcagcattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatgactgttcgaggttagacatccaatgcgaacagagcggtatttcaccttacggctccgcgcgatctggcgaccgcgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctcccacagcaagtgtgttcaccatcgggggtctcccttaaaccgaaggaacgggagtgatttgccgagttccttgaccaggattcgctcgatcgctttggtattctctacctgaccaccagtgtcggtttggggtacgggcggctttgagcctgacgccgaagcttttctcggcagccgggatcaccggatatcgggccataaggcccccatcatcgcacctcggacccatgcgggacggatttgcctgtcccacgccctgcgtgcttgaccacggaagaccacctccgcggccggctacccttctgcgtcactcctgcgctgacctactacaaggatcggtcccaacaggccagggcatcccgcccccgaaggagcagtaagcccggacccggaggttagtactccaagcctcggttttggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctctcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaagggtggctgcttctgagccaacctcctggctgtctatgcgactccacatcctttcccacttagcacacgcttcgggaccttagacgacggtctgggctgtttccctttcgacgacgaagcttatcccccgccgactcactgccgggatacgcgtcaccggtattcggagtttggttgctgttggtacccgatacgggcccgcaagcatccagtagctctacccccgggacgtaatgacccgacgctgcacccaaatgcatttcggagagaaccagctatcacggaatttgattggcctttcacccctagccccaagtcatccccccggttttcaacccaggtgggttcggtcctccacgcggtcttacccgcgcttcaacctgctcagggctagatcatcccgcttcgggtccaggacacgcgactcaaacgccttttaagactcgccttcgctacgcataccccacacgggttatgctcgccacatgccactgactcgcagactcatttttcgataggcacgccgtcaccccacaaaagggctccgacggattgtaggcgcacggtttcagagactgtttcactcccctcccggggtacttttcacctttccctcacggtactcgttcgctatcggtcagacaggaatattcaggcttacccaacggtctgggcggattcgcacggggttccacgggacccgtgctacttgggagacgcgatcggcagaccatgcgcgttcaggtacggggccctcaccctctgcggcccggtattcaacccggttcccctgacacatggttttctgcaactgccggccggcccgtcggagccggcgcacgcgatcccgcaacaccccgcgcgcaacccccgacgggtatcacacgcgcaaggtttggccatcatccgctttcgctcgccactactcacggaatatcctttcctgcaggtactgagatgtttcacttccctgcgtaccccccggccgaagccggtaccgacccatgacggtcggtgggttcccccattcggaaatcctcggatcaaagccctgttggcggctccccgaggcatatcgcagcctcaaacgtccttcatcggtcctgtctgccaaggcatccaccatacgcccttgcaagcaacacacaccacgaaagtgcatggccgcaagattcctctagcaaattcccagacgacaaatcatcacactaaaaatgatcacaaaacgatcgaaacgaacaatagagttcgattcgaaatcaacagcaaaacaaagattcaaaaactcttgttttgctcgcgtccactatccagttctcaagccaccacgcaccgccacgccatcgcgccggcacacggccggcccccaggcacgacgggcatcgaatcgcgccaggcaaaaagcctggggtggcgatccgggagcccaaaagcgcatccataccaccccggcacccaccgcacgaccggcagggcaaagccaacgacgtcttccacaccagcaaccccgccgccatcgcaccatgcgacgcgcggggcgcacaccgtcggacgaacatccgactgaattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcataatccgctggcaacacggggcgagggttgcgctcgttgcgggacttaacccaacatctcacgacacgagctgacgacgaccatgcaccacctgtgaacccgccccgaagggaagccgtatctctacgaccgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactctcgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggaacatccggcattaccacccgtttccaggagctattccggtgtatggggcaggtcggtcacgcattactcacccgttcgccactctcaccaccaagcaagcttgatggatcccgttcgacttgcatgtgttaagcacgccgccagcgttcatcctgagccagaatcgaaccctccacaaaaaaacttcatgaaaagcatccgaatagatgactctcaaaacaaaaaattgacgagcacgtccttaaggaaggacgccctcaaaaaacctcacccctcatcaaaccctcccgggtacccaaccaccacgacaggcaatcaggcgaggaatgaactggcaatcattgactataaagaagtagtacaaacacgctcttgagttctcaaaccaccaccacaccagccagacgggaaaccaaccagaggaaggaacccgccgcgctgagcggcaacaggtgaataacttacacgcatgtccggattcacgcaaatcaaggcgcacaaaaaccccaggaatcggcataacagcgcggttccctcggcgtgtcgcacagagcccactttgctctgatgaggctaggttaacccctcaaatgtttctgaaaagcatcaaatccactattcggctggcgtgtcgcgagagttttcagcttgtcggccctgcgttcatctctcggcaaccacactgccggcgcacaatcggcgcatgacagcgctccgtcatcggatttcgttcatgaatcgcgggtatacctgtagttatgaccaagaagattgctgtattaaccggggcgggcatttccacgtccgccggcatccctgatttccgcggtccggacggtgtgtggaccaagcatcctgaccaaatgagcgtttacgacatcgatctgttcctgcgcaacaaagaggaccgcgagtactcctggcgctggcaaaaggaatcgccagtatggaatgcgcagcccggcactgcgcataaggcgctggtcaagctggaacaagccggcatgctgacgctgctggccacgcagaacttcgatgcgctgcatgagaaggccggcaacagcgacaacgtcatcgtgaacctgcacggcactatcggcacctcgcattgcatgaagtgtcatcaggaatatgccacggcggacatcatggcccgtttggatgaagagcccgacccacattgccatcgcaaactgaagtatcgtggcgatatgccgtgcaatggcattatcaaaaccgatgtggtgtatttcggtgaggcgttgccggacggcgcgatggagaagtcgtacagtctggccaccaaagccgacgaactatgggtaatcggatcgacccttgaggtgtacccggcggcgagcattgtgccggtggccgcgcaggcgggcgtgcccatcaccattatgaatatgggtcacacgcaatatgaccatcttgcgagccgcttgattcatgaggatatcgccgttgccctgccgaagttggtggacgagacgattgcggagaacaagtagccctcagcataacgaaagcgccggtgggtgggttaagcaactgatgattgtcggttaaccacccaccggcgcttttgcgccacctcccgccagcgggaggtattggagcacacttctgcgcggcttcccgccagcggtattggaatcagtagatgcgcttgggctggaatccggcttccctgagtgccgcgaggatgcggtcgatgtgctcggggccgttggtctcgaccgtgacgccgagagacaccgcgttggtgtagtggccggatgccttgaactggtcgtgatcaagctgaatgacgttggcgcgctgctcggcaagcagggtggccaccttgacgagctggcccggagtatccggcagctcgacctcgaagttcatgatgcggccgcgggcgatcatacctttctgaatcaccgcacccatggtcacggtgtcgatattgccgccggacataatcggaaccaccacgtgcgggccggtggcggcggcgaacttgcgcgaacgcaggttcaggtgttccagcgcagccagcgaaacggcgccggccgcctcgaccaccagcttatgcttctcgagcatgagcagaatcatttcgttgatgtcgcgctcggtgacggtgaccagatcgtccaggaactcgttaatcagagcgaagggcaggtcgccggggtgcttgaccgcaacaccttcggcggaggtaaccacatggtcagccggagacacacgacccgcggccagcgagtccttccaggccggtgagccctccggaatcgcaccgattacgcgcacttcaggcttgaatgtcttgatggcgagcgccacgccggcacccaggccaccaccaccgagcggcacgaccacgtcagtgacgttcggcacgtcttcaaggatctccagaccgatggtgccttggccgcagatgacttcgtaatcgtcgaatggcggcacgtaaatcatgccttccttgtcggcgagctcagcagcgtgggcggcggattcatcgaacacatcgccgtacagcaccacgtcggcaccgtaggccttggtggcatcgaccttcagcggcggggtgatctgcggcatgcagatggtggccttggctccacgctcgcgggccgcataggccacaccctgggcatggttgccggcagacgcggtgacgatgccgtgagcgatctgctcttcggtgagcgaagcaatcttgttataggcaccgcggatcttgaaggatccggtgacctgcaggttttccggcttcaggagaatctcatggccggtcatctcgctcagcaccggagaaggaatgatctccgtgtggcgggcagtgcctttgagtcgttcggcggccagcttcagttcggctgcatgatcacgttgcagcgccttcaaaacatccttttgttccatagctttccattgtaagcaccacaatgccgagagacaccagctatctcgcttcacagaggtacattcggccttttgcagacagctatctgttttcataggggtaccgagaagcaaaaaccccgggtataagccttgattttcaatgcttatacctggggtttcgacgttacggtacctctctcaagacagatagcatttcgggatagccccgaagtacctctttgagcggagaaaggcactcaatgcactacaactggatgacggctgcctcccacgggtcgagctcgcggttggcaagggaggccacggtgtgcggagcgtcatacgtgctgatcaccacattcggctcggcgattccgacggcggctagttcggcagcctcacgtggcaggtcaacggttcgactggacatattgactacgaccaacaacttctcagcgtcgagctcacgggtaaaggcatagacgtgcggatcagcggcgtcaatcagtcgccagtcgccggcggccacgaccgggctgttgtgacgcagcgcaacgagttgcttgtagaaggagtacaccgaatccggatcatcgaattcaccggcggcgttgatctcggcatgattcggattcacggaaatccatggctcagtggcggcgtccggagcggtgaaaccggcgtagccggaaccgtcccattgcatcggagtacgcgcgttgtcacggctgcgcgcggccagaccggccatcattgactcagacgactgcaccttggcctcctcgaccctctgccggtaggcattcaaggattcaaggtcacggtactggtcgagacgcgtgaagtgggcgtcggtcatgcccagttcctcaccctgatagatgtacggggtgccgcggtgcatgtgcagcatcaggccaagtgccttggccgaacggacgcgggattcctccgcggagtcgtcgccccagcgggagaccacgcgcggctgatcatgattgccggtgaacaagctggcccatcctgcgttctgcacggcagtctggtaaccggccataatgctcttgaatttcggcaggtcaagcggcagcggcttccacttggtaccttcgcaatcaaaatcaacatgctcgaacaggaagagcatgtccaattcaccgttgcccggatcagtgatgtgctcgttacgctgagccgtgacgcctggcgcctcgcccacagtcaggaagccttcacgcccctcgaatacctcacgtcgcatttcagccaggaattcatcctgacgggggccgtccgcacagaacggattcgggttggaatagccctcctcgcccacaggaagatcctcaagctccgagccgtactcgcccggcagcttgccgttcgaatcggtgcgcttggagatcagggtgatgacgtccatgcggaagccgtcgacgcctcggtcaagccaccagttcatcatgtcgtacacagcgcggcgcacggcagggttctcccagttgaggtccggctgcttcttcgagaactgatgcaggaagtattcgccacgctcggggcagtattcccatgcggagccgccaaagtaggagccccactgattgggctcggcgccgggctcgccgggcgtggtgccgggacgagccggacgccaccaataccagtcggcgtgttcgtcgtctttgttcttggatgcttcaaaccaggcgtgttcatcggaagtgtgattgacaacaagatccatcacgatcttgagcccacgcttgtgggcctcggccagcagctcgtccatatcgtcgagcgtgccgaacagaggatcaatgtcctgatagtcggaaatgtcatagccgttgtcgtcttgcggagacttatagaccggggatagccacagcacatccacgccaagatcagctaagtaatcaagacgcgacgtgatgcccttaagatcgccgaatccatcgccgttcgtgtcttggaaagagcgcgggtaaatctgatagaccaccgcgttggaccaccacggattggggtggcgccgttggtgcggatggcgtcggggattattgcgcggttgaaagtagtcatcattggctccttattgatatctatattgctcgttgctcacagtctaaaaattggcgaattacattcccattggagaactgcgttggtgtgccggaaaataaatatcaatcggcatatgcgctttcatgattgcacccggaaaacacgcagtcggccgtactcgatctcgcaagtatgggtttctcccggattcatatcaatcgtcgcaccatggtcatcgatgatgcggcaagagcgaccgctagccgtaataatgccgatttgtggctgccggcgcaatccgacgaaagcgatgacctgttctgcgccgaatcttgctgtgacaccgagcgcatagtccgtatgttcggggtcattgagcagtgacgcaatgactggtcgggccggctcatcaggacgcggtaatgtaccatcttcggcaagtaaatcacgcaagacagccgcatcagtgtgaccgcaggcatcggaacaatacactggtccgccgctaagcaatcggagcacggcatggactcgcgcatggggatgctccgtccagaacatgtcccaatcacagtggtacagctcccccatcagcagtgcacagtatgcgttctggataaggtgttcgcccagcgaatcaggattgtgcggtagatagtcgtcgctactacgggtgattggcgatgaaggacgatgccaataatcctccggtgccatgcccatgcagttaatcaatgcgccgccgaatcgtcgtgaggtcacttcatcaagcgcctgatggcgtccccaggtggcttcaccgtaactttcggtgccacgaaccattactgacgtggaactttgcgaatccactttgacgaaatcgacgccggcttcggcgagttcgccgtcccaggcatcccagaactgtgcgggttgttcagcacgacttccaggaatcaggcaaccattcgccgtggtggttattgcggtcgggcagctggccgcggctacacccgattcgtccaaaccattccaatagccttggaacgcctgccacacgcctacgctgcgcacgccatagtgcgttttgagcagcgcaatggtgtgggcaagcccgtgggggaaacgttggcgatccgcgccaaagtcgatcagggtttcctttgtgcgatccgtgttggaccaaccgtcatcgataagcacccaggaaatgggcacatgcttggcttggaactcctccatcttgttgacgatagcctgctcgttgacatctcgccccaatgaatcccaagtacaccatcccaacccggtgagcgcatccgggaatggacgctccttacgggtgcgaatacccagctggcgtgctgccgtttgtgtggcagctcgaatggccatatacgggtcggatgcgcaagcgatatatgcggcagtgtcacatagagtcgtgcgaccaacccggttggaagacagcacgagccgcaaagccgtgtcatcagattctgttgcgggctgcccactgaaatcagcccgaatatccgtgccgcagatagcgaccaacactagccactcggcatcttcggcatcgttgttgcggcgtaacaataactgcgtgcgttcaggcagttcagatggtgtacgcacccaggtcgggcgcatccaccactccttgtgctggtatagcgccagcatggtgtcatcgttgccgctgtcgacgccggccatggtgagcgacacgtcaatcgcatggtggggctcaaacgcttgttgttcctgaaaggcagcggcgcggtccttgggctggggtgcatgcgcgttcacatcgatacgccagagtcgcacctgagcatcaccctggatacccgcactggacgtgcactcgtcttcgcatgattcgggaacgattgtgacggcttctaccggcagttcacagattgccgaagcctgttcgccatagacggcacgaccggtatcaagatgggccgttaccgtgcgaacggttattggacaggtttcggcaatcattggcgtaactccttggtgttcttcaatgagattatgctggcaaggcccagacggtagcagctggaggaacgctctcgacctgagtgttcgcctgcacagtcgcgtcagacacaagtagcacggtcatcggctgcggcaaggcgactggttgactgtcagagaagttcgccatcacaaccatgccggacggcaagcgccaaccaagcagcggcgccggacactcttcgttggtaagccacgagaactggaagtccgtgccgttggccacccactgtttgcgcaatgcgacagcagcacaatacaggtgcaggacggaagccccgtcaccaatctgacgattagtggcatactgcgcaaaccatgccggctggggcagccacgaagcaccggtggcattgaagccgaacgccgggccgtctgactgccacggcagcggtacgcggcaaccgtcgcgccccttgaaataatgaccggaacgttcccaattgggatcctgaatttcatcttcggtcaaatcaaagtcctccggcaaaccaagctcttcaccctgatacacaaaggcggtacctggcaggccgagcatcaccagcgctgctgcacgggcacgacgagcggcgagcgcggggtcaatcggcggattcgtgccgttggacgtcacccactgctcgatgtttgcaccgctcggcagtccgagacgcgaggcgatacgtggcacatcgtggttgccgagcacccaggtggggcggtttcggcagcgagagcatagcgatgcgtgcgctcaatcgtggtgcggtattcttcgcgattccaggcggcctttgacatggagaagtcgaatacggcaccaagttcatcaggcttggcgtattggaaaatacgggtggtgaatggcgaccacgattcgccgaccgcatacttggctggcgtgtactgattgaacaggtcgcgccattcacggtagatatcatgcacggcgtcgcggtcccagagcggatcggagccatcggtagcctgtggagacatcagtgtcgggtcgatacggtcgcgcagcggctcacgcaggtctttggccagaccgtgcgagacatcgatgcggaaaccgtccacaccgcgatcgcaccagaatgtgagtacacgcaggaactcatgccgcacctcgggattgtcccaattgaggtccggctgctccttggcgaacagatgcaggtagtaccagccgtctccacacgactcccatgcggaaccgccgaagttactcagccagttggtaggcggcaattcgccgtgctcccccttgccctgccggaacacataccgttgtgccgcttccgattccggaccttgagccagggcctcttggaaccaacggtgctgatcggacgtgtggttcggcacgatgtccacgatgatgccgataccgcgttcgtgcgctttggccactaattcgtcgaactgatcgagtgtgccaaggcggggatccacatcacaatagtcggcaacatcataacctccatccgccagcggcgatggatagaatggagaaagccagagcgcgtccaccccgagcgcctgcagatagtcgagacgatcgatcacgccttggagatcaccgttgccgtctccattggcatcgctgaatgagcgggggtaaatctggtagatgacggcgtcgcgccaccagtcattgttggtgaaagtcatatcgttcccctgtccgattgctcggtacgtatggttttaccagtatggccgcacgaaacactgttccggcggccataccctacatcctcttgccttcggatcagcccttaaccgagccggcaagcatggcgcggatgaagtagcgctggaggaagatgaacaggatcatcgtcggtgccatgatgagcagtgcgcccgcgttgagcagcaccacgtcggtctgatactggccaacgaacgactgtagggcacctgccatcgtgcgcttgttcgggtcgttctccaacaccacagccaacaggaactggttccaggtggccaggaaggtcagaataccgagcgaggagatggctggcagtgccaacggcagctgaatggaacggaacgtgcgcagatggcctgcaccatcgatggatgcggcttcgatcagatcacgcggcatctgctcgaagcaggagcgcatccacacaataccgaacggaatattcaggccgatgagcggcaggatcagggcaagacgggtattcagcaagcccatgccactgatctcgtagtacagcggagtgaccaaggtttcgaacggaatggtcagaccgacgaggaacagcacgtagatcaggcccttgcacggcaccttgagctgagcgaaggcataaccgccgagcgagcagaagatcaccacgcagggcacgaccacgatcaccagaatgcagctgttgagcagcagcggggtgatgtttgccatgttccaggcgtcgatgaagttctcccagtgcgggtgggcagtgaactggataccttcgggcatggaaccttgcggctgcaatgccgcggagagcatgctcaggaacggcagtacgcagaagaggacggtcagagcgagcatcgccgtgccggtgatgcgaacggctttggattgctgcatggtcactgctcctttccgttgaccagacgctgcagaggtccgacgaccagcagcacgagaatcatcagggtgacggcgagtgcggaggccaagccaacgctctgctgggtgaaggccaagcggtagacctgcacgccgggcaccatggtggaggtgccggggccgccctgagtggacatgtacaccacgtcgaagctggcgagcgcggagatgatggtcatggtcaggcatacgccgatttggccgcgcagaccgggcaacgtgatggagaagagctgacgccaccagccggcaccgtcaagacttgctgcctcgtacagggactggtcgatgccgccgatgcccgagagcaagagcaccacacagaagccgagctgcagccagaaaccaatcacgcctaccgcgttcagggaggtggattggtcgccgagccacacgtgggcgaagtcgccgaggcctactgcgcgcagcagctgattggcggtgcccttgtcggccagcatccaggtccaggccacaccggctgcagcgcctgggataacgcgcggcaggaacaggcaaacctgcgcgaaggaacgaccgaccttggacttcatgtctttgatgagcacggcaatgatcaggccgagcacaatcgggatgatggagaagaagatgatcaggtagaaggagtgcagaatcgatccgtacagatcggggtcggtgaacacggtgatgtagttttcgacaccgatgaaggtgctagcatcgataccgttccactcgtagaacgagtaccagatggtctgaatgatcggccacaactcgaaggcgatgtagaacacaagcgccggagcgaggaaaagcaggctgaccagaccgagggacatattgcgcttgggcttgaccgccttggctgccttatgggaatccatgattgtcaccacgctttgctggtttggtgtgaactgggaatcgaacatcgcacacaacgtcgtgcgcgcgatgggaaggaaccaggcggagcgggaaaaagggaagaacactccgcccggtaagtgcaagggttacttgacctccttctcgtactgagcctgaatggattcgacgaatgccttggggtcatcgtgccgtcaatcagggactggaagccggggataatggcgctggcctgcatacctgcggtggcgttgttgatgtagtcggtggtgttaccggtcttcaccagaccttcgtaggcggtaaggacctggccgagaagctggttatcggtgctcggagtctcgccttcgccgaccggcgggtagccgttgtcaactgcgatctggcgggcttcgtcggactggaggaagtcgaggaaggcggctgcagcgttcttgttcttggcgttggccgggataccgaaagcggtcacggcgttggctgcggcagaaccggaatcggccttttcgccggggaaggcgatccagccggcgtcatcgccaagtgcatcgttgatggaggcggagtaccagctgccggaggggaagaacagggcttcgccgttgcagaagcggctcagtgcagtggaaccgtcaagggcgagcgcgtcggaggagaagtaaccggcatcctgccagtccttgatcttctgtgcagccttcacggcaccgtcggtgttgaaggtggcgccatccttctggataatccaatcctgcacggtatcgcgaccctcatagttggtgagcaatgcctggtagatgtaggaagtgccgccttccttggccggcatcatcatggcgagcttgccagcgtcggaggccttcttcatatcggcctcgagctcttcgacagtggccggagcctcggtgatgccgagttccttggcgactttcttgttccagtacaggccggtcatcgagacaccgtccggcactgcgtagaggctgccggaaccgatcttaccgtcggagcccacgcggtagacctgagtctgggaatccggcagcttccaaccgtaagcatcggcgtaagcgtcaagattgacgacatggttgccacgcacagcggagttgatgtcggtgatacgggcaatgtccggggtgtcggcggcggagatgatgcgcgggccattctgctgggaggtgttgtccggatcgtaggtggccttgatggtgatgttcgggtacttcttctggaaggcttcgatcagctggtcatcaaaggtcttcaggccagcgccgtcccacagcttgagctcatacttggtatcgccaagatcagtgctcaccgcttcggtttcggtgttggctttgttgctggacgagcccgggccgcaagcggcgacggatgccaggcatgccacagacatcagaccggcaataacggttttggcggttcgttcgatcctcattgatcattcctttcttccttccgggcgatcccggctatgtcttccttggctatctcggcttagcgtatttgctaagcgcttatgcatgaggataacagatgtcgaaccggttcgtcaaatccgcaacacgcaaacaaatggccgattcccgaagaaatgaggaaggcttgacgttccccataggcaagcacttccttctcgcgaaattgcaacatcggtcccttaaatacctaagcgcttattcattcacctaggatgacgtttcgaaggctcgggcagctcgggaaaaattgaatgtggctcaatttgataccagtacgccacgctagacacatcatcctgacgctcaaatgcaccttcatatcctgaaccaatttgttgaagcgtgactctaagctcactatcaaacctgatgggatcaggaatatgccatcggtacaagccacgcataggtggacaataatcgtcatgatattggtttgctatagccccatcgcgcacagaataaaatggatatcctacatatggggcacaaaaagtacgctcgcgcgtatgaccatctcgctgctcagcgaagctccatgcaccgccaaaataatcttcggtgccggtactacacactgtgggataatcgttatcgccatctaggaaaaacttaatctctccctcaccccaccaatatcgttgcaacgtagaaatagcaagatatgtgccgacgtaatggccccgtccgctgactccatcgaggattacatagtcctcgcctaaagtagtgattggctgtctgcgccattgcgcatggaaataagccatttcacgggaggaatacgcattacccaatgcataatcaatctgataaaacaaagccggaatagcatgagcgtggtcattgcgcactacgatacgtgcccgtttacgaaacggcatcgtgaaataacaattcatacctcgtgtaggtgccaccacaataggctctgagaacacatcgcaactttgtccaaagccgcaacagaagaagtctcctaggggacattccacagaaggtcgcttttcatcatcccaatagatggcaagcaccgcatcgcgcagaacgtatcgatcagcgtcactggtgcgatccgtaacggtaaaccacatgtgccgaatacaaccggggccttcaatatctgccaatgtcacagactgcccgggagcaatgtcattcaaacacggctttcccttgcgcgacggccccaacggaccagtttcacggcaaccaaaacccttggctcccgttgggttctccgcattaatcgaacatgttacttcgtcgcggacagtcggcaaatccgataaagttcccgcgtacggtcctgccatcatcataggttgactctcctcaaatcaagcgtcgctagcgaaagcggcatataagttgaagctgtttctaccgcttcgcttctttgtcatattgcgcctgcacattctttgtgaattcctgaggcgtgatgctgttatccagcagtaactggaagttagggattagcccacttgactgcattcccgcagtagcattattaatgaaatcgctagtatgaccgctcgtcagcacgtcggcataggcatcaaacatactctgctgcaatgcgctattcgccttgagatccaaagtagatgattttggcaaatagccagaattgtcaacaataatctgttgcgcttcggcactttgcgtataatcgaggaacgccgcagcagcatcacggttcttagcattcaccggaataccataaaatgcacctgcattagcagcaacgttcggctcatcttcactggtggcacccgggaaagcaaagaactgaacatcatcacccagcgctttggccacagtatccagattccaattaccgctcgggaaaaatagtccttcaccattgcagaacctgctcagagcagtagaggcatccactgcgttaacaccttcaggcatatatcccttgttattccaatcctgcaaggtggacgcagcgtcctgcgccgcctgattgtcgaaggtaccagatttctgcaaaatccaattctgcacatcttccgcagaactgttattagccattaacgcctgaaagacaaaagaggtaccgccatccttggcatatgtcatcatcggcagtatgccggcatccttggctgtctgcatatccgcctcaaactcctcgacagaggtaggagctgcatcaatacctagctgctcggcaagcttggtattgaaataaatgccagtcaccgaataggagttcggcaatgcgtacaaatcaccgctgccgagcttgccatttgaatccactcgatacaattcagtctgcgaatcgggaacatcccagccgtacgcatccacatatgcctctaaagacaccaaatggttgccacgaaccgctgaattcatgtcggtgacgcgggcgatatccggcgcatcttttgctgaaatcacacgcgggccattttgtccagagacattatccggatcatattgtcccgtgatggtgatgtttgggtatttcgcttcgaacccggcaatcagcgcctcatctacagccttcagacccgctccatcccacaaagtcagctcatattttttattacctaaatcagtgctgacctcagtaggatttgtatcacttcgtgagctacttgccgagccgggaccacatgcagtcagacttccagcgataaatatcgcagcaagcgccgcgccgctgttacgcataatcctattcatcggttacctccttgcatcctcatcatatgcaatcgatatttctctttactgtcaccatttttcggcggcaataaaatatatttgcgatatcgattacgcacatcgtacatctttttgcggaacccgtcaaccttgcatcacaccaatggtggccttaacttcaaaatccagatacaatacaatcgattacgcaatgcaggagatcccatgagcgaaccaacaatctatgaagtagccaaggaggctggagtctctgcggcgaccgtatctcgtgcaatcaacggacgtgaccgcatatcggaaactactaggcaaaaggtatttgatgcatgtgcaaagttggggttttcagcatcgaaaacagcctccatgctgcgaacgggaaagacaaatcgtatagcacttaccgtaggtaactcactggctggctggttcagttcacaactagccgaaggcgtatattccgtgctcgcatcccaaggatatgacttgctatcataccgacttgcaaacgccgatcaaagacgcgatttcttttcctcaatgccagtgaagcgcaacgcagacgcggtcatcatctcctccttcgacatcagcgagacagagaggcgaaccttagaacaactcggtatgccagtcatcggtgtcaacaccatcgggcttacggaacagcgagatatgatttccatcggcgtagacgaaattatagcaatgcgacaaaccgttcatcagctcgcaggactgggacatcgcaatatcgcctttatctgcaagcagcaagacagtaacggattcatatgggaagctgaccaacgtatagaagggttccgtcttggcatggcggctgagggactcaacttgcccgacggatacatcatcgcagtacaggacaacgaatttgccggagcagaggcactcagtagcctgctcgcactctcccctcgcccaaccgccgtatgctgcatcagcgacgagaatgccattcctctagtccatgcgcttcgctcatacggattccgcgtacctgaggacatatccgtcatcggattcgatgactggccaatggcacaagcgctcaatatatcaaccgttcggcacgaccctcggtcctacggagcattagcggcagatgccgcaatccgattatcacgaggcgaaattctgacagaaagttgcatcgttgttcccacgacgctcatgttgcgcggcaccacaggcccagcacctcgagattaaacatcgacaacgtccgcatttgatgatgtgcatatcattattgcaacagcgaaacaacaggtaccagccagaggaaggacgaccgggtaacagccacaaggcggccacccattcaccatgaaacgcgcgaccatcaacgacgtagctctcacggccggagtctcaacttttaccgcatcccgcgctttgcgaggtaaggatcacgtggcagcagctacgcgggataaggtgctgaaagcggccaaagagctgaattacaccgcgtctcgctcggcggcggcgctggcaagcggacgcaccaatcgcattgccatgctggctcgcgaacggctggccggctggttcatgggcgaattattcgacgggctgtatgacgaactgagccgcgcacgctatgacttgaccgtataccgagccggcagcgtcgaggagcgtgcggaattctttactcggctgccagccaatcgtaacgccgacgccctcatcgtatccggattttccgccaccgatgaggaagccgacacgttggccagcatgggtatgcccatcgtctcggtgaattcgccgtatatcagctgctgccaagcctccgtggccattgatgacgaggcggccgaagccatggcagtgcgttatcttgcggccctcgggcatcgtcgtttctgctatgtggggcgcaccgatccgctgaccggcaaggaatggggattcgatgcacgcgcacgcggatacaaagatgagatagtctcgcttggcctcaccgactgcggcatccacttcatcgactcggaatcaccacgctcggccaaacaagtcatcgccaccatgctcgcgcagcctgagcggccgaccgctatctgcgtgtggtctgactactacgcattgcgcgtggtacatgagttgcaggcaatcggagtacgaatccccgaagacgtttcggtctttggctttgatgggtccgacgtggcggaatccattggattaagcaccatggtgccaactcccccgcgcgaaatcggacagattgccgcgcgcaaggcactgaatttggttgaggggaagaccttggacgaccctcatacgactgtacctgtggcggtcgagcccggcgcgaccagtgggccagtgcgggaataggcgatatgggaaaagcccccctcggcggaaaaccgaaggaggcttgggtggagctgcactacttcacagcgcctcgcatgactccaccgacgacccacttttgggcgaagatgtagacgatgaggatcggggccatggccatcaggtagctggagaaggccatcgggtagttggtggcgaactgcgagctgaagacgtactgggcgagcgggatggtctggttcgactggtcggtcaggatgatcaacggcaggaggaagtcgttccaggcccacagtgcggtcaggatggcgatggtggcgttaatcgggctcatcagcgggaagatgatggtccagaaaatgcgccacgtggatgcgccatcgattcgggccgcctcttccagcgaaaccggaatcgaacggatgaagccagtggcgatgaacaggttcgtgcccaggccgagcaccgtgtacagaatgatcaggccgacctggttgtccaggtgcagggagcccatctgcttcgcaatcggcagcatgacgaccgggaacggcacgaacatggcggcgatgaagaagtagtacaggaagcggaagaagcgcttgtccatgttgcgggccacggcgtaggccacgaaggtgttggtcagcagggtgagcaccacggcggccaccgtgatgatcgcggagttgagcgcggccttcgggtagttgaccttggcggaggcgtcggcgaagttgtgccactgccacgaggtgggcagggcgaaggtgccggcttcggccggagtcttcagcgcggtgacgatggtgaagtagagcgggatcagaatggtcaggctcagcacggccacggcggcggtcagccaccagttgatcttgtggtccctgcggaacttggcgggcttgccggacttggacggggtaactgttgcagtagtcatttcttatcctcccctaaatcagatctgttcctggctgcgggagatgcgcagctgtacgaaggcgatgatcgccagcacgatgaagaagagcacggcgtttgcggtctggtaggcgtactcgccaccggtcaggccacccttccagatgaggtaggtgacggtttcggtggaggagttcggaccgccctcggtcaaggcgacgacctgatcgaaggtgccgagcgcgttcttcatggacagcacgaggttgatggtgaagaacggtccgatcagcgggaatgtgatcttccagaacttctgccaggcgttgacgccgtcgatggcggcggcctcgtagatttcgtcgtcgatggtctgcaggccggcgaggtagatgagtaccgagtaggcgatgccctgccagacggcgaggaagacgattgggatccagctgagttgctcattggtcaacagcgaggtggacagccacttgatgcccagcgccttgccgagctcgggcagcgggttcatgaagatgtacttgaacacgtagccgatgaccagcacggagagggtgtaggggatgaagaagatggctcggaagccattcttgaaggcgatcttcgagttcagcagcaccgacaggaacagggcgatcacattaatcagcaccgtgatgagaatggcgatgaggaacgtgaacaggtaggcatggcccactcggttgtcctggaagagggcgatgtagttcttcaggccgatgaacttgtaatcgccgtagccctgcgagttggtgaaggaatactttacgccatcaagaaatggcaggtacaggaagaaggcgaagatgatggccgccggaaccaccatccagtagtaggcggggtccactttgcgggtggagaaggcggagaccttcttcttggccggtttcttggcagcggtcttggttgcggttgcgtgtgacatgatgttctcctctcctaccgatcactcgaaggtcctggcttggaccttgtcccattcggtctgcatctggttcaggaagcggtcggtgttgccggaggtcaccatggtctgcaggtagccgccgatgttgatggacgaaggaatgtagtggtcgcagaagtcggccagtcggttttcctcgaagaacgggcgcacggtttccagcgcatcgttgccgaagtaggtgtccttcagcggcgtgatggcggactgggcgtcggcgtaggcgtcaagctgatccttctgcatgaggaactcgacgagcttcatcgcttccttggggtgcttggtgttcgcaccgatggtgagcatcacgtcgtcgccggcggtgaggatctgctcgctggcgtcatcggtggccggcatctgggcgaaaccaagttcgatatcggggttgatcagcaggatctgcgggatggcgtaggtgccgagcgggatgatcgcggccttgccttgggcgaagttctgcgtgccctgctggtaggtgacgccggtgtccgcagtggagtaggtgaagagctcggattccttctcgactgcggtcttccacagttcctggaacgtggtcttgccttgcttgagctcggtgtacttcgattcgggaaccagcgtgccggtcagggaggcgagcggtgcctgggtggtccaggcgtcggccacggaaccctgcagcgggttgatgccggcgtccttgaaggtgttgagcatatcggtgaactcgctccaggtggtcggcggattctccgggtcaaggccaaccttgcggaacagagccttgttgtagatgtagccggaggcgttacccgcgaagggcaggccatacaggcgcttcttggaggaatcggtggtctgcaccagattcttggcgatctgcaccatgccggggttgagggtgtccacaatgggttcatcggtgaagtcgtagaacacaccggaggcggcgaagttgccgaagctgatgtcgccgttgaaggtgatcacgtccggcacacgattcttgacgaaacgggtgcgcagatcggtctgggcgttggcggagttgttgatgttgaccttgatggtcgggttctgcttctcaaagtcggcgaccatggacttgaactggtcggcggcctcggacttgaactggaagaaatccagcgtgacggtgcctgcggtgctggagccgcagcctgccaggccgaacccgacggcgatcgcgcacatcacggcggcggtgcgcacggccagacgcttcagtctaggcgttgcatgtggggaatcggacagcataattgttgactcctttatctttcttttcctccggcttcggtgccggcggttcttccactttccaaggtaacggttcggccatttcattcccagcgccagcgagcccacttgcgcaagcaacaaaaagcgcggtattttgtgattaacgcaataaatacagcgaaggggcttgcatgtctgatgtcaacgcgattccacagtggttttccggatccgagcatacgcatcgcgtggcggcggcaattgcccaatacgggccgatagcccgcactacgttggcacagatgctgggactgagccaaggggccttgtcccgcatcaccagcgatctgatctacgccggggtgatcgaggagcttccggccgaggccggcccgtcaggcaagctgcccgagcgattcacgccaagggaaagttcggatcgtcgcggacgcccgcagacttcgctggtgttgtgttcgaacgcacgcaccttcattggtgtcaaggttcatgggatgtcgattgtggccgctgcggtgaacgcgcatgacgaggtggtgtccggccggcacgaggtgccgatcggggcggatcagtcggctgagtatgtggtgtcggccatcacgcggctggtgcgcgaatgttccgccgatatcgcctcttccggactgccctcccccactgcggtgggcgttgcggtaggtgggcatgtggtcgacgattcgattgtgacgttcgcgccgttcctgcattgggacggggccacggacttggggacgatggtcacagaggcgaccggcctgccgtgcggggtgttcaatgatatcgattctctgctggtggatgcctcctggttcgggccgggtgtcggcgtggatatgttcgccgtggtgaccatcggcgtgggtgttggttattcgctggccgtgaacggcaagccagtgcagtacccggataagagctatggtctggtgggccacgtgcttatcgatccggaggggccgcgctgcaccagcggacatatcggctgttcacaatgcttgactgacgattcgatcgccgaacagtactctgcgattgtgggtcgcgcggtcagttttgaggactttgcgcgcgatgtcaagggacgcgtgccgcaggccacgcagttggtgaaccggacgtgtttccggttgggttcgctggtggctacggtggcgaacatcgcgatgcccggacatgtgatgattgccggggagtccgcgtttttggccaagctcggcaccgattcgctgcgcgatggcattcgtttctaccgtcacagccagacccagccggtcaagttcacgattatggaccacgactggcagctctgggccaaagccgccgccagtcgcgtaatcgtgaagcatattgggtaggccgttcttggctcccctcagagagggaagccaagaacgttgcttcgccacagttactccgccacgaccagcaattacggacttgcctatcggcaaggctcaatcccaccttcgctcagctgtcgcttcgctcaggccgtggctactgacagcctactaggctgtcagcttaacgccacagccttgagcaatactgcctgctgggggtggagggacggggacggatgccgtaacgctgcagggcttcgccggtcaggactacgccttcctcgttccaccagccgagagtgctctggccgttggtcagaccggtcaaatccaagctcgggtcgagcgggctgacgcggtaggtgcgctcggggtcaagtccgggcaggtgcacgggcgcggccggataggtctggctggtggtcagctgggtgaagcggtagatggcggcgtcgcggttcggcatcaccatgccatccaagcgcacggccggatcgttggagtcggcgtgcacgcaggtgtcgatggcgaaccagtcgcggtgcttcttgaattcggccacccacacggccagcttggcgagcgcctcgtccggctccttcaacaggttccattcgatgcccatgtggccgaagaacgccatggccatgcgcagttcctggctggtggcacgctgggtggagtgcgcgggactggcacccacgtgctcgcccatcatcgccggcggcaccagcagcgaggtgtagcgctggatgtccgcgcgctcgaccgggtccacgcagtcggagacccagatacggtcagcgtgctctaggatgccgagatccacgcggccaccgccggaggagcagctttcgatctcaaggcccggatgtgcggtcttgaggcccttgaagatgttgtagacggcgagggtctgcgcgtgcacggccgggcggccggagcggcgggaaccgggctcggtgacgagcttgttgtggtcccacttgatgtagtcgataccaagctcgccgacaagctggtccatgcagccgtagatgtagtcgaacgcatccggattggtcagatcgagcacctgctgagtgcggccctgcagcggcagtcggccggtggtgggcgaaagaatccaatcggggtggttgcgggccacgtcggaatcggggttgaccatttccggctcgaaccacaagccgaattccatacccttggcgtgcacgtagtcggcgagcgccttcagggacttcggaccatcgggccagacgtcctgcgcaatctgccagtcaccgaggccggaggtgtcgtcgcggcgggagccgaaccagccgtcgtccaccacgaatcgttccacgccggagtcggcggccttgtcggcgagcgccttcagcgtatcgaagttgtggtcgaagtacacggcttcccatgtgttgaggatcaccggacggccgtgcgagaacaggcgcgggtgcagggagcgcacgtaggagtggaatcgggcggcgatctcgttgagaccatcgccataggagccgaacagccacggggtgtcgtaggagttctggccttcgccagggccagcgagcgtcacttcgccgccgaacaggagttcgccgccgccgatcacgccggttgtgtagggcagacgttcggcggacagcacggagttgccgctccagcccacgtgcaccgaataggcgtcgccatgctcgaagctgaaaccgggcacgccggcggtcaggagcagggatgcgtcgaagtcagggcggccggcgagctgcggcttttcgaaacggccgacggtcagcggctggcgctgcggactgcgttcacgtagatggtgaccggtggtggtgaggatttcgccggcggattcgggcagcgggaagccgagctcgatcttgccgatctcgagcggggctccggcgtctgcaccgaacaggttggttacggtggccttctgacggaccaggccgccggggagcagttcgaggtgccattcgacttccacgccctgctcctcatcgcgcgcggtgactatgacgccgggcacgcggaccggaccggtggcacgggcatggccggccacatcggtgtagctttcgccggacacggcatcgagggtggcttccagcacgccgccggcctcgatattggtcacggtgaacttggggaagagctcgacgccggcgcggcgcagcaccacgcgctgctcgccgatccagctttcggcctgggtgggcaggatagacggccaggcggtgtcgtcgagcgcgccggacacgcgctgcggcttcagggcgtcataggcggccagcagggtgtcgggcttggccagcgggcggccccagtggacgatgtgcggcaggtcgctgccggcaaacaccagaccgatcgccacattggcggcgggctgggtcaggtagacggcggtgagtgcggtgccgtcagcggcggcgccggtgaaagtggaggtgttctcggccatattgtctccttcgacgtgtgtggatttgcattgcactactggtttcgatggtagaagaaatggaatatgttgccttggtgccgcgtgttggttgcgtgaggtaagtaatgcgtccgtgtctatcgccgctgggcgaagaaatcagtcaggatggactgacactcgccttccagcacgccgccgtgcacttcaggactatggccgatatgcggatcgcgcggaatatcccaaatcgaaccgcatgcaccgagcttgggatcccaggcaccgaacgcgatggtgccgatatgggtctggatgcaggcacccgcgcacatcgggcacggctcaagtgtgacggccagcgtgcaatcggcgagattccaagcgcccaaggcttgggccgcctgacgcatggcgatgatttcggcgtgggcaagcgggtcgccatcagcctcacgcgtgttgtatccgcgcccgacaatctggccggccgcatccagcaccaccgcaccaaccggtacgtcaccagcggctgcggcctgaccggccagttccagtgcgcagcgcatcgcctcgtcatattccataccaacgagtgtatgccttttctcatatcgtctcatgatgtgcataatcggccgcaagcttaacgttttcttcatggttcccatatacttttggtggagaaaaatttaagggagaaggcggcaacatggcggtatttgagctcatcctatgcatcattgcggcggtggtggtgagctcgtttgtcagtcgcttcgtgcccaaagtctccacgccgctggtccagattgtgctgggcgtgctggttacgtatctgccgtttttcccgaatgcaacgctcgacccggaactgttcatggtgctgtttatcgcgccattgctgtatttggaagcccacgaaatcgataagtcggcgttgctgaaaacgctggatctgagcctatcgctggctatcggactggctatcgtcacgatggcggcggtcggattcactttgcatgccgtctggccgtccatcaccttagcctcagccttagcactcggcgcggcactcggcccgaccgatgcggtggccgtcagctccctcggtaaagaagcctcgctgacgcagcgtcagcgcagcgtgctgaaaggcgaatcactcttcaatgacgcttccggcatcgtcggcttccagttcgctctggccgccgccttcactggagaattcgccgtggggcaggccgccggcgaattcgtgatctccttctttggcggcaccttatttggcctggtgatagcagcagcggccaactggctattcgagaccgtgcgatccctcggctgggaaaccactaccacacgtattctgatggaactgttcctgcccttcctgctgtatttgggcgcggaggaattcaatgtgtccggcattctgtcggtggtggccgctggcctgttcatccgattcgaccgcaccggcgtggggccgaatgtggcacgtacgaatatcgtttccacttcagtatggggtgtgctgagtttctcgctcaacggtgcggtgttcattcttctgggcatgcagctgccgcgcgccatgagggccagctggtctgacccgtatatcagcaataccgtgctgatcggcattattctgctggtcactctggtggtaatcgcgcttcgattcttctggattgcggccatgctgcgcgttgcgcgagatacaatcaccggccagcgccgcaaaatgacacccgaacgctggcgctcggccgcagtgatgacctttggcggccccaagggaaccatcacgctgtcattgatgtttaccatcccgtattacattgccggcggtgcgccgttcccgatgcgtgacgagctgattttcattgcgtcaggcgtgattatcgtgaccttgctgctggccaacttcctgttaccgctattggccccgaaccgtggcaaggatcccagcgcggaaatgattccggtgaccatcgatgtgttacgcgccacggtggaggaattgaccggacgcatcacgccagagaatcgccgtgcgattctgatggtaatcgaccaatacaccaagcgcatcggacgattgcagcagcgcatcggcgataccgatcctcagggattcgagcaattgcagatcgaagcgctgcattgggaaaaggaattcgtgcgcgaccgacttgccgacaccaaggcgcatccggcggcggatacggccacgcaagagctgaacgtcgaagcctgcgagcgcatgcttgaccagattatgaatacgctgcgtcacacttccactgatccgacttcggggcatgcggtatcgcagattcgcggtcgcttacgcatgttccagcggcagatgagcaattacgccaaacgcacggtgtccaagattcgccataccacaccattggtgagcgaggaccagattttcgcgcgcacccgcgaactgcaggtcgaggcgattcatcatgttatcggtcggcttattgacgagatgggccaggatacgtacaacaccgagcattgttcggcactgttgctggattatcgtcgtgccgaggcttcattgcaggcacgtccgaccatgagcggcactacggaaaccatcacgcaggtcgaggacgtaaagcgcgagagctacggtatcgaactcggtatgattcaggacatgtacgaagccggcgacatcaaccgagcccaagcccgctccctgaggcgcaacatctacgttatgcaagtggacgctgattccggcatctagtttccctggctcccttctctgaggggagccaagttggggattgctattcccgtgtgactttgagggctacccagatgctgcgaatcagcagaaccgtcagataggttgcgaagagtattccgccggcacgcgggctcatggccccggcaatccaagtgcccagcggtgcggtcagtgccgccacgatgccgataatcagaccggctttggcatgcaccattttgcggcgcacattggccacggtggtggtcatggcattcgggaacatggacaacagcgaagtaccacgcgcgatcaaatcggacgcgccaaacaggatcgacaaagccggcacgcaaatcgcgccgccgcccacacccagcaagccagccaaaataccggcgagcacgccgaaaacaatcatcagcaagacagtaaccagattaaattcgattgacgaatcacgcgaaggtataaaaataagctggctcgcgatgataaacgccataaacaccacgaacgcccagcgcagcacgacttccggcagtcgggacaacagcagcgaaccaatctgaccgccgatgaacatgcccaggaacatcagcagcgcggcaatccaatccacattgccttcaaccgcataggccagaacaccagacaccgaggtgggcacaatcgccaacatcgaagtggcggccgcatgccgctgggtcaggccgagccagaccagcgcgggcacgatgatggtgccgccgccaatgccaaacagtccggacaacagcccgaccaacacgcccaccacaaccataaccgcgatgccgcgcggggactcgtccacatgattctcttcagtatgtgcagtagtacttgcagtgctcacttcgctcatgggagaacagtctatgaccgagtcagccacaagcgccctcgatgtccgattgctgcgacggccgcgccaattccagtaatggcggctgactacagcacgccagaagtaatgtcgttgtcaagtagccactggcgtaaatcggcgaactcctcaagactcacattgtgatccagaccgtggtagctcttggttttcagccacgtatgctcttccagccaagcggcggtggcgaacagttcgtattttgggattacgccatcgttcttgccgtacgtatagaacacggggatatcgtaatcggccaggcgagagtcggcgggggccgtgccgggcacctgaccgggtgtgttgaagccggacagggagacgacggcccggtaccgctcggggttgatgcgcaacaaatgcacggcgaccagcccaccttgcgaaaacccaagcggcaccacgtcacggtcggcgggaatgttgtcggccacccatcggtcgactgctgtggcggcggcatacgcgtcgtagtcacgatcatcgccgataggcagggcatcgtgaaaccacgcgtagttgccggggtcgggactgccttcacgggccggcgcgagtgtcagcggcccgcgcagtgccacgaagtcgttatatggagcgatgaggcgcatgatgtccgccatgtcttcttcgctggatccccatccatgcaggcacaggaacagcggatgcgtggcatgctggtcgaagccgccgcgcgaggtgacgctgtgttccacggtgagtggctcgccaaaacgtccgggcacagtggtggattcgcggccgatcagaggctggctggcattcgcttctttgctcataccattccaatatagaggtcttgcgcgctgtgcggaaaacgatggaccatgatttcaatcacattgggtaatccgcgccgaatcgccttgggacttttcaagggataccggcaatctgtcaggcgttaccgctgtctgcggtatctgcggctgcggtgattgtctcaagttcgccgccccactgctgctgcagtgcggtcatcttgctggcctcgccgaacaccatccagcgtttgccgttcagcaatcgccaatcacctttcgtttgctcattatcagcgtattggctcagcagttcggaaatcttgctttcgataggtgcccggctgatggctgcggacgattccgattcaaaggatacgaaggccactctcggatcagtgcacatctgtacggtggtgatgcccggcaaaccgcccgtatcaagcccctgccatccttctttgcacgcgccggcagcttgttcgatgccttgctccatctgtgcggtatcttcgacgggtgccttgtcgttcgactgctgaatcagtccttccgggaacaatacgcccacggccacgccgataaccaagcaaactatggcgcacaccagtgcgatgatgccgcccgcgcccactcccccgtgagtggcgtaccgaggcatggtgactcgcgcagcgatgaccagaatcagggtgatgccgataagcaccgccgccgtcaacgcaatgtatcgtcctggcactgccgtcataaaggaaatggcgtaaggcgcgatctcatgaaccgccgaggtggccgataccacgacggctagcagtccgctgacaacggcaagtctgcggcacaatatcgacgttgggctgctggcttttgtagcggcgaatcgccggccggcatcccgcctggatgggcgtcgattctgtgcacgacgtgagctgcgcgaatcgtcatactgaccatcgccgaagaaatcgtagtcctcatcgttgcgggccatcggtgcccccttcctgccgattacacagctagtgtaccgctatggcttgggaatggcggtcattcggggaatgattcagggcacaaaaagaaccccggcggttgcccgccggggagagaaaggagagagaagaagaaagggggttcaattgtcgggaactgctgcggctcctgatcagctttccgctgacatcttttatataaccactgctttctgggtctacctctaagtttctctgagaaaaacctgagaatacttgcgattgatggaccgcggaagcgtgaggagcctctcacgtttccgcccaaggcgctagacttgaaggcagtatttatttgcccaaggagtttttcacatgctgctgtccgaccgcgacattctcgccgcacagtccgcaggtcatatctcacttgatccgtggacccccgaaatggtgcagcccgcttccatcgacgtgcgattggatcggtacttccgtttgttcaataaccacgcctacacctatgtcgatccggcggaaaaccaaggcgcgctcaccgaacagttcgaggtggctcccgacgaaccgtggattttgcaccctggcgagttcgcactgggttccacgtgggaatacgtcaagttggacccgtccattgccgcccgtctggaaggcaagagctcactgggccgattggggattctcacccattcgactgcgggcttcattgaccccggtttcgaggggcatattacgcttgagctgtctaatgtgtcgacgttgccggtcaaactatggcctggcatgaaaatcggccagatgtgcttcttccagctgagctcgcccgctgagcacccttatggctccaagggcaccggctcgcattatcagggccagcggggtccgacgccgagccgttcctacgagaatttctaccgcgcgcacatcgacgactgagcgttgcgacgtaccattcggccggcggatgccggccatttgcttaatcccaaggagatgtcatgaccaacagcgatggcgggttccagttcgacttccagcagcccgaaaagccggtcaggccaacggttcctccgattcccgggcaagagacggcagcatatagcacagaacccacggcacaagccacaccggctctgcagttcccgcagtctgtgcagtctgcgcagcccacacagcccacacagtttgtgcagcccgcgcaagtagcgtatgcctcacaacccacgcaagctgtgccgaccgtacaagccgctcagccgacgcagcccatcgatccggccatgacgcaaccgttctcgccgcaattcctagctgcggttgccgcacaagcaccacagccggcggcagccacgcagccagtagtatccgaaacaccaatcgccgctgtgcccggccagcagcaatacgtttgggatcagacgacgcaaagcttccgcccggtggaaccgacagcgccggtgacgccagcagcaccagccgcaccagcggcaccggcgacatcgcctgtttcggtagcttcaaacgccgcgacacaggcgttccaacccaatcaggccgagcagcctgcggtagatgccgaggcaacacaagcgttccagcctgatcaggtcatggcaacacagcctttcgaagctcaggccatgccgaatgccgaaaccgcggccacacaggcatacggcgcatcatccaccgtatccggtgagaccgttgccatgccggcaacgcaagtagcgtctgccgatgatgctgcagccacacaggtgttccaaccggccgccctggccgcttcggcacaggctcagcctgctgtgatgcctccctccattccgttggatcaggtctccgatgaggacgattccgatggcgccgagcctcgtcacggcggtagcggcaaaaagaacacccgcaagatcgtcagcattgccgtagcagtagtcgccgtgatagcgctggttgtcgccggcctgctctggtggcattccaacagcagcaaggcgagccaagccgtggcattggccgagtgcaaggtagcggccaagcagtacacgaatgctcagaagaagctcaccaccgccatatccaatggccaaaccagcgcgcaaacatccaccagcgatgtggccgatgccaatacgctcaccacgctgaatcaggcgttgcaagacgccggcaatccggctgacaccgccaagtgcgattccaacctcaacgccactgagttgaagtctcacactaaagagctgcagaatgatgccagcgacatggctgacaagacggatgccatcaacaacgcgatcaaggccgttaatacttcaaaggcgacggccgataccaacacactgaaatcgaacctgagctcggctatttcgcaggcgcagggcacgctggataattccgcgggcagtgtggccgatgaaaacacccgcaccgcgctgcaaaacgccatcaccgaggccaatacggtgatgaacgggaccagtccgtccgaatccgacgtcaataatgcgatttctaaactgcagaaggccgagtccgacgtcaccgcctcgatgcaggccaagcagcaggcagatgccgccaagcaagctcaggaagaggctcagcagaaggctgaccaagaggcacagcagaagtctcaagacgagtccaacaatagcgacaacaataacggcggcgacaactccacctctactgacggcactgacggcagcaacaactgaggtctgcagcgttctcctgtttcccatggggcggtaactccccatggggcggttagcatattttcctttttcgcggaataatgccgttttcagcgaccgccccatgggatagttaccgccccatgaggagccgtttggatatagcagtgggccgggctctgaataccagagcccggcccactgctatatgcccacaatcagggctattgcgatggcttaacgcttggccatcgcgcgtagcacaatcttgcgcagttcggaggcaatcagcacgattgcggccaggcagatgcattccacccaagccatcgggctcaatgccacggtgccgaacggaccgttgaggaacggcacgtaaatcaccacgagctgcagcgccacggacaaaccaatcgcaccccatagccacttgttggagaacagacccacgaatgcggactgcagatgcgaacgggaggacagcgcgttgaatagctgggcaaacaccagaatcgtgaagcccatcgtacgggcctcggtcatctgcgcttcatggccgatggcatccaccgagcggtcggtgaacaagccgccggacaggtgcatgtccataccaatcagcgtgacgatggccatgatgacgccgatgtagatgatgtcgccccacatggaggcgtcaatcacgcggtccgtcaccttacgcggtttacgacccatcacatcgtcggtctgcgggtccacgcccatagccaacgccggcgcggcatcggtcagcaggttgatccacagcaactgtgtggcgagcagcggcacggtgacacctacggtttccggctggcggatgccgaggaagccggcaaacaccacaccgaggaacacggtgaacacctcacccacattggaactcagcaggtagcgcaggaacttgcggatgttgtcgaagatcacgcgaccctcgcgtacggcggccacgatggtggagaagttgtcgtccgccagaatcatcttggcgctctgcttggtcacttcggtgccggtgatgcccatggccacgccgatgtccgcggacttgactgccggggcgtcgttcacaccgtcgccggtcatggccacgatgttgccttgacgctgcaaggattcgacgatcttgagcttgtgctcgggggccacgcgcgcgtacacggacacttcggacgtggccttgtcgagtgcggcctcatcgggcagctggtcgagctggtcgccggtcagggccttgccgtccttggcgatgatgccaaggtcggaggcgatgcgggcggcggtcagcgggtggtcgccggtgatcatcaccgtgcggatgccggcacgatgggcctcggtcacggagtcgcgcacctcagtacgcggcggatcgataatgccgaccatgccattccagatgagatcggtttcgatggcttcggcctgatcggcgatgtcggacacctggcctgcggcgttgacgcttacaccgggcacatcagccaaagaactggtttccagcggacggcaggcctcgccaagcgtacggtaggcctcggaggagagacgttcgacggtggcgagaatcgactggcgatcgccttcggtgagcttacggacctgaccacccacgcggatgcgcgtgcagtagctcaacagcacgtcgggcgcgcccttggcgaacacggtgagcttgtctgaatcggtgctgtccttggcgatgatggacatgcgcttgcgttcggaggtgaacggaatctcgccaacgcgcgtgtagcgcttgatcttgcgatcggccttgaccttgcgtgcggccacgatcagcgagacttcggtggggtcgcccacaatctcccaacggccgttctcctcgcgtagttcgccgtcgttcgcgagcgtgccggccacaagcgtggcgacgacttcatcggccacaatctgggcctgctcggattcaggactgacgccaccggtcataaccatgcggccttccggcgcgtaaccggtgccggtgatctgcactgcgccggacggggtgaccacgcgctccacggtcatctcgttgcgggtcagcgtaccggtcttatccgagcagatcacggaagcggagcccaaggtctccaccgaatgcagtttcttgacgatggcgttgtgcgcggccatacgctgcacaccaagcgccagcaccacggtcaggatggcggccaagccttccggcacggcggccacagccagcgagacggccaacagcaaggaatcaatcacgtcatggacgtcgttgaagccttccagcacggcgagcgccaccagcaccacgacagcgatgacgcacaccgcaatgccgaggatcttggagacgtaatccatctccttttgcagcggggttttctcatcttcggtggcggagagcatgtcggcgatcttgccgacctgcgtgttcataccggtgccggtcacgattgcgcggccggtgccttgcgtcacggaagtgccgttgaagatcatgttggcacggtcgcccagcgccttggcttcggtgagtgtgtccggcttcttaccaaccggcacggattcgccggtcagtgaagcctcggcgatgcgcaggctggccgcgttgaccagtcggccatcagcggagaccgaatcgccttccgcaaggacgatgatgtcgccggggaccacgtcggcggtgttgatgcgcatgaccttgtcatcgcgcagcaccgaggtctgcggggccgtcatttgtgcgagcgcttcgacggccgcctcggccttggcttcttgcatatagccgagcacagcattgacaatcaggatcaagatgatcacgatggcgtcgaacggcagcacttcgccgccttccgcgccgggctgcgcattggctttttcgatgaaccaagcgatcaccgagataatagtggccgcgatcagcaggtagaccagcggatcttggaattgggccaggaatttcttccatttcggtacgggcggggcgctggcgagctcgttcgggccgaatttggccagtcggcgcttggcttcttcctcgctcaggccgtgggatgggtcgacgttcagggctttggccacgtcgtcggcgctggtcagacttggatcggtatcccccaatagcgcttcctgtgcgcgcacctcttccgattccacgaccccgttcgttgcggtcgtggacactgcggattgatctttgagatcatccataatgttctccttggtattgccgcggagtagtcagccttgcggccgctgccgggttttctctcccggctggacgcacaggactgcgcggttatggacaccggcgcaactgctgccgatgcatacgattgccattattccataaccgcgtggcgcacttggcgcacagcgtaatagcgttttgcctagaacaggcgacgcaaccaggcctcagccaaatcaggccaacactgcacgcattcgacgatgtgcgcatagaagccgttaccggcagtttccgcattggccaaggacaggccgtggctgccttcagggaacaggtgcgcctcaatgctcacgccggcggcccggcaggcctggatgagcattagcgtgttctccacgggcacggcgtcgtcggtcatggtatgccagacgaagacgggtggcgttttggcatcgatgtgcttttcgatggagaacttgtccagcaaagcctgattgtgagcttggtcccctagcaggcattggaagctgccgcgatgggcgtacttgccggcggtgattactgggtacgagagcatcagcgcgttcgggcgcacggcgtccgggtctatgccgccctgttcgcggatgtcttcgtcgccgaccgaggtggcgaggttggcggccagatgcccgcctgcggaaaagccgagtacggccacttgcgcggggtttacatgccactgatccgcattggcgcgaatcaggcgcattgcctcggcagcctccagcaaagccaccggatagcggctgggctgcaccgaatagcgcagcacgaatacggcgaagcctttggccaggaattgcatggccactggctcggcttcgcggtcagaagtcatggcgtagccgccgccaggcaaaatcaggatggccgggcgtatacggtccggttccatctcctcgctgttgtcggccacatagccaaagaatcgcgcctcgctgccatcaatgccaacgatggtttgttgaatgtattgcatgccatacatcatacgcgcagagaatagttctcgataagaaccactcgccatatgcggtcttgcccgtatctccaaaccgaataacacttacagcgaatcgtgaagactgcgggccatggcgcggtcgcgcgagcctttggtgagcttgagaccgagggtcacggcaatcaacacaacagtgcaggcgatccacagcgttcgaccgccgaagttgctgatagtccagccaccaatcagcggcgccagcgcaaccgacaccgaccacactacgttgtagacgccctgatacgtgccacgcgccgacgcgggtgccatggcggcaaccgtagtggtggcgatagggaatgtgcccagctcacccagcgtccacagcactacggcaagcgcgaatccgccccaagaatgggccgcggcctgcaccgcatagccgatgacggttacggcgaggcccatcaccagcacgcgtgaattgcccatgcgcgcgaacagtttcatcgcgggaatctgtagcaggcacaacataccgccattgatggtgagcagcaccgaatactcgcccagccctagaccaaggtccgtcatggcaatgggcaggccggaggtgctttggaagtacacaaggaagtagccgaacatcagcagggagaagccgaggaatggagtatcggtgagcacgcgccgccaattgcgagacatggcgcccttgacactggcagccggtgcggcatccgagtgattcggcctctcaatgccggcgaattccgcatgggtaacactgcattcgtcttcatggcgcaccgcacttggcaccgatacagtaatccccaaatgccgcacctcgcggaagaacgcaatcagcaatatcgtgacggctatcatcaccgccgcttcaacgtagaacatcagcgaatacgagatcttgaccagctggttggccacaatcggtccaatcgcgtacccaaaattaatcgcccacgattgcagtacgtatgcacgttgctgacgttcggcaggcaccacatccgcgatatacgcggcgatggccgggctgggcagcgaggcgaacgcaccatagacgaacagagccgcgcctaaagacacaggatcagtgagtacggaaacgaccagcagggcagccgctgcgccgatttcgccgatgataatcatggattggcggccgaatctgtcggacaaggtaccgccgaacaggcagccgatgattgcgccgaagccgtacatggccacgactgtgcccaccacaccctcatcgaggcgcagcgcggaaaccaaatatatcgacaagaatgaggtcacgaagcgacccatccacagaatcagaatcgccaaccataatccccaatacagcagggacagtccgaatatcatacgctgcttcttcactctcaataccttaccggctaccgacggcggaatagccgcgttttggcgcggggtgctgggacaatagcacctatggctatcaaaaaaggaccgaccaaggggtcgggtggcaagcatcgcaacaaactgaagggctacggccccactcccaaggccgaggaccgcgtctatcacaaggcgtacaaggccaagaaagcggccgaacgtcggcagatggccgacccgcgtctggcagcccgccgtcgagtggacaagttcgcttcggcggatacttcggatctggtgtacggccgtaattccgtgctggaagcactgcgcgtaggcgtaccttcttccacgctgtacatcatgtctcgtattgaacatgacgatcgtactcgcgaaatcgtgaaaatcgctggtatgaacggcctgcacatgctggaggccgatcgtctggagatggatcgtatcgcccgctctggcaaccatcagggcgtgattctgaaggtcgatccgttccagtactcctcgctgaacgagctggccgatcgtgctgagaagaaggccaaggcaatggaggccgcgaattcggcggccgcccgtattgctgcgcgaccgctgtttatcgcattggacggcgtgaccgatccgcagaacctgggtgccgtgattcgttcggcggccgcattcggtgccaatggtgtgattctgccggaacgccgttccgcttcagtgaacgccgccgcttggaaggtgtctgccggtgcggccgcgcatatgccggtggcgcgcgtggtgaacctgactaaggcacttgagggcttgaaggagcgtggatactacgttgtcggccttgacggtggcggcgataagctcgtcggcgagactggctttgaatccgatccgctcgttgtagtgctcggttcggaaggcagcggtttgggccgactggtgcgcgaaacctgcgacgcgattgccggcatcccgatcagctcgtctgttgagtcgctgaacgcttcagtggcggcgggtatcagcctgtacgcggtgtccaacgcacggcgcaaggctgcggcggagtgattgtcgcttgaggccgtaataggttgtacatacacggaagcccctctatttgaggggcttctttgtgtgatgggctcacctacagacagtccaccggattgtccgcttaatgactccacactgccgcatccggatcgtcatcggggttgtagccgtcgtcgtccgggtcgctgtaggtggattcgtcgtcaatgacgccggaatcggcctcttcgttaagttcggcgagtgccttggagtcaaggctgtagctcggcagagcgttgtcgatgtagctggtcacggcctcgcccatcggcacgtcgtggccggccttctccgccaggaaccagcgatggtcaagcacctcatggaagaactgagcaggctcgatctgggagcgatattcgcgcggaatcatacgcacggtcggctcgaacacctcacgcatccagtcggtggccacgatttccagatcctcgccctcacgccacgtggaggcacggtaggcgtcaaggtcgttgagcagacgacgggcctggttctcctgcacgtcaaggccggtgaggcgcagcagcttgcggttggcgtagccggcgtccaccacgcgcgggcggaccagcacacgcttgccgtcctcggcggtcttcatttccagctcgtccacgtcgaagcccagctcgttgagcttgttgacgcgctgctcgatcttccacatttcgtccgggttgaacttgtcggtgtcggtcagggcgctccacagcgagtggtagcggtcgactaggcggttgcccacctcgatctcatccacgtcgccgggcagtagcttgccggacgccaaatccataagttcgccgatgatgttggtgcgggccaagtcgatatcgtattcgcgctggccgtcggtgagctgggcttgcaggtcaccggtctcggcgtccaccaggaaggcggagaaagcgtcggcgtcgcgcaggaacaggacgttcgacagggacacatcgccccagtagaagccggccaggtgcaggcgcaccagcagcacggcgagggcgtcaatcagtcgttcggcggtgtccgggcgcaggttgcgggcgaacaacgcacggtacggcagcgagaacttcaagtgccgggtgaccagaatcgcctccagcggctccccttcacgggtatgacggccgatgaccacggcgatcggggtcacagttggcagttcgagcttctgcagtcgacgcaggatctcgtactctcgctcggccacctggcgcgtgatctccttcatggcgtacacctcgtcgcccacgtgcacgaatcgcacgacgtggcgggagatgcctcgcggcaggttggccagcaggtccttaggccaggtggccaagggcttgtgccagggcagcgtgaacatctttgggttcgagctggcggcggtgattttcagtgcttgcggttccgctgaatcggcgtgttcgtcttcggctttgacagacgtggccttcagcgcacgcggatccatctggggcaattcgttcaactccatgtgttcgattttacgtggtgcttgggaagtgcgcttcccagccacatattcggcgcgttattctcgcatacgaataaacaaaaagtcgggtaatcccccacatgaatgagatcagaagaaatcaagccatctttaattttgtatcgcaagcaccagcaaaaagcatcaaacaaaataggataccgaacaacacaaaatcgatagcccagagacaatcctgtttgctcgttttgcccccgtcatccgcagtaaagagccacccaactatgaggacaacgattgaataaacaaaccaacctgttgcgcaaattattgcgattaaatcaaaagcagtcatggtcagaggagctcccaggctcatttcataacgctttcgtcatctgtatgggatttgtcgctcaaattgacgtcactcatgcggcgcctcatgcgcagcctgaataaaacgaacgcaacgagtagcatgagccccgctgccgcagcaatgcttcctacggcggcaccggtacggccgataacgccaggctttaccggctccttgtttggattattttcgggcggagtgacgagagttccggcgctaaatttcggctctaccgtgatgttgagatcggcggccgtatctccgctgccaggaatcgagatgaggaacggatcacagtcgtatgccttgttggctttcgccgaatccgtgcgggagaccagatataggccaagcggtaggttctggaaagtgagctgaccagctacgttagtggtgccggaatgctggtatagcttgtttttcgccgcgtgtgcagccagcttcttggcggcatcgtgatattcgctcgatgtcaggcgttcccaatcggcagtgagaccggaaaaatcactgacggttttatatgaggaaacgctaccatcattgttcgttgtgacagtggcgacgcgcacgatggcataagtatcgccggcaagtgatttgggcgaagccgtgtctcggccccatacggcattgatggtgagagtgccgaaggaatcagcttgcgcgtatggcaccatgaagccgaaagacacaagaccagtgaggatgatagtaatggtggcggcaatcatggcagcaatgcgcgccgcaccatactcgcttccgctatgcgggtctaacatgtctgcccggtcctttccgccgtgatgaatgtgattggttatttgtattggctggctgaggaggcaagtcaccgtccggctcgatggctgcggagctagaatcatcagacgcgaccttggcgctcccactctgccggcgtcgccgctcatgccgttgccacaaatgccatgcgatgagcaaggcaatcaatgcgagagacggcaacaagtactgcagcgggatgtccacgtggaatgtggatttggcgtcatcctgctgctgcggcgcgtatgggatgcgatgaccgcgcaccagcagccggtgcgtgttgaccgcatacggtgtgcaggtgatgagcgtgaccaaatccttgccgggctcgattgccagttgtttggtatcggtcggcagaacggtagtgatcttatcgacctgatacgcatacgtgtctttaagtattgtgatgtagaacttgtcgccttttttcataaggttcaagtccgtgaacagttttgccgtgggcaagccccggtggccagacagcgccgcatgagtggacgcgccgccaactggcagtgaggtctgtttgagatgtccgatgccggattgcaacactttctcggaagtgccgtgataaatcggcaaggtctcatcgagcttaggcacagtgatgtatcccatcatgccgtcaccgtcaatattgagcagactgttgtattcctcgtccgtggatgcggaattgacggcactggcaagagcgtcggtctctcctgcatcgttctgggcgagcttttcgttataggcgtgcgcagcatccagcaccttctggtactgttcctggctcaatgcttcaacgctggcgtcgtagttatttacggcgcggctggcgttgcgcataatgaggaagttgctgatcgtcggatagaacagaatgagcattccaccgagaatgactagtaagggtaggatgttgcgcagtcgtttcatcgagcgttcttttcgcaaggaaaccgtgttgtgggcgtagcgggtgtgtgcccttcacacccaaaacacggtcatgttcgtcaggcgttcttgcgcttgagagtccaggcaacgccgagcgcgatgaccagcacaccaatcaccgtgaaggcgatggtacccatgccaccagtttcaggcagggtaacaccggacttgttctggaccgggataacaccgttcgatgcggactggttgtagttgctgccattgttgttgttgtaggtgatggcgacggtggcattcgtggtgtcagtaccgtcgttctggccatcaaccttcacgccgatggcgctggcgagcttgttgtagccggccggcgctttggtctcggtgagcgtgtactcgccgttcttcagtccctggaagacaaccttaccgtttgcaggagtgatgataatatcacctgtctcaccagccttggctacacggtatacagcgttctgggtctcactatcagcgactttcacgaagctaatagcggagccgtccttatgtgcgagtgtgaactcagcgccagcaagtcgagtagcggcatcatcatattttttaccagtgtacttatcgacggtgaagccataagtgaagacgcgaaccttgctgggttcggactcaccggtgccactgctgctcgggttgttggagtactgaatcgttgcggagttggtgttaccatgaccgcccacagcagccttctcgttcaacgtggccgtgtaggtgacggtgatcgtcttgccggcattggcctgctgcttggccttgaagtccttcatggcgacagtaagcgtattgtcgggggccgtaggagtggtgacggtgtagtcagtgcccacggtcagtggattagtcacaccgtcgaccgtaacggaagtgacttgtccaaaggtgaggcccttagacaacgtatccttgaagttgaaggtgtaggtgtcataggcggacatgtctggaatggtggaggtcagggtgaaggtcagggtatcaccgatcttcgcgtcggtgacgtccttaccagtgctgcctacctgtaccttcttgtcgacggtaggcaggtcgcccttgatgtcggcagtcacattagcgcggtcaacggaaactagcgtggcgtattgaccactggtgttggccaaggtcgcacccggcacagcgaccacgtagtagccgtagtcgagaccagcgaacgtcgcagtgtacttaccgtccgtggcatcgtcagatacctgagtggtcacgccagccgcgatgttgttggccttggtctgcgcccagttcgatgccttggtagcgaaagcaaccaagtcttcaccctgcagcttggatacgtagtcgtttgctttatcgttgacgttctcgttggtagcaccagttagtccggaagcagcggagtcctcaaagaacggcttccactcgtcagtcaacgtgtaggagacagccgtgccgtcaccgctcacggtagcggagaacatcttgtaggcgttcacggtcttaccggcgaacttcgcgtcagcagtgctgaccgtcagcgtggcattatccgctgcgttggccgtggcgactgtcgtcgcggccaatccaaatacggtggcaatcgccgcggcagcagcgaaaacctttttcatcagtgatttcattactgttcctttccctaaatggaaatcttttctgtttggcaggtacggtttgtctatgtggtcgtcacgcggcatgggcacctcgctttcgtatacggctggaacccgagcggactgtgccggattgaacgcgttgattacgcacgtaccagaccacgccagctcccataagcagcaagccgaacatcaggaaccacatcgtgcccgcacctcccgtatccggaagcaacgccgcattggtaacaatggccacgcgttccttggtgttgtaggagaccgatacttggtatccggcctccgcgggcttgatggtcttggtggtatcgccgtccttataggtcacggcggtttctttcacggtgtacgtgtagtaacgcacgatgtccttgccgttggcatcctgtccatccacgaatgcgaccggcagtccttgaatcaccttgcgccaggtgttgctccaggaagaggcatcggaggagtccaacgtcaccgtccatggattcttctgcgtcacggttgtgcaatccgcgccgaagcattgaatcgtctgcggcgtcaccgtattgccactgccatcggtatagtgcgcggcgatcttcagctcgaccgactgcggccgttcgaggttgccgtccttccataccttctggacggtcaggtcaatggttcggcaaccgtccttgccgcacgggtcctggccgtcgtccggttcgggggtgagtccgccgttgttgtcggtcacggtcgcgtcgagcatgagcacggccttggccggggactggtaggcatcgagctttgtgctgctgccaccagccacagtcacggcgtccttgatgccgacccatgtggtgcccgcgtcgccggatgcaccactgtgcacagcgccgctgtcgtatgtgttgaccacgtcgaacagcttcacttcccaacgatcgagtccggtgttcagcgcatcgtctgccgtgttcttctgcgagaagatcttgttgccgtcctgtgcggaggtgcgggcctcaccggcgttcgcggccgccttgcggtagatgcgataggtgttgtatgccttgccgccgttgccttcatcgaccggtccgaggatgtcgctcatggtgttgaagtcccatacggacttgagtttggtgttcgagaacgggtcgaccagtccgctggtgccgcggatcgtgtcggcgtagaccatgtggtcgtctgccagcacgccctcgtcgttcagtccggcgaaaccgcccgcgtagcctgtggaaaggtctttcatgccgtcggtatcctgagtcgctccaccaccgaacacgtcatagccgctggcgatgcccgtcacggtggactgttccacgcgggtgcggttgcccttgatgagttggacggtcaggttgctacctgacccatccatgtcgatgccgtccttgctgcagggcagtttgatgacgctgtcgccgatggtgacgatcgccacgtcggtctgctgctggttttcggcgtcggccttggacagggcgacgctcaccttcagcccgaacaggttcacgtacagcacatcgccttccgagagcaccttgaggtcgaataccttgccgaagatagtcgggaaccacttgcccaagtcgatgacgccgacctgctgcgccttgtcgaggtacaggagcttgaccagcgcgttcactacttgcaggagcagttccacgagtaccgagttgacctgcgtatcgaccagataggcgcggctggtttcgccgacgaatccgccggcgatctcgccgctggtgaccttcttgagattgccggccgtgcagcccttcactcgggccaggtccgcgtagccgacgaatccgcccgcgacctcgcgcccggtggccttgtcggtggctttgccgtaatcgtcgccatggtgtgtggcggtgacggtgtagccgtccgggatgccggtgacatgcgaatcaccgacatgcgagccccagatgtcaagtacgccggccgtggcaccgagcagattgagcgcatccgtgccgagctgtgcattgtcggcggcgaccgtgtcggatttgccgaggtgcccgatgaagccgcccacgtagttcacgccggtcacactgttgaggttggtgacgttggactgcttgacggagccattgatcagtccaccgccgaagccaccggccgcaccggtgtaacgcttcgagtcgagcatgcccttcgtggtggaatcatgggcgacgacttggatgccgtcgttcacgccgttgacctgaccgtcgtagatgaaggtgcggaacgcttcgagcacgcccacgttgccgaccttgagcagtttgagcagcaggttggtgtcctgcttatcgccggcctcgccgccgccgacggaagcgacgctggacacatcggcaaggccgaagaagccgcccgcgtattgcccgccttcaacggcacgcagcccggtgactgtaagtgcggctgggtcattgttcggatccgcttcactgccggtgcctttggcggaatccttgtcaccgaggatcgaggcctgcagcgagccggcgaaaccgccggcgttcagggcatacttggttgtggtgttacccttatcgtccttggtctcatatgcgccgtcgaccgtgtatccccatgccgggtcatccgagctcacatgcgcaccgcgaatcgtcgtaaccgtggcctgcaatacgctgaccagacttgccggggtcgagaccagcgagtcgaggattccttgcaggaatccctcggatgcgttggtgtccacatccgcgaccgcgccggcagtggccacgccgatgaatccgccgacgttgttgcggccttccaccttgcgcaggttggagacgttggcaccggccgccttgtcagcagtggccccatcggcaagcttctggccgttctggtcgagatcgccccagatctggccgccgaccgcgagacccacgtagccaccggcgttgccggtgccgtgcgtgatgtcttcgccggtggccacgaccttcatacccttgcggtagccggccacgctcgaggatttgatgactggcacgaatacctgtgccacgtcgagcatctgacccagatcaagtttgatgcctttgtcgccgaatagttggatggagccgaacgaggatgccgagccggattccatcgtgcccgcgtagccacctgccgcacgcatggcggagacggtcttgacgtccatcgactggccatcggtgatcgtgccggtgcgcatcaggccgacgtgtccgccggcgacgccggaatcatgcaggttcgcgccggtccgatactccgcacgtcctgcgacgacgttgaatccgaagatgtaggattcgaggaacttgtccagggaatcctggtcggtaacagagcccgcaccatcagccgtggtcacatcggtgaattccttgccatacgcaccgtacttgccgatgttgtcgacccacgtcttccactggtcgtagctcatattgcgcagcggaccggtgaccttcgtgtgctcctcagtcgggtagaccacggacagcacgccggcgaggttgccggccttgatgagaccgccgagcaaggagagcgaaccgccttcagcggtatcggccgcttccatgaagccggtgtagccgccggcgatttcggcaccgtatacgctgcggatgcgcgcggcataggctacgcgttgcggcccgttgtatttgccgtcggtgttctcctgcttccatgctgcggtgttgttgccccagatatggccgccgcggttacgtcccgcatagccgccggccatgccgcggcgtgtggtcgtatccgatgccgcctgtgcgcgcaccgcgccgccgcacactgtggcatcggtcgagctgttgcgaatcgtcggcacgaagtcctgcacgagcgagagcaggttgtcgaggttgacgagcttcttgagcacgctgccgtcgccgagtacgtttgccacggctcccggctgcatggtgcccacgtagccgccggccgaaacctggccgatgatgtatacgaactcatgcgagctggagtcctggatatggccgccttcgatgtctccggcgaagccgccggccatacccagtggatcgggcttgttgttggcgttcctatggtctgccgtgccggccagcacggagtatccgccgatgccgccggtcacatcggaatgttcaatcgtcgagacgacgacatccagcacactgagtacatcgttgagattgacgttctggtcgagcaggctcaagccgccgcccacggccgccgccgagccgatgtccattttgccgatgtagccgccggcataccgagcggcggtgactgcatacgagctgtctttgctcagataggtgtcgtcgatggatccggtggtttccagattcttcggtgccttgacgtcggtgtggcgcagttgggtcacgctggaatgggatacctgcacgccggaaccgtagccgatgtagccgccggcggaaccggattgcgtatcggattggtcaagtcgggtggcggagacggtgaagccgggatcgtccgggtcggaaatcttgttgccgctggtggtctccacggtggtggcatcggaatgcacgcccgcgtaggagatgaacggcacatagccctgcaccacctgcagcaggttggcgagatccaccgtaccgaatttgccgagcaggctcaggccgccgttgccagccgaagcgagtgcgccggaaacgaccttgccgccgaaaccgcctgcgtatgcgccgccggtcacatggtcgaggttgacaacggccacggggttggcttgaacgcgggactgcacgtctgccagcgttgagtcgttctcgagatcagtttcggagaactgattgactttgccgctttggaagtttcccgcatagcctcccgcgatatccccttcgacgtaaccgccgttgacgtacgtcacggtggtatacgtatagcttggaatcagatacggcatggcaccgagcaggtcgttcacggacagcagtccgcccttgatgaggttgtccaacacgctggaatcatcggcgttgctaagtgcgtcagcgaggccaccggtggtggagaagcccacgaagccacccgcgatgccatcggatgtgctggtatcggccgcgaccgacttgaggttcgtcacatggctttcgcgggtcttggtgctgttggcctgaccgtagaaaccgcccgcagcgtaatcggtggtctcgttgttctcgttcttgccggtcgccttgaccgtgaatccgttggcgatgccgttcacattcgatgaagtgactgcaaccgaagaatattgggcaaccgatagcagaccggaaagcttgataagcccaagcacattgagcccgccggcaccaacggcgtcgcctggtccggagaagccgatgaaaccgccggcttctcccttggccgtgaccgtggccagattggtaaggttcgtgttggtcacgtcaccaccggtggcgcatccgatggcaccgcccgcatagtatgaaccggccttcaccgtcaaaccggatgccggagcggtgacagacatgttctccacggtgaacgcggcaaactggtcgaacttcttgagcgtggcgatatcgccaattttcaccacactgttgagcaacccagctaccgttgtcggttgcagattgccggcgatgccacccgcgtaggagcccgtggccgtgaccgattcaaggccttctatggtggtggagcgctgctgggggaagtcacgaggattgttgtacttccagaacgtaaggttcttgagatgatcctgtgaggagtcgccgatcaccgtgcccgaaccttcgcccacgagaccgcccgcgtaatcgccaccagccttaacggtgagggagcccttcatctgcgtgccgagaatcacggagggattcacaccgacgatggacagcagttctcccgcaccactaccgctgccgctcagcaatttggccacagccttggtgagttgtttcagcagcgatgcgttcgcggcatcgtccgtgccgagttccaggccccatcccacggaggcaaatccggtgaatccgccggcatgggatttatcagtagacacggcagccgtggctgaaatcgtattattgaccgcgtaggcattggccatcgcgccgctaaatccaccggcatagtccgtggcagatacagtgaccttgccatcgccgtcgacggtcaggttgctgttctcgatgaggctctgcggacgcagcgcagacagcaaatcaataccaagcgaatcgagcagaccacccacgttgccgttgcggcttactccggcgaagccaccggcgtattgcgttgcctgcacggtgaaaccattcgtgctcgtcaccgaagagttctcaatgattgcaccaatctgcgcaccgacgaagccgccggcctgcgggttgtccttgttgccgatcaccacgttctttttgaacccgttcaccgaactgttcgagataaccgggttgtagtagccaaccggaatcaaggcattcagcccgagcgtgccggacagcaaccagtccaccagatcgcccagcccgaggaatgggatgacacccaagatcttcgagagtacattggtgagcgttcccacgatgccggagaccgcatcgtatcgggttgcgccctcaacatatcccacgaaaccaccggtcatacggcttacgctggataccgaaacatccgccacttcacaatccgtgaccttggcatcgccgtaaatacggccggcgaacgcacccgtggcgagattggagggattgtctttgtgcagggtgagcagacctcgaagattgaggccaagatctacttgtccgaatgtcagcagtttcaacgccttaagcagaagatccaaaagtccacccactgccgaagtgagcataccgagcaaggtcgccggaatatacgattcactcgtatgattcgccaccgacacatcctgcagcttgaggttcgacaccacggccgtaccggcgctgcccagactgttgctgttcatcacggtcttgttcgtgatcgaggcgaagaagccgatgccctgctgcttgctgacatccagctggtcgcctttgacattagagaccatatctttctgattgacgaccacatggctgatgaccggccgagctgcggtagcgtgaaccacgcttgcgccatcggcaccaacagccttccacaggctggctgcggtgtcgccgtcattggagaccgcaccgagcatagtgccggagaacatgagcggagtccactcggtgttgttggtatctgccgcgttcttggacaggtcgatgtcacggaagatcaggtagttggcgtctgcggaataggtcaggccggtgttggcagcggagtagtccgtttgcgtgccatcagcacccacgccgtaatacttgatgcgggtattaccagcgtccactttcgtacgacatatcgccagcgaattgtcatagtcggaggcatcagcatcgcgcaaagtatctgaatcggagagatcggcgtcaccggcgtattcggaagacggcgtgccgtccacccactgataattgggtccttgtcgcatgcaagtctgcgtgaccttgttgatgcggccaataaccttcttgccggaaccaatcgcacgcagctgctgctcgttaccaatcaggatgtaggtcttgccgttgatctccttggtgacctgaccctcaaagtcacggccgccaagcgccgtcgcggcgacctgcacattggccttcgccggcgattgatccgtcgcatttgaggaatcgttcttggcatcttgagaagaagcatcgtttggagcctgcgtttgggctccatcattggcggaattgccagcggcagcttctgctgagtcgtccgccttattgtctgtcgcaccatttgaggattcggaagaatcaccagtagtagaagatgaaggagatgaatcctgctgtgcgtcttgattcgtttcggaaggtgttggcgcaccgtttgatgtattggcctcttctgacgtcttatcgtcaacgttgacattgcgagcagaaggagcagctacgacagtattaccccccctcctcagaaattacggcattaggagagctactcacatcgtctatattctgagcatatgctgcaggcaccatgcacacgatggacaaggaaacagcaataaccgaagcaaggcaacgcttcaaggcatggctctgccgtccagattcctgttctgttcctccgttaaacccgcaacggacgaacttcaatttcgagctcactgtttcccctcatagattcgcaatcctcttttcgggggttactgcatataatcataccccctttctaggaaaaagttgtcgaaaaactagaaaatgttcatttgcggggccagttagcgtacgttttctaggcaaaaagaaaagccccgcagctatgcagggcttttccaacgaggtcataagagaggaagagaataacctcgtttaatggttgacgaagcgattagacctcgccaagtatctattagttcagacgcagctcagtcgacggagcgaacaggtgcatcttggccgggtcgatcttgatcttgacggtcgcgccaaccttcggcagcgcacgcggattcacacgaatcgtggtgagcttgttctggtcggacatgacctgggcagcctcagctgcggagccatcggtgatgatgttgccgtagatgtagccatcggagcccagatcctcgacgttcacaaccttcagggagaaggcgttcgggtcgtcagccggggccagaccagcgtcctcaggacggaagccgaccacgatctggccgttgtcttcggcggtgagcttgttgacggcctcagccggcaggtccacggtgtcctcaccgatcttcgccttgccgttgaccaccgggtgggtgttcaggttcatcgacggggagccgatgaagccggcgacgaagacgttggccggacgatcgtacagctcagtcggggcgccgacctgctgcaggataccgagcttgatgacggcgatgcgatcgcccatcgtcagggcctcggtctgatcgtgggtcacgtacagggtggtgacacccagctggcgctgcagagcagcgatctgggtacgggtctggacacggagcttggcgtcgaggttggacagcggctcatccatgaggaagaccttcggctcacggacgattgcacgacccatggccacacgctgacgctgaccaccggacagagccttcggcttgcggtcgaggtactcggtcaggtcgagaatctcagcggccttctcgacgcgcttgcgaatctcgtccttcggagtgccggcgatcttcagggcgaagcccatgttgtcggcaacggtcatgtgcgggtacagagcgtagttctggaacaccattgcgatgtcgcggtccttcggctgcatcgtggtgacatccttgccaccaatgaggatgcggcccttgttgacctcttccaggccggcgagcatacgaagggtcgtagacttaccacagccagaagggccgacgaggacgaggaactcgccatccttgatatcaagattcagatcatccacggagggcttatcgttgcccgggtagatacgagtgacgtggtcgaaaacgacttctgccataattactaatcctttcagaggcaggtacgtgcctcacgatccgttgtaaagggatttgttctttactgtgcttccgccctcgccaccgacgtacaactttgctttcggaaactgcaagcttcagcgtttacttttttccggttcagtgaaggttctcttcgttgagccgagaactactatacacggaccgtggaccaaggcaagtggcgtgtctgaaatgtagttaactttatggacgtttctgggggtgttgtgtggttcggcccatgacacgcctgtttctcgaacgtgcgaaccggcacgcccgacgtagagcaggtctgctcttcccggactgatggattccatcagtcgccgactaatgcgacacagactcgaaggtgacgccgttgcgggcggctttgcgctcggccttgcgctcctcggcgtcttcgatgcgctggatgcgcagctggcgccagtcctcgcgcatgtcgcggaaacggtcggccagcgttacgtcatcgttctcggcatcgccatcagtactgctgccatcggccttaccgaacgtgccatcggccaccttggcgatgcccagcttgagcagtccgagcaactcacgcaacgtttccggtacgggctcatcgccctcatcggcggacttggtcaggccctcgatgcggcgacgaagcgcgtcggcgtcctcgggatcgatcttgagcccggcgatcagcgactggcgcatggtctcgtaatcgaggttggcaaaaaaattcagctgttgcagcgtcatgaagcccttgagctcggggaatcggtggacgatgtattcctcgcggtcgtcggcggcgcgggtccagtcgcgggtgagctgcggatcccagctggcggtaatcgacccctcgcgcatgcggtagtggtacagcgccttgggcagacggaccacgcgcgtggcctcgccgatcacgttgcagatacgggagagatcctcgattttgcgacccaccgggaaggagaatccggtgccctgataggtggaggcgggtgccaggaaggcccagaaatagccgtcaatctcagccttgacttgctttttgatgacctcgaccggggtcaggacctgcacctcggtgaagtcgttgtggcgatagttggacagcagcggcttgttgttctcggagatggtgtcgaactggaacatcacgaggtcggcgtcatactcgcgcatggcgttcaggcagtcctccaccaacgtgggtgccacggtgtcgtcggaatcggcgaagtatatgtacgcgccgatagcctcagcgataccggagttgcgggcgtcggacaggccgccgttgggcttgtgaatcacgcgtatgcgcgggtcgcgggcggcccaggcgtcgcacatggccgggcaattgtcgggcgagccgtcgtcgaccagcagaatctccagattggcgtacgtctgcgcggcaacagacgccacgcattcgtcgaggaacttctcgaccttatataccgggatgatgatgctgaccaacggctcctgttccatatctccagcgtagcgccgccgtgcgaacgcggcggcgctgcgggttcgcggaccgcgaaacccttagaagtcccagtcgtcgtcatcggtttcttcggctttgcccatcacgtaggaggagccggagccggagaagaagtcgtggttttcgtcggcgttcgggctcagggcggccaggatcgcggggttcacatcgcaaatctcagccgggaacaaagccgggtaaccgaggttcatcagcgccttgttgccgttgtagcgcaggaacttctcgacgtcatcggtcaggcccacgcgatcgtacagcgactgggtgtactccacctcgttgtcgtacagctcgttgagcaggtcgtacgtgtagtcctgcagatccaggcgctcggcatcgctcagctgggcgatgcccttctggtacttgtagccgatgtagtagccgtggacggcctcatcgcggataatcagacgaatcacgtcggcggtgttcgtcagcttggcgtgcgcggagaagtacatcggcagatagaagccggagtagaagaggaacgattcgagcagggtggaggccaccttgcgcttgtacgggttgtcgccctcgtaatagtcgagcacgatctccgccttcttctgcaggaactcattgttctcgctccagtcgaatgcggcatcgatctgctcggtggagcacagggtggagaagatggacgagtagcttttggcgtgcacggattccatgaaggcgatgttggtgtacacggcctcctcgtgcggggtgagcgcgtccggaatcagggagacggcgccgaccgtgccctggatggtgtcaagcagggtcaggccggtgaagacgcgcatggtgagcgtgtgctcgtcctcggtcatcttctgccagctggggatgtcgttggagacgggaactttttcgggcagccagaagttgccggtcaggcggtcccagacctcaaggtctttctcgtcttcgaggcggttccagttggttgcggagacgcggtcgatgagtttcagcggtttgcgcggaatggagataggtgccatgagtagtgttccttttactcgttgtcgttatcgtcgttggatttgttttcgaactcctccggcgcggtcagccggagcagtgctctatagacggttcgtgacattgttggttccttagatggtggagcccccctcagtccgcttcgcggccagctcccctctctgaggggagctgtcggcgttagccgagtgaggggagtaacaacggctctctggttgttcaatgcgtgcggagaccgccgtctgaggccgaaggcgtacgaaggtacgtcgagtgccgaagaaaggcggtatacgctccctcgaacgatcagagcatgcaggagacgcagccttggacctcagtgccttccagggcttgctggcggatgcggatgtagtagagggttttgatgcccttgcgccaggcgtagatctgggccttattgaggtcgcgggtggtggcggtgtccgggaagaacagcgtcagcgacagtccctgatccacgtgctgggtggcctcggcgtacgtgtcgacgatggccttccagccgatctcgtaggcgtccttgtagtacccgaggttgtcgttggtcatgtaggcggccgggtagtacacgcgcccgatcttgccttccttgcgaatctcgatcttggaggcgatcgggtgaatcgagctcgtggaatggttgatgtacgagatcgagccggtgggcggcacggcctgcaggttctggttgtagatgccgtccttcagaatcgcgtcgcgcagggcctcccagtcggccgcagtcgggatcgcgatgccgtactgttcgaacagcgcacggacccgttcggtgcgcggagtgagcgaacgacgaccatcggtgtacttgtcgaagtagttgccctggccggccggcttggcgtagtcgctcgtagcgaagctggcgaacgtgcggccatgctccacggcgagcgcgtgcgaggcacggtaggcgtggtaggccacggtcatgaagtacatgtcggtgaagtcgaggccctcttcagaaccgtactggatgccttcgcgggccaggaagccgtgcaggttcatctggccgagaccgatggcgtggccctcctcattggcgcggcgaatcgaaggcaccgcgttgatgctggtgtgctcggccaccgaggtgagtgcgcggatcgccgtctccaccgtgtggcccaagccgccatccatcgccttagcgatgttgagcgaacctagattgcaggagatgtcgcggccgacatgcgcatacgtgaggtcctcgttgtatgcgctcggctcctgaacctgcaggatttccgagcacaggttggacatggtcacgcgaccttcgatcgggttcgcgcggttgaccgtgtcctcgaacacgatgtacgggtagccggattcgaactgcagttcggcgatggtggtgaagaacttacgggcgtcgatgtaggtcttcttgatgcggtcgtcggccaccatctcgtcataatgctcggtaacggagatgtcggcgaacggcttgccgtacacgcgctccacgtcgtacgggctgaacagggccatctgggccttctgtttggccagttcgaacgtgatgtccggaatcaccacgccaagagccagcgacttgatgcggatcttctcgtccgcgttctctcgcttggtatccaggaagcgcaggatatcagggtggtgggcgttgaggtacaccgcgcccgcgccctgacgtgcgccgagctggttggcataggagaaggagtcctccagcagcttcatgaccggaatcacgccgctggactggttctcgatgtgcttgatcggggcgccgagctcgcgcaggttgctcagcagcagggccacgccaccgccgcgcttggagagctggagggccgcgttgatgccgcgcgaaatcgactccatgttgtcttcgatgcgcaccaggaagcagctgaccggttcgccacgctgggccttgccgagattcaggaaggtcggggtggcgggctggaagcggccggcaagcatttcgtcggcgtattcgatggcctgctgctcattgccggcggcgagctccagggccacagcggcgcaacgctgcgggaagtcctcaagatagaggcgaccatcgaacgtcttgagcgcgtaggacgtgtagaacttgaacgcaccaaggaaagtgccgaactcaaagccggcggattccacgtgctcgtagatgcggtcgaggaattcagcggagtactggttgaagaccgcagggttgtagtactggttgctgatcaggtattcgagacgctcggcggcggaggcgaaccgcttgctgttggtggccacgtgccctgtcacgtattcgcgttcggcggccttgtctttgtcgaactggatcttgccgtcggcgtcatagaggttgagcatcgcgttgagcgcgtggtaatcgtgcgccgggtcgtactgttccgctgcggtgtcggcagtattgtcgagcggcaggccggtggcggtgaggtcagtcattggaaatccttggaatatggcagaagtgtgtttactcagacagttgctcccctcagtcaacttcgttgacagctcccctcggagaggggagccaatacctcgagggggtcaagatttactgttcggtgaagaagcggacgaggccgtttcgcacggcggcagtgtcttccggggtgcccatgagttcgtaacggtagaggtagggcaccttgcatttggcggcgatgatgtctccggcggcacagtaggcctcaccgaaattggtgttgcctgaggcgatgacgccgcgaatccactcgcggttggctggatcgttgaggaagcgtttgacctgaatcggcactgctttcttgaccacgccgccgccataggtgggcaccatgatgacgtacggttcgcggacgtttagcgccggggcggcggcccgcaacgggatgcggtagacgttgatgccttcgtcctgcaaacggcatccggccacgaaccgtgcggtgttttcggaggccgacgagaagtagaccaatgcgccgatcgtcttgccttcggccgcgaattcgggctggctcagactcacgcggacaccgtggcggcggcgcggttgtcggcggccacctgctgggcgacttcgcgaatcaggtcggggcggtagccggtccaggagttgtccggcgtgatgaccaccggagcctgctggaaaccggcggcctgcagctgctcaagggtggaggggttctgcgtcaggtccacggtttcaaacggcacacccagcttggtgagctggcgcttggtggcatcgcactgcgggcaatgcggcttggtgaacacggtgacggtcatggcgactccccttgatgtggttctgatgaacagtgaagcgaaggccatattacagcggtgtgatttgaaatcaaggcactatatgtagtggcgcgtgtcacataacaaacctagatatagggtttttcattgatattccgccattcccatgcacccccgaaaatcggcgtgcagcgacccgcccaatcacatgtggcattgttcacatttgcgtttgaaccgctcttcgactgatcctcaaccgccctgcaaccgccatcttgagtttcgaggggctgttttgaccctttccggagatctatctccgtttcgaggggctggtactcaagtaagcgcatccccaaaatggcggaatgacggtggggcgaagccgtttatacccgtgttctagcgggccaccagcccctcgaaacgggagtaaacctctacggaaggccaaatcagcccctcgaagcggagaacggatacctcggcaccccgtgtggagccagaaggcccggccggatgtccaaacgagcatccggccaggccttaaaagtagttgttcagttatcagaatcgatgcggcgcgatactactccgcgtctttacggctccaacagatcttcgatgcggcagccaagcgtgcgggccaaagcgagcacggtggagacggcagctttgccaaggtctttgcggcgctgctcgtacatttggatggagcgcagggtaacgccggagcggcgggccagcccggattggctgagtccggcgcgcacgcggatcgtgtgcagccgggagtcgccctcggtgcgattatgggcggcccgctcgtcgtacacgtcgacgaatcggctttcgtcggcttcgtgcaaagccgggtaaagtcgcacgatatcgccgagcgacagcacatcgagaatgtccgagaaccgcactcccctggcccattggcagtatgcgagtacccatccggcccagtattcgggtgttgagccggcgcgcagtgcggctggcggcatatcgagaatgcgcgcccaaccggtttgccgcatgatttcggccaccagctcctcgccggacatgccacacacgtatttgggcgtgcctcgcccgaaaagcgcggccgcctcggaggtggcgaagaagtccatgaataggccgaccggcaacccgcaatcgttcagcgcataatcgaaggcgccggccaagttggccatggcgtccggcaagtatgtctcatcgtaggcggtgatcatcgttggtcactttctcacggatgatgtcgcgcatgaacaggccgtcgagatcggcttcagcgctgttgcgacggtaagcttcacgagccgtgcggtcgcgctcgttgcgcaatacgtggtaggtcgaagcgcgggcgatttcgcagccttggaaccgcagcgccgcgaatgcctgaggactggtgagtacgatctgcttgccgagctcacccaaccgcatcgcctcggcgagttggtcgagggaaatcgcgttattgacaaaagcgcgggcgaacgagaaatacgaatcgtcggcacgatatccgacgatgacgtcagactgactggtatccggcagagacacttgtttcagatattcgatgccttgcgcggcgacggtggtggtcggctggaaacgacggttttcgaccagcagggccaaccagttcaggatggtgtagggcaactgggacaggtccaggaaggtgagcccgttggtggccaatgtgtaccgattcgcgaaaccgtcatccagtcccgcgcacgcccattccttggccagctcgacgctgcgcgtgcaatagaatccgcggccataatcgttgttcggcttgaccagcccgtattcaggatgcttgatgacatgcgaagagccatgccacagttcgatcgatgcggtctccattggccggctccttctctctctccttacatattcttgattatatcactgtggtgatagtcataagggaaatacgagatgaaaaataccgctgtatacgttcgtacacaacgtgaaatgtatacgaacgtatacaacactgatgtccggagtcatgctccgcagtggcgcagcggacgcgccactgcaatcggaatatgggactgaagacgtggaagaagtggacggactggccgctgatggtgctgtccgtggtgtttctggtggtgtattcgtgggaaattctctcccgcacgcatatcgcgctgtgtgaaaccgtcatcaacgtgatctgggtggtgttcgtcgtcgattatgtggtctcgctgtggttggccgacgatcgctggcggtggttcaagcacaacctgttcacgctgctgaccatcgcgctgccgatgctccggcccttgcgactgttgcgtttgctgaccgtgctgcacgtgctgaaccgcacctccggcatggcggtgcgcgggcgcatcaccgtatacgcggtcggcgcggtgggaatgctcatgtacgtgggcgcgctggccgtgtattccgtggagcgcggggcgtccggatccacgatcaccgacttcggcacggcgttgtggtgggcgttcgtgaccgtgaccaccgtgggatatggcgacttctcgccggtcaccttccaaggcaagatcattgcggtggtgctgatgttcaccggcatcgcgttgatcggtattgtgacggccacgctggcctcgtggatcgtggatcaggtcaatctggagacggatcggcgcgaggacgctcgggagaaggaagtggccaaggaagccgcgcaagaggctattgcgacatcagccaatcccgaaatcgacctattgcgcgaggaagtgcgtgagctgaccgctacggtagccggtctgcgcaccgaacttgagcgacgttgattggcgaagcgggacaaacaacgattctgccaagaaggtccgcgtcagttgttgtcaccgcggattgcggcagaatcattgtcgccacggctgttttcttcagtcggctcaacccaacttttgataatttttatttttttgatatttttgataatttttattttaggttgattcagcgaggaggcggtccacatgaaggcaaaggaaaacccattcaagccaacggcaggaggggaaccgcccctgctcatcggccgaggcaaagttatccgcgatttcgagaaaggtctcgataacggagtcggtgccccagggcgcattatgctcgtcaccggcgctcgtggaaccggaaaaaccgtgatgctcactgtgttcggagaccgggccaaagcgcgcagatgggatgtcatcgaagaaacggcctctgccggactatgcgaacgccttgttgatgccttacgaaccgggcgaggggcccttgaccacctcactatccgaccatcgttgacttttgctggagcgggcatcggcctcggagaagccgaactatccccgaagcgtatgcccgaaacgttgagaagtgccattgccggacggttggatgcgcttgagaagcgccatgctgggttgcttatcaccattgatgagactcaagcggctgagcgatccgacatgattgccatcgccactgccatacagcatcaaatcagggaacgacgcaatatcgccatcgtgttcgccggtctcccacagatgatttctgatttgttcaatgacgaagtcatcacgttcctacgtcgcgcgaaaacgaacatactcacagatattcctcttgatgaagtgcgcgatgctttcgccacaacattccgcgcctccggcatgtccatcaccgacgctcaattaagcactgcagccaatgtgacagccggatacccctatatgattcaactggttggctaccatatctgggatgccgcagacatgcgggactcggataccatcatcgacgctgatgttacggcaggtatcgaggaagcacgtattgaccttgataacgccgtgtgcatcccggagttgcaaggcttatccaaaaacgaccgtgagtatctcgaagccatggcagcgtcagatggtccctctcccaccgtgaatgttgcacagcgcatgggcaaaacgcctaactatgccgccacctaccgcaaacgcctccttgacgccttcgttatccgcgaaacagaacgaggcgaagtcgattttgccgtgcccttcctgcgcgaatacttgcgtcggaatcagtaatcggcacaatgcacagtatcgatatattccgttccatataatgacttttcgcattcagatacacaatggacggcctgttgagtagcactcagcaggccgtccattctatttagctattcagttatcggagacacacctcaggccttgaccggagcgtcagcgggagccgatgccgccgcggccagtttgcggcgcttgaggtacttcatgatggtcaggaccatgccgcggaagccccactcgccacgcaggacagtgttgagcagtccggagtgggaaccgccccactccataccgatgtagttgaaggcgctcatcacggcacccgcgccgccctgcttgacgctcatctcgaagggcttcaggtagatctcgcgaatcgactgctcgttggcccaggtggcgagctcgctcagtcggttggtctcctggtcgttcagcgcgaagtgcttcatgaaggcgtacacgcccttggcctgagcgccagcgacctgctgggaggccatcacgccgaacaggtagccgtcttcggagaagtattcgaaggtacgaccggcgaagtcgcggcattcgaatctgatatcgttatcgattcgatcagcggctcacgatactgcccttgcatcgctgtgccactgttgaatgtgcccggctggctcacctttgggtcaccgccgacacatccttgatgccaatggttatagagtcgcaaattcacgactggcgcacctgcccacgcacctatcctgtcatttcgagcgcataatttgctaccacatccggtcagggcaatcgaccttaatggcgtaaacggcacttctcaatacgtaaacggcatttattcttggctcccctctcagagaggggagccaagaaatatcaagctcggcctcccaggagagagccagaataatgcaccagcaaggcattaggatggagggcatgagcgatttgaacgcgttgaatcttgagcccggcgaagtggttggtgggtatacgctgatctcccggctcggctcaggagctatggggtcggtgtggcgggtgcgcgacgacggcggcaccacctatgccatgaagattctgcgcgactccctgaccgacgagtcagtggcaggctccggctctgcgtccacggccctgcacgaccccgacctcaagcccgatgtcacgccgcgcgagcgcctgcggcgcgaggccatggccttgaagaagatcaatcatccgggtgtgtgcggcatcgtggatatggaactcgacgatacgttggcgttcatcgtcactgaactcatcgagggcaagaatcttaaggatgatgtggccgccaatggccggtatgtgggcgacgatctggaacgcttggcccgcaagctcatcgaagccaccaaagccgtacatgcggccggcatcgtccatcgcgacatcaaacccaccaatgtgatggtgtcggccgccggaccggtattggtcgatttcggtatcgcgatgggcgagggcgaaagtcacgtgacccgcaccggcctagtgatgggtacacccggattcatcgcacccgagattattgacggtgccgaatccgacgacgccaccgattggtggtcggtggcgtccgtgctcgcttttgccgcaaccggcgcgcctgtgttcggcaccaagccgatgatggcggtacttgagcgcgaggcctcgggcaacgcgaatctttccggactaccggccggcacattggctgccttccgttctgcactggacccggatcgcagggatcgttgcacgccggatcaattgctgaatgccatcgccttggatgcgttgaatcccaacgcttggcagggcgagcaggcgggaccgttcgccgcgggagccgtggctggacaaccggctgcgatcgttgccgaagccgcggaggcgatgccccttttggcgcggccggcggcgttgaccgcaataatccccgaaccatctggcgcgcggccgaggaagccgctgaggctcccaccatggccgtgttctccggcaataagggcgataacggcgatggcgaaaccgccgtattctcgccggctggcgccgctaccgccacgctgcccttagccgatatgccgccacgtccgccggccggtgcggagcaggccacgcaactgttgcccgacgctgctgccgatttcaccgacgacgccggcacgcaggtactcaccggcgcgaccacaccgatgccggaccaaaccacgccgctggccgagcgcaccaccgtactccccacgccgcagccgtcatcattcccccgtccggcaccgcccagagcagctgggatcccgcaagcaaccagcccacagcggtggaccccgccattcgcccggcattgcagcgcatcatcgaccaaaccgcccaagcggcccccaccgaaaccatggtccaaaatcctcccatgcccaatccggtggacgtgaagcgaggggaatatctgcagcgcggcaccctgccattgatcctgctggcggcgccgctggcggcactggcggcaaatgctccgctcgtggccatcatcgcggccactgcgttgttgtggctactgctcaccctggcctataacaccgaaccccagcttgagcgcgagggcaaacgcggcggcgagcgcaaaaactccgattcgtggattcgcgtggcgacttttccttggcatctggtcaaagccctgctgctggccattccccgcatactgctgctagtcatcatctatatggcgggaaccgccgtggccaccgcggctctggcactgcccgttcacaccatctcctggtatttcaccgcggattggggtattccggtgccgttgctcaatgatgtgccgttctccgcttccgggctggcgctgggcggtttcatggccatcggctggctggtcactgtgttcgccccacagtcgatgatgattcggctggggggcggcgtactgcgcgggctcaaacacagtcgcccggcgggcgccccatccaccgaagtgggtggggctccacctgctccagtggcgccggcgcccaagggcggcgggcgcggcaccgtgctgttcaccatatgggccatcatcaccgtggccttgtgcgcgatgccgattctgggcatgccgatcaactggatgccgttcgcctagagcggggcggaatctcacacatcagccatccgcacacatggccgttgtgtatccgatacgttcgttccgtcacacttttacagggaattcacctcagatcagctctgggcgcagtcctcctcaggcccggtcattatgatggggcccaaacattgaagcgattgcaaggggatagctatgtcagatccgaagcgtcaggccaagcgtgccacacgcgctgagcgccgagcggccgaggaggccgcccagcaggcacgggccgagcaggcagccaaggagcgtaagcagcagaccatcatcggctgcattgtggtggccattattgtggtgctggtggccatcgctggattcgccgtatacaaggctatgcggccgtccaacaccagcagcagtagccagcaaagcaacatgaccgcggacgaggcctatagcaagctcaagaaagtcagtacccagccggctaacgccgacgacaaggccggcttcgtaatctccaacaaagggtatggccagaaagccgagggggctcccaccgtatccatctacatggaaccgctgtgccccggctgcgcctcggtgaaccgccaactcgacccgacgctcgtcaagctgatgaacgcaggccagctcaacatcgatttgcacttcctcaatttccagaacaacaagagctccgacaactactccaaccgcgtgttcaacggtgccatctacattgccgagcatgatgacgatcccgaccacctcatgagctacctctccaacatctacgctgaggatttccagccgggcgaattgtccaattacgagccggtaaacaacgccaagctggagaagcaggccgtcaaggccggcgtgagcgaggatgtggccgccgcggcgttcagcggcaagaacgaatacctcgactggctcaccgcctccaacaactacacgatcctgcgccccgaactgttcaacagctccggcgccttctcctcccccacactcaccatcaacggcgaatactgggatctgaagcagctcacgctggcggacacgaatatggtggacggcttcctcaagtccattgggctggatgctgaccaggtaggcgtggaaggcaaaatgccatccatcggtgccagcggaaagccgatttcggtcgcctcctgatgctgcgtggccgaataagttgacgccgcgacatatgcaataccgcctgcggctcggcttaaattgaccactcgggaagtaccggtatactagtcatttgttcgcaacgatttacgcgttaagaacaatcgcctctttagctcagatggccagagcggccgccttgtaagcggcaggtcgtcggttcgatcccgacaagaggctcgtcgcgcagaaaaaatggcgtattatgtgatacgtagacttttctacgcatataattcttaccttgggtaagtactccaggagccttcccccaattatgggcttcctggaatgagggcggagcgtcccccaaccagctccgcgccttcaagggggcgggaacatccccttctctcccgccccccttttcttttctttttttgagctcagaacaatctgacgagcaggaatggtgacggtggccggtgaaaccgcagtacgggccggaacaaccgttacgatgggtggcgtaatcgttcacccagcaggaagagtatggcaatggcacggcgttggaccccgcagcggtttgttacactgcgtcgcatccgcgtaatcgcctgtatcgcggcgaccagtatcgcgctggctggatcattcgcgttcaccgcgcgtaaatccgtggccctgaacatcaacgggcaaaccacccaagtcaccacatatgcgatgacggccacccgtcttctggaggaacaaggggtggatatcaagacccacgatatcgtcactacctcgtccggcgaccagctcgccaatcatgccgtggtcaccgtacagtccgcctaccagaccactatcaacatcgacggcacgtccgttcccttctggaccgtggccaccagtgccgaccagctactgggatttttcgaggaaaaccagaacaacgccgcgaagatcaccgtcgacatcgacaatgtgtacaaccagctcaccggcggactggtcatcaatcaggatggcccggtcaccgtcattgcggacggcaagacttccgtggcccccaacggcaaactgcctgcggcctccattcttgactccaaaggcatcgtgctgaacaaagaggaccgtgtgagcgtcgaaaaggacggcgataccactatcctgcgcgtacggcgcgtgacgcatggcgaggaaacgcgcacagccgtagtgccatactccacacaaaccatcatcgactccaatcttcctgaaggccagtcggagatccgccagcaaggcgtcaatggcgagaaaacccaggtgtataacgtcacgtatgtcgatggcgtggccgaatcggagacgctgaaatccgaaaccgtcaccacgatggccatcgaccagatcatcgccgtaggcgccgccaagtctgataccgataaaggttccgacaaaaaatccgactccgccgataacggcaaggccgattccggtttcaacaatcagcacgagtcgtccggtaacaatgccaacaacacaggcgacaagaacaacagcagctctggcaacaacacgaacaccgataccaacaacaatgccggcaacaccggcggcaacaactccggtaactccggtaacaccggcaattccggtaacactggtaattccggtaacaccggcggcggtacgaacaacaattccggctcttctggctccgattcaggcacaaccaccacgccctccggccgcctgtggcacgccaccgtagcccaggctcaggcctatgccgccggtgccgccgcgcagcgcgggtggacaggcaacgactgggattgtctggtcaaactatggacccgcgagtccagttggctgtggtatgccgaaaacgcgagctccggtgcctacggcattcctcagtcgctaccagcagacaaaatggctgcgttcggtgccaattaccgtgacgatgccgccgtacagatcgattggggtctgtggtacatcgcacaagcctacggcagcccgtccaaggcatggcaacattccgaacaagtcggttggtactgatcggttacgaagcccacaaggaacacacgcttatgaacgacaccattcccgccactggtcacctgttaggtgccgccgatatccgtcgtatcgcggccgatgccggcatcagccccaccaagaaattcgggcagaacttcgtcatcgaccccggcacggtccgtcgtatcgtacgcgaggcgggagtgaccgctgccgatcatgtcatggaagtcggccccggcctgggatcgttgacgctggcgattttggaaaccggcgccaccatgaccgcagtcgaaatcgatccgccgctggccgaacgactgccgggcacagtcgccgaattcatgcccgaagccacgtcacgactcaccgtcgtcaatcgggatgccttaaccgtcaccccggagaacgtgcctgatttcagcgatgacgcatcgtttacgctggtcgccaatctgccgtacaacgtggccacgccgattctgctcacgctgttggagcgtttcgacaacctcggctcgttcttggtgatggtgcaaaaagaggtggccgacagactcgccgccaagcccggttccaagatctacggcacgccgagcgtgaagctcgcctggtatggcaccgccgaacgggtgggcaccatcggccgcaatgtgttctggccggctcccaatgtggattccgcgctcgtcaaattcacccggtatcaggccgatgacccggctgccccgggaactgcgaacagcacagacgacggcacacaacgggaactcgtatttcgtctgatcgatgcggcattcggtcagcgtcgcaagaccctgcacgcggcattgaagaccattgcgccctccgaggcattctccatcgccggcatcgatccgacccgtcgaggagagacgctcaccatcgccgaattcaccgctctggccaaggccatcgaatcgtgtggagagggagatgaggcacaatgagtccggtaatctcacatccacgctcagccgctgcccgacatcagtccgatgagctctcccccatcaccattacggtggattgcccggcgaaaaccaatctcaccttggaagtgggacctgctcacgacgaatggggcggacgccacgaactggacaccatctactgcgcaatcggcgtatacgacaccgtcaccgcaaccgccaagcaacccggagcaggattctctctggagctcgaaggcgcttatttgggcgacttggcctcctcacgcagcgacatgcgccgcaaccatgcggtactggccctcttcgccatggcccaggcggccgagcgcgagccggatgtggcgttgaccatcaccaagcgcattcccgtgggtgccggactaggcggcggttcagccgacgccgcggcgaccatgctggcggtcaatcgtctctgggagctgaactggcccatagagcgcctgcgcaccattgctgccacgttgggcgcggacatgccgttctgcctgaccggtggccttgcatacggcaccggtttcggcgaacgcatcacggatatcgcccccggcagccgcgatgagctggcgctgatagaacagggattcagcggcgaagtattggtcggcgcataccagtcgcaactcagcactcctgaggtctaccacacctttgacatcgtgggagccgcagaaggcgaccgcaatcatctgcaggctgcggcaatcagcctgcatccccgcagcgggcaggccatcgacgccgccacgcaggcgggtgccagccatgcattcgtctccggatccggcccctcagtggtcgctttcgccgccgacgaggcagcggcacaacgcattatcgaggtgtggcgcgatacagctgtggtcgatcgtattattcgagccaaatctcccgaacaccccaatatcagcgtcagacagtgacgctaaggtagcaaccagccacccgacccatgaaagaagtccaccgatgacgtatcaggttgatgaacgtgaagcccgcaaggcgtacgtgcgccgccgccagaccatcgtcttttccatcagcggcgcggtattggcagtagtgctggtcatagccctactgttcaatttccacgttttcggcctcggcgaagtggagactccggccagccagccgaattacggcaacgcggcgccgtgcgcggtcaaggacagcagcggcaaagcgcaatacgtgtccaacgcttcggtcggcattcgcgtgatgaacggcacctctcacggccaattcgccaaggccgtgggtgaagctttggccaatcgtggattcagcgtgcagaaaatcgataactattccagcaccgacgttgaacgcaccaccatctacttcggcaagaacgccattaatcaggcgtatacgctgatcggcaatttcaccgacgccaccatgatcatgacggctcgcgaggatcagctcatcgatgtggtcatcggcgccacgttcaacgatctgcaggacaccaactcctccccgcaatccggtaagaccatcaccaatatcgagggttgcaaggccgccgatagcatgaccaagctgcccgccgacaccaaacacgacgcatacacggcgcagtaaggcgcatacagcttcatcttcgcgaaaaaccgtacgctgacacgtattcagcgtacggttttttggtatcggactagtatcggactactgaatctcggcgtaccagcgcttgagttcttcgacggccacatcgtggtccaccggaccgttatccaagcggtattccagcatgtgcttgtaggcgcggccgatcatcgggccgggctccaggcccagcaactccataatttcgttgccgtccagatccgggcggatcgcgtcgaagtcctctttcttcttgagttcgcggacgcgctcctccatctcatccatggcctgggagaagatcatcgccttgcgtttgttttgtgtggtggcatccgcacgcgtgagcctgttcagccgctcatagaggtgcccggcatccttgacataccggcgtacggccgaatcggtccacggctcgtccacatagccgtggaagcgcaggtgcatattcaccagttccgagacgtcctcgaccagatggtggtcaaaacgcagcgccttcaaacgcttgcgggtcattttggcacccaccgcgtcatggtggtggaagctcaccttgccgcccgactcgaaccggcgggtcttcggcttgccgatatcgtgcatcacggcggccaagcgcagcgtcaggtcgggggcgggcaccgggccgtccgggccggtttccagggcgatagcacgttcgagcacaatcatcgtgtgctcgaagacgtccttgtggcggtggtgttcgtcgatctgcaattgcagggccggaatttccgggaagacgatgtccgcaagaccggattcgaccaacgcctcaaggccggcgcgcggacggtcggagagcagcagtttggtcagttcgtcgcgcacacgctcggcggatacgatgtcgatgcggtcgcgcatcgaggtaatcgcctcggccgcgtccggcgcgatacggaagcccagctgggccacgaatcgcacggcgcgcatcatacgcaacggatcgtcgtcaaaggactgtcgcggatccaccggcgtgcgcaacacgcccttggacagatcactggcaccaccgaacgggtccacgaattgcaggtcgggcacgcgcagagccatcgcgttgacggtgaagtcgcggcgggacaggtcgccctcaagcgtgtcgccataattgacctcgggcttacgcgagtccggatcgtacgtgtcagagcgataggtggtgacctccaccttgacctcggtgccgtccgggcggcggcgcatggcacccagcgtgccgaacttgcgccccatgtcccagaagccgtcatgcccccaccggcgcagtatcggctcgaactgctcaggccgtgcggatgagcagaagtccaaatcgtggctctttctatggagcagcaaatccctgaccgggccgccgaccaatgccagctcgtaaccctgttcggcgaacagtcgaccaagttcgatggcttcaggccatacttcgaaatccaatgggcaccttcccgcgtgcgacgtttttctgccctaccagcataccgttaccccacctgcacacggggttgagtaaggtggagaatatgattacgcccgccgaccttgcccgcatgctggggcaaacaccagattcggcggatagccatacccaagaccacctgctgtatacgtccgaaactccgcatcattccgccgattcgggcgattcttccgatgtcggcggcaccgcgagccactccaccaatcaggccgttcatcaagacgaagtagacgcagtaccgactgcgcaacattccggtgtgcctggcacacccgcaacgcccgccacacccgaaccatccgaatccgaaatatcggacgccaccagcgacatgcccgcaccgaagccgatgatgcccacaccggccaccgtcttcggcatgcatgccaccgtcaccatcgccactaccagcggcactatcgaggggcaggctgatggtatcgccggcgaggccggtgccgagacgattgccgaggtcgagccgattatcgccacagcacaaacgtccgtaaccatcgtcacgaacgatcccgcggcgaccgctcacgcggccgtagatgctgccgttgcggtcgccaaggccgccgccgcgcacaccacagcgataccgactccgcgcgacgtgctgatgccgcctgcggcacgtaccgcaccggccgcaacgccggtcaccatgccggtctcagcgccgtctgcagcaccagtgaggcccgcaacgtcagcgcatcccacgccggccacggtcttcggccggcacccgtccggagatgttgcctcgccggaaccggcagtgccggtagaaccggtgacaccatccggcccgactccggccatgatgccgcaacgccgtacgtcggacggtccgaccacattcgcttcactggatgcccaggaactgccggtcgtacgcgaatattcggcaggcggtctgattttcgatgaccagaaccgcgtggccattatcgcccgtcattcccgctccggccatctcgaatggtgcttgccgaaggggcatatcgaaaaaggcgagaccccgcagcagaccgctgtgcgcgaagtgcatgaagagaccggcatcctgggcgaggtgatcgattccatcgccaccatcgactactggttcaccggtaccacgcagcgcgtgcacaagctggtccatcacttcgcgctcaaacagaccggcggtgaactgacggtggaaggagacccggatcatgaggcggaagacgccatctgggtgcgttttgaagatttggatgacgtgttgagctatcccaacgaacgcaaaatcgcgtggctctacgccaggaagaagaacaggcaggcaaacgagtgaacctacccggagtcttacgacattgcacacgtctggcacacgcactggcggctggcgtcgccgttgtggcgatgctggccgctccattgaccgtctacgcgaacgatacgacggacacgactgattcatccgatacgacggacgcaacgggcaatcagaccgagaatcagcccaagcagagcattgccatcacgcaaagcacccccatcgtcacctccaaatcgggctatcgtgtcaccgcggtcatcagcaatacggacagcacggccacgtcaagcggcacactgcacctgaccaccaatgcgttgttcacctttgtctcgcgcaccgatattcagaattgggccgagaacaacgcccccatcccaacccccaacgagttgggttccgttgacgtgccatcgattcccgccggcggcactgccaccgtcaccatcgaggtgaacgccaatcagcagacccttgcctccatagggagttggggaccgaaaccgctgatgctgtcgtatatcgttggcaatcagatactcgccgatttgccgagttttctgacccgatcttcggatgggctcaacaccgcgacaacaccggccatgaacctgaccgtggccatgccctacaccgccagcggctggcaggtcgataataaggccatcagcaatcgcattgccgaaaccaccacttcctcgacatcaacatcgtccaagtccaacagcacggacaaggccgacaagtccgataacgccgacgccagcaacgcggccaaagccactgatacgcaagccatatccttatccgaacaggatgccgataccgcgcgatcccttgggcagacattcgccaagcaccgctcgctgcaagtgatcgcggatcctctgtattggcgtcagtccgcagtgcaaccgtccattgccggcatcatgcagcccgccgacttcgacatcaccgcctataccgcactggacgataccgcggcctacgaaaaggccggcatcaccactgagcagtggaacgccaagcaggcggccgcatggtatgccgacggaggcgactccgaaacaccctccgcgtacgcatggcagggcaacaactgttggacgttggatgcgctgaccgcagcacgcgagcagggctatgacacggtgattgccgatgcctctttcgatgccgaccagactgaagccgtacacacaggcacctacgtggtgcatacgcctgccggcgatgtcaccgtgctgaaggagcaatcgaccttgggcacgctggccaagggccaagccaccagcacggacgcgcaggccgagtccagcgatgccggtcggttggcccgactgatcgctcagagcgcgttctaccagatggaacagccctatacatcccgatacctgcttatgacgttctcccgcaccacggaggccagctggatcgatcaggtgatgagcgccttcgagcaggcgtcttggttgaatctgacggacctgaagaccatggccaaggccgatccgtacaatgtcagcgattcggtcaatcccgacaatgccgatgatgccaacaccgccaatacccggtcggcattgagacagttggccgacagccggcatgacatcatgcgcatggccacctccatattgaggaacgagattgattccgacgaggtctcgtcgttggacccgcaggccctggcccggcaggacgccaatgacaccgcctcgcatagcaacgatccgacgcaatggattggctctttactggcgctgcatgacgatatggcgctgcggtccatgtctggctccccccagccgacagccacgcgaaaagccatggtcaaagccacgaaaacactggccagcgatcttctgaacggcgtacgcatcaacccatcggaatcaatatccgtgttcagcgaatccgcgaaaatgccaatcaccgtcagcaatgaccttccctacgccgtcagcgtgcaggtcaactcactgactgactccatgcagatcgtcacctcgcgaaccgctgacatcgatattccctcgcatagcgacgctcaggtgaccttcaccatccgcgtttccacttccggctcatcgacggcccatgtgtcgttgaccgaccgggaaggcaacagcttcggcaacacgcaggacaccgcgatcaccagtgtgatgcgcatcagtgatgccagcggcttcattatcatcggcttcgccgtgctactgggcattatcggcctgtggcggcagttccatcggaagaaggaccccgacgaatgagttcaagcgtaggtcgtaattccctgatcatggccacgggaaccgctgcttcccgtgtgaccggtcagctccgcacgattcttctcgctgcggccatcggcaccaccggattggcggccaacgcctatcaggccggttccatgattccccaatccgtgttcacgctggtgtccggcggcatcttcaacgccgtgctggtgccccagatcgtgcgcacgttgaaagaaaaagacgcccaagaacgactgaatcgcctgattacgttggccatcggcatcctattggccatgaccgtggtgatggcggcggccagccctctgcttgcccgcctgtacgtgggtagcgacgatcaccagatgatagccctgaccacctcgttcaccctgtggtgcatgcctcaggtgttcttctacggcctgtatacggtattgggtcagatcctggccgccaaagaccatttcctcacgtatgcgtggagctcaaccggtgccaacattattagttgcgccggttttactggctttattctgctgttcagcaaggccaatgaacagcccctcgaattctggaccgccgacaaaatcgcgcttaccgcaggcacctggactttgggcgtggccttccaagcgctgatactgttcctgccgctggcccgtatcgggttcaagtacaaacccagcttcgggcttggcggctttggactcaggtctatgggtcccgtggcgttaggctctttgggcgtggtgatcaccagtgagatctgcggcattatccttacccgtatcgccacatccgcaccgcagcgcgcccacgaactgacgggtgccagcctgttcagcgtggcaggcaacgcgacctatcagaatgcgtacacactgttcatcctgccctattcactcatcgccgtatcggtatccacggctatgttccccaaaatctcccgttccatcgcagctgcgaatctggatgaggcacggcacgacctggtcagcgcactgaataatgtgggcctgctcatcatgttcttcgccgccgccatggtcgtgttccccgaaccgatcatccgtgcattgcttccgtccgtctcgatggacgagactatgttgatctcctatgcgcttatcgccttgtctgtgggcattccattggggtcggcgttcctgttaatccagcgcacgttctacgcctttgaggacggccttcaccccttcctgtccgcggtgatgcagtatggattcacctcaatattcatgatcatcggcatgatggtacttcctcctgagcattgggtactcggcatcgcctgctcggtgaccctcggtggattactggcgttgccgctgacgttgatgatgttgcgccgcaagttcgaaggcaatcttggcggtcgggagatcacgaggacatatgccaaggccattgtggcggcactggcttccggagttgtggtctggctgatcaaacgaccggtagtcgcactgctcggcgcggatattcgaccagtaggcgggcacatgagctggtggtctgcgctggccatctgcgtggtgctcaccattgtgctggccgtagtatatgtggctgtgttgtgggtggtacacaccccggaactcatcagcgcctatcactcgatactggcccgtctacacaagactccggccagtgaggacgttgctgtgacagcccagccggaaaaaagtcgacgctacgtaaatcaatcctgagacggagcccgtcaaggatagccccgcacgtagaatatctaagaccaatctcgaacaccaatcacacggagccgaacgcactatgaaaccgcaactcggagacacgattctcaaccgatacaccttggtatcatcgttgcgtgaggagcctggcattcaggcatggaaagccaacgaccgtgtgctggcaaaggattgccagctgttcatcattaccgatcgcagcgctttcgccgcaatcgatgagctcgctggtcgcatcgccgccactcgccctgatcgtgtgattcccatactgaaataccgtatggaatccgacgtacttctcattgtcatgccggtggatagcggccaatgcctgactgactacatggtagataccgccaagccgctcagctacagcgccatccggtcgattatcggagaatgcgccgacgtgctgcgcgaggtcattgcggatactcccagcggcatcgtcatcacaaccgacaccgttcgagtgactacctccggtgtgcaaattgccgatgcaccatgtgccacgatgctggccgatacgtccgctaccgatctgcgcacggacggtcctgaacggtatgcgattcgccagcttgcggcattactctacaccctgctgacacgcacgccaagccaagcgacacccacattcaatctgcgtgccttgccgcaagacacccctggcgaattccgcgtgatttgcaagcgtggattggccttgagcgagcccgacgatcatacgttgccaatggctgcccttgtagaactcgatgccttgttgggtaattggaagccgctctctgaactgagcgatgctgatattgctttgccgagcgtggaaagcgattgctcgattaccaaggcgatactgaagcctgccaacgagactgatatcgtgcctattcccagcacgttgattaacagcagcagtcttccggaattgtctattaccccttccctgccggttcagacggccgccgtccccgctccgcacgcgatgtcaccggttcctctgcctgatgggtccagtactgctgacggtaaccagtctcagtctgatgcccgccgtctgtttgacttcaacctttctgacgcctgggagcacgaaaatctttccggtgaaggcaccggtgactggtacagcgaaatgaatccggcccccatcggcggtccgggtgataatactcggttgacagtgcctattgttaccggcggtatttccgatgccgccgtgggagagacaaccagtcgtattcccgtgttcgacgccagcggccgtgctgtggctcctggtgaggaatcgctgcgtgccttggaagaggagcaggcccgcattgccgaagtaagcgccattcctccgagcttcacaccgaagaatgtgccggatgacgaggttgacagcaagctgcccgatgaacatctgttcggcaaactgtcgaccaaggtcgttgccatcattgtggctctgatattggtagtggcagcggctgtttgggcagtgcatgcgttccgatcctccggagacaatcctgccgatgcttccagcaactccagtgaaggtgactggcctgatatcaatgctgacgctgtgccatttggtggcagcgagaacgcgacgaacggtggcaccactgacgattcttcaaaatcgagtgatgccactcagagcgaatccaaggactcggcatcagacaagtccaagaagtccgagactgctgattcgtcgtccaagaagaccaaggccaagaagtccggcgataaggattccagcgctgttccgcaaccgagccatgagaacaacacggcgtttacgatttccagcgccaacttcctgtcgaatcctggcggccaatccgggtacgcatactacatgcaccttgaccagccgcaggatgcgtaccgcatggttatcaccatccgcacatccggtggtaagggctatattcgcgcaaataccactggggaccccactcaaggcaagcaggtggccgaattcacctttgctgaaggtggcactactgaggtgaagttcaccaaagccgtcaagacgcaggatctgctgctgtgggtgccatcggatagcctgccgcagaaccagctgtacatcgaaaaggtggaggtcttctaatcggcatctatgccgatgactgacccaagaaggggcggtaccgttcgcatacattcgacgataccgccccttcttcgcatctggctgaatgacacggaatatcgtatggggtgtgacaatgtttcacgtgaaacataacgtcatcattatcggttctggtcccgctggctacacggccgccatctatcttggccgcgcaggtctcaatcctgttatggtcactggtgcgttgtcgccaggtggacagttggtcaacaccactgaggtggagaacttccccggattcccggaaggtattcttggcccggatcttatggatcgcatgaaggaacaggccaagcgcttcggtacaacctatatcgcagacgatgtctcttccatcgaggcgtgtgagagtgattcggtcaagccgacctatcgtgtaacactctccgatgactcccaattggaggcatcgtcgcttatcatcgccacagggtcgtcattccgtaagcttggggtgcccggcgaacaggagctgtccggacatggcgtctcgtactgcgccacctgcgatggcttcttcttcaggaacaagcctatcgtggtcgtaggcggtggcgattcggcttttgaagaggcattattcctgacccggttcggttcttcggtcaccttgattcaccgacgcgatagcttccgcgcctcgcagatcatggtggaccgagccaaagccaatccgaccatcactctgatgaccaacacagtggtgacctccattaccggcacctcctcccccacacagaacaccggtgcacctattgccattcctggcttgacgctcaaacgaccggctgtagcaccggccagtgtcagcagcatcgccgtacgtaatgtggtgaccggagaagaaagcacgctggacaccaacgccgtattcgtggctatcggtcatacgccagccactgattttgcggccggtgttgtggaccgtgacgatgatggatatgtcgtggtgcagggtgccagcacggtgaccagtgcgccaggcatctttgctgcaggcgattgcgtggatcgtacttatcgtcaagcgatcagcgcagcgggcatgggctgccgtgcagcgctggatacgcaggcctatcttacggactgatggtggcggactgatggtggcttgctgttctggctgctgcctgtgacataggagcaacgctaggtcagtgttacagcatgccgcccttggatagtacgtatcggtcaaaggcatagaaagacccctcaggcgacggagaatcacgatgtgtgattgtccctccagcctgaggggttttctattgcgacaggggctacaacgcaggcatacgcccctgccaggaatcacgcagaggctataacgtcttgcgcatacaacgcactgcacagcaataatgccggcgacaacacgaatgttcttatcgtgttacacccatttggaatcggcatcgccttggctcggcaccagcagctgcaggatgcgatccatatcctctggtgacgaaaagacgatttcgatgcgaccatgcttggtgctgcccttaatcgacaccttggtatcgaaatgattttccaaactctgctggatggcggaaccaacccaaggattggtcttagacgtcttaggcttcttcggctgctcccccgacgcaatcttcatggcgacgatttcttcggtgctgcgtacagaaagaccttccgcaataatacgagaagccagcttgtccatttcctccggatcgctcaggcccaatagcgcacgcgcatgaccggacgatagcacaccggcagccactctcttttgcacagaagccggcaggttcagcagtcgcaaggtattggcgatttgcgggcgagacttggacaccgacttggacagttgtacttgtgtcaacccgaactcttcaatcatctgctggtaggcagccgcctcttccagcggattcaaggccacacggtgcaagttttccagcaatgcatcgcggagcatatcatcatccgcagtggttttgacgatggcgggaatcgtctccaacccagccaactgagaagcacgccaacggcgttcacccataatgagctcatacgggctgtccaaatgaccggcaaacggattcgtgctggattccgtctcgtcgtgcttggcggctttggccgcagcaatctggcttgccggacgcttgcgcacgactatcggttgcagcacaccaacttccttaatggaagcagacagctcattcaactcatcctcgtcgaagatggtacgaggctgatgtgcattgggcccgatatcagacagtttgagttcagccagataaccaccggctaccggcttgagctcgtccttcttatctgtgtcagcggtctttgccgccgatgcagtcaaagatgtttcacgtgaaacatctttgacagtgacggatgtacgatgtgccgtctgagacgcagacgacttgccgccctgctgaggtgcggcgaccttaccggtttgaggtttctccgtaccgaaaaacaggtcgctaggatgagtaatggtgtccaatgcgggcatggatgcgcgtttaccggcggctttcttgactgccttgctggacgatatcgtctgaggcacggcaggttttgattcctgctgggcagtaaccttcttggcgggggttatgtcagcagtggcctccggagtagacgaatcctccgcaatcattgcgggctgctccgccaccggctcctcccctggcaatgtggggaacaaagcgccaaggcccttaccaagtcgtgattttgatgccattacttgttcctcctcgcatcaatggtgtcaaggacttgttgcgaacgctgtgcgatttccaaagctgcttcaccatacgatatggcacctatgccacgaggatcataggcaatcaccgattgggagaaactcggcgcttcggagatcttgactgaacgcgggatggtggtattcagcacaatgctgggatagtgtcccttaacctcgttatatacttcacggctcaataacgttcggcgatcgaacatcgtgacgagcatggtggacaccagcagtacgggattgaaatgctcttgcaccaaaccaatcgtgttaatcagctggccaagaccctccaatgcgtaatactcagcctggataggaatcagcatctcggtcactgcacacatggcgttgatgaccaagaggcccaagctgggcgggcaatcaatgaacacgtaatcatagtgtttatctgattgacgcaggtagaggtccaaggcctccttcaacaatgtgtttcggttgggcagatcagccacttccaactcggcaccgctgagatcgattgatgcaggcacaacatcaagtgtgggaaaatcaggacagaccgtgataacatcacccagatcggaacgcccctcgataacgtcatagaccgagggctctcccgatgcatgagatacacccaacgccgtagaggcattgccctgcgggtccatatcgatgaccaacacctgcgcgcccttgttcgccagcgccgcagcggtgtttaccgtggatgtggttttacccactccccccttctggttggccacggcaatacgacgggtacgttgaggtttggggaaatcggttttcttgagtacatcgtagcgtgagctttcatcagccatctggctgccaagcactgaaccgtgaccatcgaatattcgctgaagcgtttcggaagccgattctataggttccgactgatgatccttggtggacatcgctcctccttgcacagacgtaagttccagtgttctcattcgtatggacatgatgctcgttatccacaattgcgatatacaatgtggataagtgtggataagtgtgaatgacgttgagtgttagattatgtattcgcagacgaaaaacattgaaaaatcagtgttttcatcattctgcacatcgtcccgtaaaaatgtggataacttttacgcacatatggaaatgtggataactcaatcagtactccactcatcgcttatccacaatcaccacgtgggtaggctcaagatccggtccgacagccgcctcaacgacgcgtggacgacgaccaccgaattttgcaatctccttgccagccttgtcgatttcagcctgagcagaccgtcccttcagtgcgatcaactgtcctgacggtttcagcaacggcaacgtccagccagagagtttggtcataggagcaaccgcacgacacgtgacaacagcgaacggatgaatttcccgcttccgtacctgctggatgacggcatcggagcgtccacgaataatctcaacgttctgcagttgcatcaggccaacacattcatgcaaccattcgattcgccgctccatcggttcaatcagcgtgaagtcatgatccggcaaacacgcggcagccaccaatccaggaaaaccaccaccactgccgacgtcggcaactgttttgaagcgaataccattcgtcgcattccgaacgtacggcacaatcgcagcggaattcagaatatgccgttcccaaatgatatcgacgtcacgggggccgatcaatccacgaggttcaccctcttcggcaatcttggcatggaaacgctccaacttcggcaacgcatcacccaagacctcagcaagtacaggtgacccctgcagctgatccgtcatagccatctccctcaccatgtttcacgtgaaacaatcaacatggagaatggcgccgctcattacgacgccattctccatgcggtcactttagtttgttcaaagacgacatccgtcgaacgtccctgtcatctcaaaaaaactcgccgagcaattactcctgatcaagctcgtcgtcttcggcggtatcctcgactctattcttgagatacaccgtcacgtaacgatgaggctcctcaccgtgcgagcgagacttcagcccctcttcccgaaccacatcgtgaacgactttacgttcgaaggaattcatcggcttcaagtcatacggctcgccggaatccttcactgcgtcaatggcatccaaggcgatatcacggaggtgctgacgcttgcgcttcaggaaaccgtcgacatccacaatcagatgagaacgctcgccggtcttctgctgtacagccagacgagtcaattgctgcagagcatcaacgacttcaccattacggccaataagatgtttgatgtcagtatcgtcatcagcaacgatttgcacggtggggcggtcattacgcacgcccatctcaatgtcgccctcatagtcggcgatatccagtaggccttcaaggtaatccgcggcgatgtcagcctcttcgttgagctggtcgatcgacttcacgtcatcctgtgccatacgctactccttcatgtcgtgtttgaattccaagtctaagccctgctcccccgaacagagaaagtaatgtcggtgcgtgttgaatgtttcacgtgaaacatcgaactcgcaccgacatagtcgtcacttctttttgcgcttacgcacgggctgttgacgctgatagccctgagtggccttacgctcggcctcttccttggccttggccaatgcttcttcttccagagagggcaggccggcctttgcgcggcgagcattctcattacgatgatcgcgcttctccttgtccgccgcagccggagagccaggggtcgggaatgcgtacacctgccacaatgtgcggcagaggttgcacacgttgttggtcagccagtagaccagcacggcgaacggcatggcgacaccggagaagatgtacatcaccgggaagagccacagcatagccttctgcatggtctcggtctgcttgttcatcgaagcagctgccatgttgcgcttcatgctgaagtactgcataaaccacaggcagaaacacatcaggaacacgaagataccgatgaccgccttgccactagcggcagcactggtgaagttatcggtcacgctgacaatgccgaacacatcggtttgggtgaattgcttggcggttgctacgtcgaacgcgcccaacgcatcgcgtttaccgttggcaatgtatggaatggccgacagcgtatagaacatggacatgaacaccgggccctgaatgagcataggcaagcaggagccagccggattgacgtcattgtcttgatacagtttcatggtttcacggctcatggcctccctggaagcctgatccgtcttgcctttgtacttgttctgaatacgctgcatcttcggcgccaatgcctgcatcttgcgcatcgacttcatctgcttgtagaacagcgggaagatacaagcctgcaccaccagcaccaggatgataatggcaagcacccatgagacaccaatcgggctcacgcccagcatcacgaagaagtcatgcacgatcttcatgatccaggtctgcaaccactcaacgggagtcaggattttatatagaaatccccaaaacccgctatcaagcagaaattcatttgagttcatcgttgggcctctctttgggttgtggccaatggtgtcagtcgaggctcttcatgagccttcgaccacgaaaacctgtaaaaaacggaataccgttgtggaacatcgtcgattcccccacgactccacggccggcaacgcagtaatctcagcacggcgagcactccccctttgaacgcgccataccgttccaatgcctcaatggcataattcgagcacgttggataatacttgcaacaaggcggtgtgtttgccgagatgtgctgttgataccagcgcaccccaccaatcatcaccgccttgaaagaagctgtcatgcctcagccaccttatgcgccaccgtggcaaaagccttcgcgatctgctgatctagcgaagcgaacgatgcggtcgctgcactgggcttggcgcgcaaaacgatatcgcaatgcgcgggcagcagatcctcatgggctctggccaatacacgaaacctacgcttcaccgtattacgggtgaccgcatgtcctaccgatttggagacagctaatcccaaacggcgatgcaccgtccggtcgtcatcatcatgatggtcgtcgggcaccaaatagtgcacgacgatatccttgccacctgctttgcgccggcgtttcagcacggtgacgaaatcacgatggctttgaagcctctccacctcgactatgcctgtggcactgatcggaatgatcaggcggagagggtcttgcggcccttggcacggcgacggttgatcaccgcacggccagaacgggtgcgcatgcgcaggcggaagccgtgcttcatgtggcgacgacggttgttcggctggaacgtcctcttcataatccattgctcctaggtctattcggcaacgcttcgcgctgccctcacgtgagtcaagctataccaaagtactctcacccctaccctcaagtcaaaacggacggagtattttcacatttcgacacgttgcgagacacgccccaaatctcttataatcggcggaataccaaccattcacggccaaaagttatccacaaattacatgtttgttattcacaatccagttatttcaacacgcgacacggtggataacttgtctaaaccagagtaaatattatctgttgtacgtatttcgccacagcgacagaaggggccaccatggttaacgcttccggcgaccccgtaatcgaggccgcccacatctggtcagacacgctgacggtgctcaaacacagcgcttcgctcagcccacgagaaaaaggctggttggaaggcgttgttcctgaaggcgtcttcggttcgaccatcgtgctgtgtgtggacaacaacgacacgcttcaagccattcagggtgatttgaacgattccctgcttcaggcattgcgtacggtaaccggcgaaaatatgtttcccgcgttcaaggtcgtgccgaaaaccgagcccgaaccgctttcggaggcaaagccggcgcagccatatccttcggaaatttctccgactgtcgccgaattcggtaaagaatcctatggtgcaaagccggcagccgcaccgcgggaaccgatgcccgccaccgagccgcagttcccggtcggtcagcagaagatgaatcgcgatcccgagactcatctcaataagaacttcacgtttgattccttcgtgcccggcgattccaaccgttttgcccgtacggtcgcactggccgtggccgaaggttccgggcaggatttcaacccgttgtgtatctatggcggatcgggcctgggcaaaacccacttgctgaacgccatcggcaactatgcactggtcaaggatcccgggctgaaggttcgatacgtcacgtctgaggaattcacgaacgaattcattgacgcgctgcaaaacccgaaccaaagccaggggcagattgctgaattcaaccgtcgataccgacaggttgatgtgttgcttattgacgatatccagttcctcggcggcaaggaagccaccttggatcagttcttccatacgttcaatgcactgcatcaggcaaataagcgtattgtcattgcttccgatgtagcgcccaagaatttgaagggtttcgaggctcgactcatctcgcgcttcgaatccggcctgaccgtagacgtcaagccgccggatctggagacccgaatcgccattcttcgcatgatcgcctcgatgaacggctcgaaaatccccagcgatgtgttggacctcatcgccgaacgcttcaccgagaacattcgtgaactcgaaggcgcgctaacccgtgttacggccgtggcctcgctgagtaatcagccggtgacccgcgccttggccgagcagacgttgcaggacttcttcaccaccgatgtggaaatcaagcccacggacatcatcagtcaggtggcgaagtacttccacctgacgtttgaggatcttgtcggtaaatcacgaaccaaaaacgtggctgttcctcgtcagatcgccatgtatctggctcgcgaaatgaccagtatgagcctgatggatattggccaggtctttggcggacgcgatcacaccacagtaatgcatgcctgcactcgaatcagtgaccgaatgcagcaaaaacaggagatctataactacgttatggagctcacggttcgcctcaagcaaagcaacaccaactgacacaacgcttctgagagacgaaaaacggcactttttggactgactttccgaaaagtgccgtttttggttgctcaggcggattctggtggatacgtcgaggcaacggattcgagacattagattcctcatggctcccctttgtgaggggatctgtcggcgcagacgactgaggggagtttcgaaggggaacacgcaaaaaaccatgaaacgagagaatcgattctgaggaccgattttgcgggtttgggcgagcgagacggaaaaagtgccgaaaacggtctccagaatcgattctcctcgacgaaaaaacagtcttcaacacgccgtgcgaaagtgcgaaaaccaaaaaagttatccacatagttgtgcacagatgtgggtaaactcggcggataactcgtggattacccactgttttgttgtggaaaactcgtgcataaccgcgacctcgatgtggaaaactcaaattcgacgaactggctgtggaaaactcgcccacttatccacaagccatgcagaatttgtccacaattttcagggacttatgaaccgttgcagttgtagggctcagccctacttatccacactatccaccggccttattatggcgattacttactcagttacgtgaaaagcatcatcgccatagtaacagccggtcatccagcgtacgtaagttcgccacctaacggctagaatatttctcagccaatccgacgaagggaacaatcacacatgaaagtcgaaatcgatactgcagccctggccgacgccgtagcctggacctcccgagtcatcgacgcacgtccctccaacccgattctcgctggtgtcaagctggaagccattgacggaacgctgcaattctccgccttcaactacgagatttccgctcgccaccacatcgaagccggcgttgacgaagccggttccgtactggttcagggcaagctgctggccgatatcaccaaatcgctgcgttcggagaaaacgtacctggtcaccgacggctccacgctgaccatcacgtccggcaagtcgaagttcaccttgcagctcatgcccgacaccgagtacccggatctgcctgtggtaccggccatgctcggccaagtcgatgccccgactttcgttcaggccgtgaaccaggcgtgcgttgccgtctcccgcgaagaaaaccgcccggtactgaccggcgttcgcatgcaattccaaggcgacaaggtcgtcatgacctccaccgatcgcttccgtttggcccgcgccaccttcacttggactccgcagaacccggacgtcgacaccaccacgctggttcgcggctccctgctcaaggatgtggcccgtgctcttgacgagcaccagaacatccgccttgatttcgatgccgatagcccgacgctgctcggcttcgaaaacgccggccgcgtctccacctcccagctcatcgacggtgaattcccggcggtcgaccgcctgttcgccgacgaatatccgattcaggccgtagtcaacaagcaggatttgctcgacgccatcagccgtgtggctttggtcgccgaacgcaatgctccgattcgcatgaccttcaccggtcaggaagtggcgctgtccgccggatcggtcgacgaggctcaggccaacgaaacactggacatcgacatggatggcgacgacatcaccgtggcattcaacccgtcctacctgaaggagggtctgtccgccgtaaccgaaccattcgtgcgcatcaaaatgacgaccccggtcaagccggtcgagttcaatggccagcaggaagctgattccgacgagtccatggactaccgatacctgctcgtgccgatgcgctttaacaactgaaatccctgaatttccaacgattcgctaatgcacatctcccgtctcgcactcgaccactaccgctcatggagtcaggtagtggtcgatttcgtaccaggcgtgaatatcctgttcggcaagaacggtctgggcaaaaccaatctggtggaagccgtcgaagtgctgtccaccggatcgagccatcgcacgtccagcacgttgccgctgatcgaacgcgggcagaccacggccaccatccgcgcgaacgtcgctgatgatgccggtcaaaccactacgtatgaagcgtcaattcatgcgcgtggtgccaaccgagcccgcatcaactcggggtcgtcgctgtatctgcgcgatatcatcggcaagattcccagcgtttccttcactcccgaagatcagcggttggtgtccggcgatccgggagcacgccgcaccatgatgaatcaggctgcggctctgctcgagcccggatacatgcagacgttgcaacagttcacgcgcatcgccaaacagcgtgccacattgttgaagcaattgaatgccaatgtcaacaatggccagccgatggatgcggttctgagcggtttggaaatctggaccggccagttcatcgaagccggtgtggcgttgacccgtatgcgcgctcatgtgatcggtctgcttgccgagccatttgccgcgatttacgccgacttggccggtgccggcgagcaggtgacgctcacttatgcgccttcattcgacgaagtgctgatgttcgacgatccgcatccgcagattagcgagcatttccaacgcatctaccccggtgaagtggctcgcggcgtgaaccttatcggtccgcagcgcgatgacatgaaccttgagttgggcggtattcccgcccgcgagttcgcttcgaacggcgagatgtggacgatggcgttggccttgaaaatggcattgttcgaaatagtgcgtgaccggttgggattgcagccgattgtgattctcgatgatgtgttcgcccagcttgacgacagccggcgcacgcagattcttgatttcgccagaaaacaggatcaggtgctgattaccgtggccgctgaaggcgatgtgcccgactatgaatcggcccatcgcatcgacgtggccgcactggacgaaccagcttccgtgatattgccaactctgggcaatttgtccaattcgcgggaaaatgagagtttgggtgggtatgacgaaaaaaccgcggtggacagcgcgtccgtagaacggaaagtgtcatgaacccgccgatcgcccgccaactcaacctggacgagaccaaactgccggccgaaatattcgagcggctctcccgtcgcggggcgaccttgaaggactacagacgccgccgtgaagaggccatcgaaaacttcggcaaaccggggcgcgatccggctgaactgggcagcgtgatgaccaccatcgccggcaacggcgtctggacggcgaatatgaagcttgcgcaattgcgcaaccattgggaccaagtggtgggtcaggccatcgccagccattcggcagtcgccgatttcactgacggcgtactgaccatccgcgccgaatccacggtctgggccacgcagctgacctaccttatcccccaactcaccgataccatccgtcgcaatctcaaaggattgaccatcaccgagattcgcgtgaccggcccggccgccggatacacacgcaaatgggctcggcggcggtagccaagataccaaacaaattcgcagaagcctcgctatggcgctcgtcgggttagacgagtaaaatcacatgcagtatggtcaaatggctagaagagccctttacgggcctcgtaagccatatcacctccgtgaatgaccttcatgacggaggttgaccctgtagtcacggaaggaagcctgttggcagacgaaaccagcaaagaggagcagctgaaggcggctgcggaacgcatcaacaatgcggaattgaccgaaggcgaacttgacgaatccatggcccccgagcattatgaggcctccgatctgagggtgctcgaaggacttgaggccgtgcgtatccgccccggtatgtacatcggttccaccggcccgcgcggtttgcaccacctggtctatgagatcgtcgacaactcggtcgacgaggcgctggccggatacgccagccatatcgagatcaccattctgccggacaacggcatccgtgtggtggacgatggtcgaggtatcccggtcgatgaggtgcccggcgagggcgtctctggtgtggagaccgtgatgaccaagctgcacgccggcggcaagttcggcggcggcggttatgcagtgtccggcggtctgcacggcgtgggcatctccgtggtcaacgcactctccacccgcgtggacatcgaagtgcgccgtcagggcttccactggacccagacgtacatcgaccagcaccccaccgcgcccttgaagcagggcgagccgatgaccgaaggcgagtccaccggtacgtctgtgactttctgggccgacccgaagattttcgagaccaccatctacgacttcgagacgctgcgttcccgcttccagcagatggccttcctgaacaagggcctcaagatcagcctgaccgacgagcgtgagaacgaccaggccggcgacgaggtggccggcgacgccgcggacgagcccggcgcaaagcaccagaccgtcacctaccagtacctcaacggcatcaaggactacgtcgactatctggtcaaggtgcgcaaggccatgccggtggaagaggacgtcatcagcttcgaggccgaagacctgaagctcggcatctccgccgaactcgccatgcagtggaccactgcctactccgaggccgtgcacaccttcgcgaacacgatttccaccaccgagggcggcactcacgaggagggcttccgcgccgcgctgacctcgctggtcaaccgttacgcgcgagacaagggcatcctcaaggacaaggacgagaacctctccggcgacgacgtgcgtgaaggcctgaccgccgtgatctccgtcaagctcaccaacccgcagttcgaaggccagaccaagaccaagctcggcaactccgaagccaagaccttcgtgcagcgcgtgatgaccgacaagctcggcgactggttcgatgcccacccggccgaggccaagaacatcatccagaaggccatcgaggcatcccgcgcccgtctggccgccaagaaggcccgcgagaacacccgccgcaagtccatcttcgagtccgccggcatgcccgacaagctcaaggactgtcagtcgaacaacccggaagagtgcgagctgttcatcgtggagggtgattccgcaggcggctccgccatccagggccgcaacccgatcacgcaggccatcctgccgctgcgaggcaagatcctcaacaccgagcgcgccagcctggaccgcatgatgaagtccgacaccatcgaatcgctgatcaccgcggtcggcggcggctacggcgaggacttcgacatctccaaggtccgctaccacaaggtcatcatcatggccgatgccgatgtggatggtgcgcatatcgccaccctgaacctgacgctgttcttccgctacatgcgcccgatgatcaccgccggctacgtgtacgtggccatgccgccgctgtatcgcctgaagtggaccaagggcccgcacgacttcgtgtacaccgacgccgagcgcgaccgcgtgctcgccgaaggcaaggccaacggacgccagctgcccaagggcgaaggcatccagcgctacaagggtctgggcgagatgagctaccaggagctatgggagaccaccatggaccccgagcaccgcattctgaagcaggtgcacatcgaggacgccgccgcggccgacgagaccttctcgatgctgatgggcgatgaggtcgaaccccgccgcctcttcatccagcgcaacgccaagaacgtgcgttggatcgatgcgtaacggaatcctccaacctccctcgtcagagggaggtacacaacggacttagacaactaaaggaacaacagtggcagatgaaaacaacaccggcgacgagcagttcacgccggacggctcgatggagccgttgagcccgcaggaggcggacactaccgactacggcctgatggacaccggcgaacgcatccagcgcaaggacctgcagcaggagatgcgcgagtcctatctggcgtatgccctctccgtgatcgtcgagcgcgccctgccggacgtgcgcgacggtatgaagcccgtgcatcgccgcgtgatctacgcgatgtacgacggcggctaccgccccgatcgcggctacaacaagtgctcccgcgtggtcggcgacgtgatgggtaagtaccacccgcacggcgactccgccatctacgacactttggtgcgtatggcccagtcctggtcgatgcgcaacatgctcgtcgacggccagggcaacttcggctcccccggcgacgacccggccgccgccatgcgttacaccgaatgccgtatggccccgctggccatggaaatggtgcgcgacatcgacaaggacaccgtcgacttcgtgcccaactacgacggcaagacccaggagccgaccgtgctgccggcccgcttcccgaacctgctcgtcaacggctccgccggcatcgccgtcggcatggccaccaacatcccgccgcacaacatgcgcgaggtggcggacggcgtccactgggcgctcgaccacccggacgccagccgcgaggaactgctggaaaacctgatccgcatcatcaagggaccggacttccccaccggcgccaccatcctcggccacaagggcatcgaacaggcctaccgcaccggccgtggcctgatcaccatgcgtgccgtggtcaacactgaggagatcaacggccgtatgtgcctggtggtcaccgaactgccctaccaggtcaacccggaccgcctcgtcgtctccattcgtgaggccgtgcgcgacggcaagatccagggcatcgccgacatgcgcgacgagacctccggccgtaccggccagcgcctcgtgctcgtgctcaagcgcgacgccgtgccgaaggtggtcctgaacaacctgtacaagcactcccagctgcagcagaccttcggcgccaacatgctggcgctggtcgacggcgtgccgcgcacgctgagcctggacgccttcatccgccattgggtgaaccaccagctcgacgtgatcgcccgccgcaccgcgtacctgaagcgcgaggccgaagagcgcgaccacatcctgcagggctatctgaaggccctcgacatgctggacgaggtcatcgccctcatccgtgcctccgaagacaccgacaccgcacgtacgggccttatggggctgctggacatcgaccaggtgcaggcggacgccatcctggccatgcagctgcgcacgctgacccgcatgaaccgcgacaagatcgtggccgagcatgaggaattgcagcgcaagatcgccgactacatcgacatcctcgccaagccggaacgccagcgcaagatcatcggcgacgagctcgacgagatcgtcgccaagtacggcgacgaccgccgcaccaagatcctgccgttctccggcgagatgaacgtcgaagacctgatcgccgaagagaacgtggtggtcaccgtgacccactccggcttcattaagcgcaccaaggccgacgaataccgctcccagcaccgcggcggcaagggcatcaagggcaccaagctgcgcgaggacgacgtggtggatcacttcttcctgacctccacgcacaactggctgctgttcttcacgaacaagggccgcgtgtaccgcatcaaggcctacgagctgcccgagggctcgcgcgactccaagggccagcacgtggccaacctgctgcagttcgcgcctgatgagtccatccagaccgtgctgtccatcccgaactacgaggtggccaagtatctggtgctcgccacccgttccggcaaggtcaagaagaccccgctggccgagtacgattccccgcgccagggcggcctgatcgccgtgcgcctcatggccgacgagaacggcgagaacgccgacgagctcatcggcgccgcgctgtgcaacgccgaggacgacatcatcctggtctccaaactcggcatgagcctcaagttccaggccgacgacgagcagctgcgcccgatgggccgccagaccgccggcgtgcagggcatgaagttccgtaacgacgacagcctgctggccatggatgtggtccctggcgactccgacaaggacctgttcgtggtcaccaacgagggcttcgccaagcgcaccgccatcagcgaataccgtctgcagggccgcaatggcctgggtatcaaggccgtgcaactggtcgagggccgtggtgctctggtcggcgcgctcgtggtgtccgaagacgatcaggtcatggccatcatgaagtccggcaaggtgattcgctccaacgtggacgaagtcaaacgcaccgggcgcaacacccagggcgtgacctttgccaagcccgacaagggcgacacgattctctccatcgcccgtaacgaggagaaggacgagcccgaggatggcggcgatgccgcggcgaacggcaccgccgagaccgcacaatccggcgagaatgtgaacaacgcggacgaggcgtgagcagcgtcctgaaaagctggtagcctcgcatacagcagaggctaccgccaagcctgttaaggagaaacgatgagcgagaatctcgaagacaacgagccccggatcataccgccggcagtcggcaatacgcagaacgagcatgtcgagccgctgatcggtactgagcacgctccccgcgtggcacgctccgtgtccagcgatccggaagaatccgcgttgccttcttcaggtgccgccactcccgtgcgtccggcacctcgccgtagcgcccccagggctcgccgcatgagcttgtcgctgacccgcgtggatgcttggtccgtggccaaggtgacgttcatgctgtccatcgccgtggcgattattcaggtcgttgcctccgcgatcgtatgggtgctgcttgatgtggtcggtgtattcagccagattacgcagattgtgtcttccaccggtcttgatgcaggcggtttcgatctcaagaacgtgttgtcccttaccaccgtggtctccggcgtcaccatcttctcgattgttgaagtggtgatcttcaccctgctggccaccattgcggcactgatctacaacgtggtcagctcgctggtcggcggcgtgcacgtcacgctcggcgacgactgatatagctatactgacggaactcccctcagtgaaccgcaccccggttgttggactgaagtaattcagattcgatgatcggaggtgcggtttcttatgtgtggggttcgtaggcgtcgttgctgggccgagacttgggactccggcgacgctgggggtggcaggcgtcggtgttgggacaggttttgtatctctgacgacgctgtggagggcttaccgtcgtcagcggtacagatcttggagttctgccgacgctgagggtgcgttctgtgtcgtatgcgtccaattcttggccctctgccgacgctgggcacagcaagcgtcgttgctgggccaagttttggactgccgccgacgcagagaatgcacacagtggtgttggtctgccagcgtgtggcagcttggcgccgctggggggagtcatgagtcccattccaactccccttattgaccacttaggggtgcatcccaacacatggggtgcaccccttttttcttgttgtgctacggggttccagtcgcatttttttcggtgatattttgaacgcgaagacaggctgggaaatgcccgatagtcgtgttcccctcagcaggtgaagccctgctttcaggctgcaaaaccgactcgggtgttccgaaagcggctttcgttgttgtacatcgatacataagagagaacacccatgaaaaacaccattattcgtgctgccggtgtgctgttggctgcaagcatgatatttggcggtgcggcagccactgcatcggccgcggaagcaacgtcgccgagcaccggcaccaccagcagcacgcaagccgcggaatccatcaatcgcgaatgggtgctgaatcccgcgaacaacactgagctggcggctctcggcactatacaaggcggatcccagacgttcgacgggctgaccatcgatgccactgcaaacggtgccaagtttgcgccgcgcgccaatgacacccagatcaacgccggaaccatcatcagcatcccggtgccagcccacaccaatacagccaccatcacccttgcgttgtccggcggcaccaccactattaccgcggatgccggtgaagtgagcagcgacaacacagttatcgccttgcctgctgcggagtcggctcgtacggtaaacgtcaccttcactgcccagacctatctcaacggcatcgcccttgccgaacagcagccggaacccgagttccccggtacgcccacggtcgcggccaaagacacgaactgggacttcacggaaaccggcatcgatcgaccggccgtgcagggcctaccgacaactaccaaggcgtcgccatcgacgctcgggcgcaaggcgccaagttcaacccgcgtactaccgcggcaagcggcggcagcgatactcaggtgaacgctggaaccatcctgtacattccggtcgcacaggccgagggcggcgctacagtcaccgtgaagggccagctgtacggtcctacgctcaagctcgacggtacggacatcaccaccggcactgctgtaaccatcgcaaccgacagcacgcgctacgtgccgctctccgttgaaggcacgggcagcctgtacctgaccggcatcgccatcgactacgcggccggctcccccgccgccaccagccacacggtcaccgtgggcccgaacggccagtaccggaccattcaagccgctctggatgctaacgactcttccgaaaccgaccgactagtgctgaagatcactccgggcgactatcgcgagaagatcaccgtgaccaagccgggcgtcaccttcgccaacgccgacgtgaccgccaagcgcgcggtgacgattcgcgccagctactattcgtccaacacattcgatgccgacggcaagtttgtgccgcaggatgaattcgaccttggcaccaacaagtgcgccaccgtgaccattggcgcgggtgccacaggtttctccgcctacggcatcaccttccagaacgattacaacgtggtggatcacacggcggcgggcgagcagacgccggccgtggcgctgaacacccaggcagacaaggtgtacctgaagaacagccgcatcatcggccgtcaggacactctgtacgtgcagggcgccggcaaccgcgtgtacgtggacggcggctacatcgaaggcacggttgatttcgtgttcggcgacgccaacgcctacttcgccggcaccgagctgcacatggccgcgttcgccggcaagaacaacggctacttcaccgccgccaacaccaagaagtccggcgtgggcctggtgtttgaccgctgcaacttgaccgttgccgcagcatatgacgacgatgccaagctttcgctgggccgcccgtggcagacgttcgcgcagtacacgcaggtgcgtaagggcgacggcagcagctatgtgaccggcgtggatttgggtacgaagaactcggcgtatacggacacttcctcggccgtgacctacctcgacagcacgatgtccagcaagatcaccaagaatcgttggaatgtgtggaccagcaagaaccagagcggcaaaagcgtggacgtgaccttccacgatgatgtgcgattcgcggaatacgccagccacgatgaaaccggcgcgctgcttgatccggctgattataagaacgtcgtgctcggctcgatgtctgctttggatgaggctcaggtgcaggcgaagcgtgctgaattgctcgcggcactgggcttcggctcggcggctggtcagtgggttgtgccggatggcgcgtggccattcgcttacgacccgaactactcgaccggcactgatgtgcagccgactcagccgggcggcaacgcctcgcctaacgcggattcggcggccaaggccgacaccatgccggaaaccggctcggccatcattgcggtggttgtagtcgccgtgccgctgctcgttgctggcttggcgctggtagcagtgcgccgcaatcgccagcagtgattgaaagcgttgctgcgaaccggacctggtgaccttgtagacgggggctatctccgttgaaagaggtacattgatggctttgcagaaagccaactgctttcaaaggggtacctgaaccacgaaacctcgagtataagcgttgcaatgacggcgtttatactcggggtttcccatattcagtacccctctgaatgcagttagcttggatcgatgatcatatccaagaattcactcgtatagtggtgcgtaatgcttacgtatttgggatagcacttgttgctcgttgtacatatagcaatgcccttgcctcctcacggggaagcaagggcattacgctactgcttagtactgcttagtattgctcagcactgctcagcgattgctcagcggcaagcgtcacagcacgccctgggcaaccatggcgttggcgaccttgacgaagcctgcggcgttggcaccgagcatcaggtcaccctcgtgaccgtattccttggcggcggccagggagttggcgacgatttcttccatgatggacttgagcttggcgtcgacctcttcgaaggtccaagacaggcggtagctgttctggctcatctccaggccggagacggccacgccaccggcgttggcagccttggccgggccgtacagcacgccgttcttctggtagacctcgatggcctccggggtggacggcatgttcgcaccctcgacgaccacggtcacgccgttgtccacgagcttctgtgcggattcgccatcaacctcgttctgggtggcgcacggcagagcgatgtcgcccttgacggtccacacgcccttgctgccctcgtggtactcggagcccggaacgcgctcggcgtattccttgatgcggccgcgctcgacttccttgatctgcttgacgacctcgacgttgatgccgttcgggtcgtagatgtagccgttggagtcggagacggtgacgaccttggcgcccaactgctcagccttctgagcggcgtaggtggccacgttgccggagccggagatcacgacggtcttgccctcgaaggagtcgttgcgcagcacgcgcagggcttcctgggtgtagtagcacacgccgtaaccggtggcctcggtgcgggccagggaaccgccgaattccagacccttaccggtcaggacgccggagtactcgtcgcggatgcgcttgtactggccgaacaggtagccgatctcacgaccaccgacgttgatgtcgccggcgggaacgtcggtgaactggccgatgtggcggctcagctcagtcatgaaggcctggcagaagcgcatgacctcagcgtcggacttgcccttcgggttgaagtcggaaccgcccttgccgccgcccatcggcagcgtggtcagggagttcttgagaatctgctcgaagccaaggaacttgacgacggactcggtcacggtcgggtggaagcgtagtccgcccttgtacgggccaatggcggagttgaactggatacggtagccgcggttcacctgaaccttgccctcgtcgtcaacccaggccacgcggaacttgatggtgcgctccggctcgacgatgcgctccagtacaccggccttctcgtactccgggtgcttctcgacaaccggctgcagggtctcgaagacctcgcgaacggcttgcaggaactccggctgatcgccgtcacgggcaacgacctggtcgtagacacgcttgatgtactcgtcagtgagcatgattctcctcgatttgctagggaattaagacggttttattctatgcgcgcaggcccttgctgcatagagtctcgctcggataacgggaaagctatcggcgtggttatggggtggttcaagtttccgtttgttagatttttcggcgattgctggatgtctgtctgtgcgtgaatcgggtcgaaatggaagctgcatcacaccgaaggtgcgttcatatagtggacataaaggtggacttgggtgatgtcggatgtgcccgttgggaatcgtgcgccgtaggggccgaggtcttcggcgcgcaggttaccgggttcgcggtcagtgcgcgaagtaggtctgcagaatcatcgtggtctcggtgcttaccggcaccgtgcggtggatgagattgagcaattcctcaagggcggtggggaggccacgcgtaccaccagtacgaagctgggggcgccggccaccgaatagcaggagacgatgccgtcgatattgttcagcttgtccggaatcgaggattcggctgagtagtcgagcggggtcacgttgacgaacgcgctgatgggcaagccacgctgctcttggtcgatgatggccttgtatcccttgatgatgccgcgcttctccagcttctgcacgcgcgactgggcggcggagacggacagtccggtcgcctgggccagttgcgcgagcgtggcgcggccgtcggcctccagcatggtgaggatgcgctggtcggtctcgtcaatcgcggtcatggtgtcttctccgttcgttgtgctctgtgttcactgtacctgttgccggaatgcgatggctttccgattttgcctggtaatttcagtagttcttcctgtgttttctgttgtgtggtggaatgtttatgcctaaagtcctaattgaatgtaataattccttctgaaataagagaacgacgaaataattccattgaggagggatgatatgcagaagttttccaacatgcctctgtccgaagttgcatctgctgctgtgcctgctgccagacgggttgctgtgccgaccgccaagcccgcgagcttgtccgccgaagccctgaatatcccgcgctccggcatccgagacgtattcgaccgtgtagagcgcgtgcctgacgcgatttcactgaccgtgggggagcccagcgccacggccgcgccgcatatcgtggcggccgcttgcgaggccgcacaggctggccgcactcggtacaccaacgtgctcggcgtccccgaataccgcaaggccgtggccgattactccgcccgtgtgaagggactcacttatgatcccgaaaccgagattcaagccgttgacggtgccacgattggcctgtttctggcgctgaaagccgtggtaggcaccggcgatgaagtgattattccctcgccgttcttcacttcctatgacgccgaagtgatgctgtgcggcggccgcccggtcaccgtggcgctgcgtccggagcacggcatgcgcgtgaacgcggcggacatcgaagcggcgatcaccccgcgcacccgcgccgtaatcatcaactcacccggcaatccgaccggcgcggtaacttctgccgctgaactggcgcgtattgccgaagtatgcaagcagcacaatatttgggccatctccgacgaggtttaccatccgttcgtgtttggggaaacgttcggggaaacgcttgggggagaggcagccgtggcaccatcgattgccgcggtgccgggcatgaaagaccgcaccattgtggtggaaagcctgtcgaaaacctacgcgatgaccggctggcgcatcggctacctgctggcacccgaagcggtcatcgaacagaccggtaaaatcgccgaactcatgcactcctcggtgaactccttggcgcaatacgcaggcgtggcagcactggccggtccgcaggatcatgtggccgccatgcgcgaggaataccgcgccaagcgccagatcgtgctggacggtctggccggatgcccggtattgcgcttgattgaaccgcaaggtgcgttctacgcctttgtggacgtacgcctgactggccttgactccggtgaattcgcagaccgtctgctggacgaagagcacgtggccgtggtccccggcgaggccttcggcgaggaggggcgcggcttcgtgcgcctctcctacgccggagatgccggcgagctgcgtgagggcgtcgcccgtctgcgcgcattcgccgaacgggtatggaaccccatcaccggccaccacaccgccacctatcaccccatggaggtgctggcctgaggcttaaagcgaggctaggccgccattcggcctcgtcggcgcgagcgatggcctgcttcttggctcgcagcaagatgtagccgagtaccagaacgttggccagagctcgatgttggcatcgcgtcaaaacaaccgcattaaggctgccgcgtttcgtatcgttacgcgtaggggctggctgaggcgtaatgctgaagagtaacattgaagcaatggcaatcaagccgatttgaggaagagaagcacacgatggcgtactgcggccactgcggaaatagagttgataggccggcacgattttgcccggcatgtggagcgtctgtagacagcgcaccggttgcgtctgtaccagtgccggccgcatcgtcagccgtaccgactgcgtcgataccggcacctgctgtgccagcgccttcagtaccaccatcgataccagccgcgccggttgccccatcggtttacgccgcgcccgctgccccacagccggcaccaactgctcccttgccagctttgccgattcccgctcctgccgcatatcaggcgactgatgcaaccgccgtcctggcaccgccgcgcaaatccagcaagaagctgatcgccgttctctgcgcattgcttgcgacgattctggtggcggccttggcattcatcgtccccaacttcaccgccgtcaaagcgatgctgggcttccagcccaccaatccgctggtcgtcaccttcgacgcgatcaactcgctgtccactctgcgcagcaccaaatacgaactcagaacccacagcagcactgacgactcccttgacgcgcggatgtctggcatgtattcgctggggcaaaaccaccaatgactcctccgcgtctgtgaccatcaagacagatgaacaggcaacaaccctcgcttggcacaaaggcgcattcgccgggaaaaacgtttggtatgatgacgacccctactacatctactacccggccgaccaatatgaagatgacttaaggaacggcgttggtagtgatgtggcggacttgatattgaacgtcaaggatgcgttggtcaagaacggtgcttgggacatcaccggcgcggagcaaacgttctacgatcagctggacaagatgaacgacgatgggtactcgaacgacatcgaccgggccaagggcacgaaaacgtctgccgaggtgaaggccgaggccagcaaattcatccaacaatatttcggcgtggagctggaagataagaatgtgcgcagccagctgttcccgaatacatcgtctgccaagtctgccggcaatacgcagctgtcgtaccaaatcgatatcaaagcgttgtctcagcatttcgtgaattactggatcagtcatgaagcgcagtatccgcatctgaaatcctgggtgattcagcaaatcgaggatgccggcgtggacgatgctgaagatgagtaccgtcaggcgctcgataatgtgcgcaactgggatttcggcacggatgaagagccggagatgccgactatcaccgtggatctgaactacggcagaaagcgtctgatgaattcgattgccataagcgtgtccggcaaggacgaatacggcgactcctataatggctcgctatcgttgacgctcagtcagcagaacgcggtgtctgtggacgaccccgatttgactgatatggtgagcaaagccaaggacaacaacggactggatttgtcctgaatatggtgcgtgggatgttgcggcggcgctaatttcctcggtgggctatcacgcactcttcccgcttgcagcggtctgctcgctgattggcgcggtgctgatcgtcttcatcaagtcagtgaagtaaacatacttattcatccctcttccttccataacaaacgagcggaggggttgggccattgttttgcggtgtgtccagtctctccgctcgtttatttgcttgattctgtggaatggaaggggcatgctctatgtcaaataagataatgcggaagggctgttctgcgtgcatatatcttgctgaacgtatttgagggtactttctggttaaagacacgccctatggtgggcagaatgctgccgttgtgtctggcgtcggtcgcaggacatgtcgtatcatgagggcccaagcttaattcagccgtcctcaatctgattagtcgtcgggtcgggttggcgtgatcggcttgcagggaatcatccggctcttccggttttggcgtgacccgcagcctcctccacaccggcggcttcagacacaccatacaagcccacctataagcatccccctacacaccaaaaccggaagagccaattatctgccggtaccttccacccgagaggaaggtgtagtcctccgggtccgggcgatatcgccgcaaggcgaaggattttcgtgtaccgttccatgaagacggagcgacaatgaccacgcggttggtctgaatcctcgaggggtggtccttaacaggaccacccctttttcgatggagagggccatggcggactgggagaatccctcgaacaagaacgcaaaaaccctcagaatcggtattattccaagggttgtctgtggagctagccgggttcgaaccggcgaccctctgcttgcaaagcagatgcgctaccagctgcgctatagccccgtgagaaaaaaagagcggctcgcggccgcttcatttttcctgtgggcccgggaggacttgaacctccgacctcatccttatcagggatgcgctctaaccagctgagctacgggcccgatccatacgcttcaaaagcgcacaagtgattacaataccattgaacggcggtatgtcaataacggcgtgtcgcgattgtcgcttgcgccatgattgccggctcgacggtcaatgcccagctacgtaaccttgcgttctcacaccgtaatgctgcggttacacctccctctctgcgcagaaatgtccaatacatatgaggcttctgctgttttcgtgggttgggttcttggttgtggtgggcgtatgtcgagtccgccgcggcggagcatgacaagcgcgatgggattgttcgcgtggtggaagccgtaggccatgcggatggtgaccttgatcctgttgtcggacgcctcgagcctggcgtttgaacagcccaattcgattgtcccgaggatgtcgggcccatgacggcggatcttccgggcgggttcgacgatctcggggatgcggctgtgggacgcccggaacacccggcggttcagttcggtccgggcctggtcgccggtcgtttgggcatcgtccggaggggttccctgagccgccatgaacggtagggccggcccttggggtccgtgtcccgcaggttcccggacgcctcggaccgtctgtcggtcagcttgccggggttcttcaggacggtgtatctgccgccgcgcatgcgcttgacggatttctcgtccccgtcgcggcgctgcgcttcgacggctacacggacggggcggacctgtggcagtacgtcatcgcgaacttcggcaccctctgctgggtgccatcatgctcggctgtctcgtcatggtgtcctcggccaccgcgaaggcggggcagattctagtggtggttgcaacacctgaggtttgagcggccttccatggtcacgttgtcggttgttgaggttatcacgcggcgtcgagcagttcgatgatcttctcgcttggtttcatgaacccgagggttttgcgtggccggtcgttgagttcctcggcgaccgcgtcgaggtagtcctccgggtagacggataggtcggtgcctttggggaagtactggcgcaggagcccgttggtgttctcgttggtgccgcgctgccacggggagtgcgggtcgcagaagtagacggccatgtccagcgaggcgccgatccgtttgtgcagggcgagttccgctccctggtcccaggtcaggctgttgcgcaggagtttgggcaggtgctgcatcttgtcgatgatggcctgctggacgtgttcggcgtcgtgcccgtcgggcaggtgcagcaggatcgtgaacctggtggtgcgctcgacgagcgtgccgatggcgcttttgttgcggctgccggtgatgagatcgccctcccagtggcccgggaccgcccggtcctcgatctccgggggtcgctccgagatcatggccatgggttcgcggaaacggggtttgcggccttggccgccttggggtctgcgggcggttcgcccctgcctcatggcgcgtttcagctcctgcttgagttcgcccctggcctgcaggtagatggcctggtagatcgtctcgacgctcgcgtgcatatccccattatccgggaagtccagcctcagccggttggctatctgctccgggctccaatgcctgcgcaacccggcggcgatctcgtcccacagtcgcgtgccctcggccgccttgcgcggtttggggcgtttgagccggtccgcggccttctgctgggcgcggtaaggctcgtaaccgccggactcgggattcctgttgcgctcgacctcgcggctgaccgtgccggggtcgcggcccagcaggcgggcgatggcgcggatcgaatcgcccagacgcagacggtccgcgatctggatgcgctcctcctggctcaggtagcgcggatggagggtcttgggtttgtccatggtggaacgataccagtccaccaggggtttctcgtttgtatttagtcaagtcggtgtttcgtgtttcgtcactaatttttttcggttttcggcatgaggagtgccggccggtggtttgttttactggttgtccgtcttgccgaacatgagggcctggctgacgcgtcggctggggccggtgaattcgatgaggcgtccgtggtggacgatgcggtcgatgatcgcggcggcgagtttgtcgtcggcgaagatcgtcccccatttgctgaactcgatgttcgtggtgaagatgatgctgcgccgctcgtagctgccggcgatgatctggtagaggaggcgggccccgtcgatgtcgaagggcacgtagccgaactcgtcgaggatgatcaggtcggcacgggcgaggtctttgagcaggttgtcgagggcgccgtcgcgtttggccttgccgagctggagcacgagctccgcggtctgccggaacctcacgctcctgccttgctcgatggcgagcatgcccagggcggtggccaggtgggtcttgccgcgtcccgtcttgccgtagaacacgaggtcctgcgccttggccacgaaatcgaggccggtcagctgctccttggtgtatccgtcgggcaggcgcacgttcgcgaagtcgtagccgtcgaggcttttgggcaccgggaaccgggcctggcgcatgagccttgcccgtttggaggcctccctgttggccagttccgtggcgagcatgcggtcgatggcgtccagttggcggggcgtggcccattcgagcgtttcgtcgatggtggcctgcgagatgaacaggctcctcgcccgctcgcgcagcgggccggggtcggtccgtccgttcttctggttcactcgtcctccttggtgtaggcgatgtcgtattcgctcaggtccacggggtcgtcgtaggccacgggtcccaggcccgaggcgtggcgtgccgcggccagacataccccggcccggtccgtgcctccggtggattcgaggatctcgagcatgccggccacggccgcccgccagccgctctcgccgtcggcgtgcagcagggcacgcaggctgtcgcgccgcgtggcctcgtcctgcgcgtcgatccattcgcgaagcgggtcgggcatcgcgtcgcgcacccggctgttgcgccaggccgccggccggtcgcacaacagcccgagctggctcgacgggtcgccgctgtcggtcggcttgtccccgtaggacctcggatgcgtgatcacgcgtttgccttcggcatcgaggatctccacctccagggccctcaggccgacgatcatctcatggccggcgtgttcgggtccggccgcgtaccggtggcggccctggacggtgacgtttccgtatttgtcggccttcatcctcgtccacgtgaccacgtcgaacggcttggcgggcaggggcagcagcgccttgcgatcatcctcgaacaggccggcctggctctcgcccttcctgtaatggtccttgtccccagctcgagacagcggtcgggaaggcgcaggttgaagttgtcgaggctccacacgctgggcaccggcacgaacagccttcggcgcacggccccgaccctggcctcgaccgcgcccttctcgtggcccgagtacgggttgcagaacgagtactcgaacccgtaatgggcctggaacgcctggaacaggcgggtcaggcggatctcgtcgaaccgtcggcggcccacgccggcggcattgtcgtacacgatgcgccggggcaccccgcccagccattcgaacaggttaagcaaagcctgacacgtgcattccgcgttctccccgggcatcagctggcacggcgagatgttcgagtacgggaaatccaacacgaaatgccgcatccgcgtcacgacgccccggtagcgcacgtcgacctggccgaagtccgcctggcattcgcccggatgccacgacaggtccaggaaacccatctcgcgctccgccatgaactcacgcttcaaccgggccaccgtccgggtcaccgtcgacaacgacgcctccaccccgtactcgtcacgcaaccgctcgtggatgcgcgtcgccgtgtgacgttgcttgtgccaggtctcccggtcctcggcgagcatgccctcgatcacgggaatccactcgtcgagcaccgagccacggcgtctccttaccggaggcctggccgacaggtcgtcggccttgagatacttgcgcacggtcggctcgctgaccttctcgccgcgcgcgatcgaggcgacggactccccattcctgcgcctctgacggatagactgtattttgggcatgctgatcatttgcctttccggccctttcccgaatggattcgaagcaccatcaggctaaggcccacgggtggtcggcatgcctttctgcctaaacccgaaaaaactacgtgactaaaacctcaactccctattgaacacatacactcgttccttcccgtggcgcgcgtcctgccgttgcgccacgccttgccggtgcgtttcgagacgccgaccgcgtgcgcggcctgggtgaagttcatgccttcctcgtccagcaggcgcacgtactcggcgcgtctcgcctcgcacatcagcttcctcgtcggatattcgacgccgttgaacgtccaacggtgttccccgccacggtcttcgtttcggtggcttctggtcacctgaccctccttgcggtaggtcaggtgttgcaacgatcactagaacccgcccggtgttcgaggagtgggggggggctgcgttccggggcatttgccggccgtccggcgtcacatcgtcaggctgtccgggttgaggaggaaatcgtagacgctcatcgtgaggatgccgtgttcgtcgcggacgggtttgaccacgtcgcgtacgaggacgatcttctggaagctgtcgtcgatctcgagcagcgaggccttctcctgcgcgaccttctccggtgtgggcagttggtatgcggattgaatgtagcagcgccggttgccgaggttcgccacgaaatcgacctcgaggcgtttgcggtacggcacaccttcgctggtgccgcgccggtcgaccacgcccacatcgacgttgtagccgcgtgttcgcagctcgttgtacacgatgttctccatgatgtgcgtctgctcgatctggcagaaccccagtcgcgcgttgcgcagccccatgtcctcgaaatagtatttcttcgggctgccgatgtacttgcgtcccttgacgtcgaaccgtctcgcctcctcgatgacgaacgcgtcctcgagatggccgatgtattgcatgatggtgttcgtgctgatgccggaatgcagcacgctggcgaacgtggccttgatcttgggcggattggtcagggctccgatggaggaggccagcacgtcgaccaggtcgtcgagctcctgcgacctgcgcagcccgttgcgcgagacgatgtccttgagataggtctcctcgaacaggttcttcagatagagggacttctgctcgtcgcttctcatggacaaggtgagcggcatgccgccgaacatcacgtattcggcccagccgtgctggacgtcgccgtcgtacgcctgcatgaactcggcgaacgacagggggcggacgcggacctcgtcgccgcggccgcggaactcggtcatcacgttggtggacagcatcttcgagttgctgccagtcacgtacacgtccacgttgcgcatgcgcagcagcccgttgagcaccccgtacagacggggcggctcctcgccgcgcatctcctcgtccgagatcgcgtactgcacctcgtccagcagcacgtagtacggttcctcgcgattcgtgatacgggatctcacatagtcggacagggcgtgcgcgtgggggtaaggggcggttgccgattcgtgaggggcggcattgtgtgccgcttgttgtccgccgttgtgcaagaatgacttgcatgccttatcgccgtcgtcaatccaccgctccgaagtccggtgcgccgaaatccgttcggtccgctgccgccgggcagtcgttggacattgacggcatccatctgcacctgacgcgcaaacccatcaaaaacctgtatctgcgcatcaaaccgccgagcggccgcgtcgaaatctccgcaccgatgcggatgagcgagagtcgcattgcggatttcgtcaaagagcgacattcgtggattctcgcccagcagcagcgcatggctgaggcgcaacggcgctccatcatggcattgaacgagggcgccggcttcgagaacggaggtcgtggtgtagctggtgccagcggccatgatggaggcgttgccggtcgtccgaaaaccggtgatatcagtcgtccgggaattggtgacgccgggccaggccaagccggtacgaatgtccaaccgtattttgaccgctcccaaatctggaccgacgaacgcaaacgacaagcggcggccgcgatcaacgccgcgttgccacagctgctggccaagtgggggccggtcgtcggccggcagcccacgcatatcacgctacgggtcatgacctcgcgctggggatcgtgtacaccgcgaaccggccgcatccgtctgaaccttcaattgggactgatggaaccgcaattcctggaatacgtcttggtccatgagatgacgcatttgtgggaaagcggccacggtgccggattccagcgccgcatgaccgcctacctacccggctggaagacgctgcgccgcgacctcaaccgccgcgtggtgctgtgacgatgacgggtcaggcttcagtgccggcgatgtggctgatggcctgatcggattcgtcgacgatttgccgcatggtccgaatgcgccaccatctcgatggccgccggacacccgctcaccgacgaagaccgctggccttggctcgacaccatcgccgcgtggatcgacgagcgcgtggccgccggcgagcccgccgtggtcacctgctcggcgttgaagaagatctaccgcgacaagctgcgccgtcaaggcgtggtgttcgtctacatgcagggcacattcgacgaggtgatggaacgcctttcccaccgccaaggccacttcatgaagccgagcatgctgcaatcccagtccgacattctcgaagagccgggcgatgacgaaattcacgtcaacgtacacatcggccaggccgatcccgaacacgaggccatggccgtggccggtgccctcggcctgtgagccatctctcggttccccttagtctcacttcgccacacgtgcggcgcatcgacgaactcgaacggcgcatcagcgaacttcagctggagctgaagcagtgtgaaggccagcaagggcgaaccggatcggtccaaacgggctactcaggccgaccagcccagccagtccgttcagaccgacctaactgatcagagcgggccctctgaccagtccgaaccatctgaccgacatgtacttgttgactaagtgtgcggcccgtcattcgttatggaacatgccggccatgtatacaggcaggtaggttacattcccttcgactgagacgttgcacgggccaagcacatagcctgtattgagatggtattcagggtggacgagcacgttgtccattgcgcgatggcgtttgtaggatttgccggacttcacctcaatcggcagcacgtgatcgttgcggtcttggatgaggaaatcgagctcgccaagcttcttactgttgtagtagtacaggtcaaatccgtgagcgcgtagctcttgggccaccgcattttcatagattgaaccgtagttgatatcagggttgccgtcgagtacgtcgagcgcggttttcttgagaaacgagccggtaagcagacccacgtcgttgtaaaagagtttgaagaggttacgttccttgctcatctccaacggtgtgcacggttcgtccacgttgtacgcggcgacggctacatccgcattgaccagccaatcgaaatcggaagcaaccgattggaatctcatgttcttttcgattttggcgaaggtaaagcgcttgtttgggttatttaactcgctgggcaccaaatcgtagatagcgcggatatgcagccggtcttctttgcgcgcgtattggctgatatcgcggcgatattcacgctttatgttctcttgtatagtgcgcacgtccgcaacgctgccgtttgccacgaacgagtcgactgcggcaggcatgccgccgatgaccagatatttggagtatagctccatgagcctttgatgaatgaactcatccacttcctggtgcttggcaaagcattcggcaagcatatcgaatacgtcgttgccgatatgctgcgaccagcagaactcttggaaatccagtggatacatatccagctcggtcaggtacccgaccggtaccgagcgtatatcttcgagctcgactccaagtagcgagccggaaagcgcgtaatcgaaccgaccatcatctacaaggaacttaattgcggtgaccatttccttgcaacgctggacctcgtcaaagaaaatcagggttttgccgggtactaatggcgtatttacggccagttccagcctcatcagtaggtttttggcatcgcggggccgatcgaataatgcaacgaggtcagggttctcgatgaaattgagctcggcgatatggtcgtaatgctgttgggcaaagtgcctgatgatataggttttgccaatctgacgggctccggtgaccagcagtgcagtgcgtttcggcgcggatctccaagcttccagctgtgtctcgatttttcttcgcagcatgagaatctccagtcatttgtaggccttgcatctatgctgggcacgttttccaactgtttatagcgcatattttacacttttccaaccataagaatgcggttttggctacgttttccaacctcaaaatggggagttttatacacttttccaacttatgtatgtggagactctctatttcacgtgagacgaaagtggctcccctctttgaggggagccacggaatactgcttttacttatgccaggtgagagcgcatgaaccactggaacttttcgagttcctgcacgtggtcctggatgatgttggagctgatcacatccagctcgtccagctcggcgatggccttgcggtcgtcggcgatgaaggcgtcgtagtactcgatcagcgccttgagatactcctcggtgcccacgcggccctcagcgtcgaacgatttccacgtgcggttgcgcacgatggcgtcagcacggccatccggggtgccgcccagagtggcaatgcgctcggcggtctcgtcggcctgggccagcacggcctcgacctcggggtcaagcatctcgtgaacggcgatgaagttcgggccggtcacgttccagtgtgcgtgcttcaggaccagagcggcctcctgctcctggctcagtcggttctgcaggatggcgatggccttctcactggccgcttcatcaaggcccggcacaacaaatgcaagtgtcataatgttccttctttcagtaggtggaacgttgccctttcattctacgttttttggttatgccccgggccgaacgaataggtggtgaatatcacgcgactatttggcatcgtcgctttgtgattcggccggcagcggcgcatggtccggggcgccggctttgcggacttcgatggtttcgatgcggcggccatccaccttggtgacgaccatgttgtagccgtcgtcggaatgcagcacgtcgcctaccgctcccatcttgccggtcttggacaagaagtagccggcgaccgtctcgtacgggccgtcctccaattcgatgccggtcagatcggcgaagtcctcaatggtcatgctggcctcgatcgtggccacgccattgacgaacgcggtgctggtggtgcgttcgccgcccttctcgctgggcagatcgtactcatcgcgaatatcgcccacaagctcctcggtcatatcctcaagcgtcacgatgccgtccgtgccgccgtactcgtcgatgaccacggccagatggatgccgcgcttacgcagcagttccaggcttggcagcagcttggaggtgccgggcagggagatgccttcgcgcaccacatcgcgcacgatcttggcgttcggatcgcgcacgtccagcagatcgcgcacatgcacgaagccgatcacgtcgtcgaaatccttgccggtcaccgggtaacgggagtacggctggtcgcgtacgaacgcggcggcctcggccaagggctggtcgccctcgatgaagaccacgtcggcacgtgggcgcatcacctcggcgacgatggtttcggacgcgtcgaacacatcgtccagaatcgtgcgttcgtccttggagaggttggtgttggagctgaccagcacgcgcagctcgtcgtcggacacctcggactcggtctgctgcgggtcgaagccgagcaggcggacgatgccgttcgtgttcttgccgatgagccagatgatcgggcggcagacggcggcgaaggcgtcgatggcgggcaccacggcgcgcgcgatctgctcggtgcgctgcatggcgatgcgcttgggcaccatctcggagatcacgatggaacagtaggagatgatgagggtcaggatgatgttcaccaggccgccggcgatgccggggtgcacgccccagctttcgaccgccggaatcaggtagggggcgatggaagaggcgccgaacgaggcggacaggaagccggagagcgtcacgccgatctgcacggtggacaggaaggtgttcgggtcacgtgcgattttggcgactttggcgccgcgagcgtcctcctgctccatttgctcgatctgcgagccgcgcagagagaccaatgccaactcggtgccggagaacacggaaccgataacgagaaatacaaaaatcaggaggatgttcaaaccaagtgacatggcttcaactctaggggagtggcacgtcaaattggggtgtgctggctgggcagtaagaaactcggcaaagggaagggcactcttatcattactgcggccgacgtgtcgaccggtgtttccgatgcgttgctcgccttcgacgatgccgtatgcgctccagcgctggacggcattactagtgcagagaggctgtttctcgcggctatggccaaggattcgccaaatcccacgcaggttggcgatgttgcggatcgcacgctcagaagctcagcacttctactttgccggaatcgagctgatagcgggcgccgacgatcatgagcttgtcagcggcgagggcctgctggatgacaggagactgctccaccaaagtttcaataatgtgggccacatgcacgcgctcgatatcttcatgcgcgtcgagctcggcttcgcgcgcctgccagacggacatgccggcctggcgcagaataatcgattcggcggcggcgatgtgctcgtcgaggtcgtccatcgcatccgcggcctccagtgagccgtcggcttcggaagtgatggtgtgcatcaggtcgtccagctcctgctcggcggcctcgattgcgccgcagtgctcgtgaccgagcacacagatcaggctgacgtgcagtttcttgaccgcgtactccagcgaggcgataaccgcgctatcgatgagttgcccggcggtgcgcacggtgaacaggtcgcccaggccctgatcaaaaatgatttccggaggtacgcgcgagtccgagcaggagagcaccgcggcatccgggttctggccatcaagcaacgtttgacgggtctcctgatcctgccatggatggtcgggcttgccctcggcaaagcgccggttgccttgcagcatgcgactccacgttgcgtttgcggtcgattcctgttcaaagtctgactgagccatgaaacctccattatcagcgggctgctgattgccatattagcgagtattcgcgcatagtcgtgattggggcaacggccatttgggcacaagggttgcgggtggtgtgataaggctcatacgttacacccgcgcgagccgtggctcaccacattacgataggtggtggtaaacgcttgaagattaacaattcccgaaaggaccgatgatgactcttctgcagcatgaactgaccgatttcaaggtgaacgcattccagaacaatgagttccacgaagtgaccaaggacgatgtgctcggccactggtccctgttcttcttctacccggccgacttcaccttcgtgtgccccaccgagcttgaagacctggccgagaactacgccaagttcaaggaaatcggttgcgagatctactccgtctcctgcgacacccacttcgtgcacaaggcttggcacgacgccaacgagaagatcgccaagatcgagtacccgatgcttgccgacccgaccgccctgctggccaaggatctcgacacctacaacgaggccgatggcgtggctgagcgtggcgacttcatcgtgagcccggagggcaaggtcgtggcctacgaggtcatctcctccaacgtgggccgcaacgccgaggagctgctgcgccgcgtgcaggcctcccagttcgtctacgagcacggcgaccaggtctgccccgccaactggacccctggcgaggaaaccatcgagcccagcctcgacctcgtcggccagctgtgatcgacactgaataggcggtaatcttggcccccctttctgaggggagctgtcgctgaaagcgactgggggagtgctcgcgagagctagcctgatccgatatgctcccctcagtctcactacgacagctcccctcagagaggggagccagtgtatgtaagggagttttcatgactcagaccaacaatctctatgacgtcgtcgtcattggtggcgggccggctggcctgacggccggcctgtacttggcccgcgctcgctaccgtgtgctgattcttgaaaaagatgatttcggcggccagatcaccatcaccaacgaagtcgtcaactatccgggcgtgggccgcaccacgggccgcgcgctcacccagaccatgcgtcagcaggctcaggactttggtgccgaattcctctccgccgaagccaccggtctcgacgtggatggtgacatcaaaaccgtgcacacctcacgcggcgacctcaagaccttcggcatcctcatcgccaccggcgccagcccgcgcaagctgggcttcgagggcgaggccgagtacgccggccgcggcgtggcctactgcgccacctgcgacggcgagttcttcaccggcaaggaagtactggtggtcggcggcggattcgccgcagccgaggaatccgtgttcctgaccaaatacgcctccaaagtcaccgtgctcgtgcgcgaaccggacttcacctgcgatgccgcagtggccgccgaagccaagaacaacccgaagatcgacgtgcgttatcaggtcgagctgaagggcgtcaccgccggccaaggaggcctgcgagaagcctcaatcctgaaccttgccaccggccagaccgaaacgtggaagcccgccgacgccggcaccttcggcgtcttcgtgttcgccggctatgtgcccgccaccgatttggtgcgcggcgtggtggagctcgacgaccacggttacgtggtcacgcacgactacctcagaacttcggtgccgggcgtgtacgcggccggcgatctgcgcgtcaagaacctgcgccaggtggtcaccgccaccgccgacggtgcgattgccgccgtggaactggagcgttacgccaagcagatgagcgagaaaaccggcttggtgccgccgcgtcccactgcttccgcttatgaggagtccgaggccaaggccgcctccgccgcctcggccgctggcacgacgcccgccccggctcccgccaaacgcagcgccgatgccgcagccgcagccagcgccgccaagaagcccggcgaactgttctccgccgccgtcaagcagcagcttggcgtggtcttcggacgcatgacccgcccggtcacgctcgctctcgaactggacggcactccgctttcggcggaattgcagggtttcatcggcgagatggttgcgctgtccggcggcaagctgaactcggttgccgttgatgccgcagggctgatcacggcggtggatggtgcttctgtgcctacttctttggtggtcggcgaaccgctgtccgtcaccttgccggacggcaccgaactgcccacttatggttcgttggacgattccggccgcgccacattcgacgtcgccggcgtcctgccgctcgcccgcccaactgtgcgcatctgcgtgccggctgagggcgacggcaaggccggcaaggacggcaatggttcactggtcttcaccggtctggccttccacggcgtaccttccggccacgagttcaactcgttcgtgctcggcctgtacaacgcggccggtcccggccagccgctgggcgatgacctggtcgaacgcgcgaagtccatcacggacccgctgaacatcatgatcctcgtctcgctcacctgcacgatgtgcccggaaaccgtgcttgcttcccagcgcattgcctccctgagcccggccgtgcgcgccgaagcctacgacgtctcgcacttccccgaacttaaggaccagtacggcgcgatgagcgtgccctgcatcgtcatcacccacgccgacggcacccagcaagtcgaattcggcaaaaagagcatcccccaaatgctcgaactggtcggcgcgtaagccgcacgacctcaggtactcaacagcaacaacaacgattctgccaaaatcgtgacgtacatcgattgatgcgatcgatgcgcccgactccggcagaatcgttgttttgcggcagctcagcctcggtcttcgacggccttcgtgacgtttctgtcgccgaggtacttgaccaagctgatgctgatcagggccacgacgaacaggccggtgagcaccggaatcagcgcggcgtagcggtgggcctgatcaggcgcgtgggcaactacgaacgaggccaactggttgccggacagaccggcgaacgcccaggcgctcagcgtcagaccgtgcgtggtggagacggttttggtgccgaagtgctgatcaagcagcacgggcagcgtcgagaaaccgccaccatagcccgcgttgacgaggaacagcatggccagcacggcccacagcagagcgttgccgatgctgttggtgaagatctgcagcaagcacacggcaatcgacatgatgaagattacctgatagacggtctcgcggcgcttcaggtggtcggagagtgtggagaagcccacgcggccagccgtgttgaacacggagtccacggcgagcaccagtccgatgatgccggagatggcggcggcaaacttggcggggctcaggttggcatactgcgggaaggccctgagcacatcgtgcaggatgtccttctcttggctgatgagggccaggccgcaggtgatgttgatatagaaggctatccagatgccccagaacacgggcttcttgaggattgtcttgcggctgacgtgtgaggtcgcgggatcgtacacccagccggccggacgcttgatgagcaggaagccgacgaacatcatcaccgcgtagaccgcggcgaggatgaagaacatgctgaccaggccaaccgtgccgatgagatattccatcagtgggctggcaatggccttggccaggccgaagccggcgacggcgatgccggtggcgaggcccttgttgtcggcgaaccaaagcatcaggttcttgaccggagtcagataaccgacgcccaggccgatgcccatgatcgcgccataacagatgaacacgcccggcaggaagttcagggcgatgctcacgcccgtgccggcgaagccgaccacgaagcagaccatggagacgagtgcggatttcttgatgtttttctccaccattggcccggcaaacgcggcggacatgccgaggaagaagatggcgagtgagaagccccattccacggaggcggggctggcgtggagacggtcagcgataagctgcttgaacacgctccagcaatagacggtaccgattgggatatgaatcagcagtgcagggataatcgcgctggtccaacgattctcggtaaaccttgccatatatgggcggatcctttcgtaactggtgtacgatggcctgccggcccgaacgagagtcgtatcgcccatatccacgcacatcacgacggcatgcccctgtgaaccatccgggctgcacgaatcgaatcaaatcgaatcgtgcgaactgcgaacaattcgctaaacatccttggtgtgcatttcatcggcgctgctggctcttgtcgacgccgacaaacagaactataacgctgttatggggttgctgtggctgatttctgtggtcggaagctatgagctttctcacatcgaaaacagttatatgacggtatcggcgtgattgatacgtgacgtctgcccgtggacgcggcatatccctctcggaaaacaatgactccgtcatgtccatttcttggtttgacatgttttcgtttgcagcgtcggtgctcaccacggtgaccgcggcgttcgagtcgccgggcagggcctcgaccgagggtctcatcctcggctgagatgtgggcggtactatggattcttatcgataaggttcgtgatatgcggagatggtaacgatggtgaccttaaaggatgtcggcgaactggccggagtgaccgccaccaccgcctccgcggccctgcgaggcaaggattacgtcaagcccgaaaccacgcaacgcgtgcgtgacgccgcccgcaaactcggctataaaatcaacctgtctggccggtccctgcgttctgggcggtccgataccatcaccttccttacctcgggcctcgagggcgactatttctcccatctggccatgtgtgtggctgaggaagtgcacaagcgcgactcgcacatgctcatcgaactgtcccggtatcttaccgacgacaacgatctgtcgtacacgttttcggacggcatcatcgccatcaatgcgccacgtgcggtcgatatcctgaagcggcacccggccgtcatgctggaaaactacgacaccagcctgcccgtcgacaccgtgaacgcgccgagcgacgccggctcacgggcggcaatcgaacaccttatcgcgcgtggctgtgcgcgcatcggcatcgtcggcgacaatcacgatcccaacaatcccaacatcattcccggctcgcgtgatattcgtatgcgggccgccaaggagacgattctcgcggccggactgccgtttgacgagcgccgtgatttcatcaaatcctcgtggtcgattgacggcggtatcgaggccgggcgcggcttggccaagaaaggcaagtgcaagtacgacggtctgtactgcctgaacgacggtattgcgctcggtattctgcgtggtctggcggacgatggcgtaagtgtgccgggcgatgtgcgcgttatcggcttcgacggcctgagccagagcatgtacagcgtgccgactttgaccaccgtggccaccgatttcaagggcatggcggataccgcgctgaccttgcttatgcggcgtatcgagaacctggacgacgagttcttcccgcagaccgtgaatgtgggctataagctcatcgagcgcgaatccactgcggcgtagagtctttggccgtgttgagcttcaattgggtgattggactggcaccagcggctgatatcagatatgccgaaagcagcgatgatcggatttaagttgctggagatgacaggatggattgctctttacccctttcaccatcttgcaataattcttacatgtaagaactctctgttaacatgtaagaattattgcaagatggtgaaaggggatgctcatgttgccggccaaagaaagtttgacggttgagttcaagagtgagcagaagcgccctcaatcgcatgatgaaattgttgacaacgtagtggctctagccaataccgaaggcggcacactgtatctcggtattgaagacgatggcactgtgaccggcgtatgtgacgagcatcgcaatatcaatggacttgcggtactaattttcaataagactgttccgcagcttcccgctcgcgtggcgctcttgtatgagaacgaggtgccgatagtcagtattgaggtggataacagtcagcaaatcgtatctaccagtcaggggaagacattgcagcgccggctgaaagcagacggctcgcctgaggtcgttccgctgtttgtttcccaattcattagccgtttatctcagcaacggttctacgatttcagtgcgcaacctgccccagaggctcggttggacgatttgaatccagactcacggaacaagttgagaagccatattcgcagtgccaatgcgcaaaactcgttgttgtcttttactgatgaggatttcgatcgggcacttgagctggttgttgatggcccgtatggattgcagccatctgttgctggtctgctcaccattggttcggttgatgctattcatcgatcggttccagccgcatcggctgtttttcaagtgatgaaaggcatgtctccaaaggtcaatatggatccgttcgtgttgcccttggtggatatgtttgatcgtgtaggcgagctgatggagccgtggaatcccagccacgaagtcatgagcggcttgattcgggtcgatctgccagacttcgatcgaggggcattccgtgaggcaatgattaacgctttctgccatcgcgattatgcacgaatgggttcggtgaggttcctggttgatgatgatgggttgaccatagccaaccccggaggattcatagagggtgtttccgaagataacctgcttactgcacaaccgcgttcccgcaatccgcagcttgccctgattctgaaagctgccggatatgttgaacgcaccggacgaggcgtggataccatctatgccgggtcgattgcggcaggcggttctttcccggattattcacagtccagtgctgaggaagttatcttgttcttgcgccgcgtggtacctgacgaggcattcgtaaccatgattggcgacgaggaacgtcgacgtggggctccattgccggtctggtcactgattgtgctctcgctgctgcgtgagcatcgtaggcttaccgtggtccaattgtgcgatttttctcatttggagcatcgacgcatcgtgtccgctgttgagaatctggtggaagctggtttggtagagggggtcggtagcgggagctctcgttcgtatatgctgagtgcccgagtgtacaaacgttcagaggggctggcgtcttacgtgcgccagcgtgacatcgatgccacccggcgcagtggccttgttctggagttcgccgaaaaaaatgatggtgtcgtcactacggcggatgtcatggatttgtttggcctgagctatatcagtgcataccgggtgttgaagaagctagaggatgcgggcaagttgcgccgcgaggggaatggaccgtcatcccgatacgtgttggaatgattggtacgcgtgaaagtaagttctttcatcacctttcaataattctttcatgtaagaactctctgtttacatgtaagaattattgcaagatgatgcaagatgcacacaaaacggggaagctctgcttgatgtgagcggggcttccccatatgcgctggtgtgtagatcagcctgtgttctgcaggccggcagcgacgccggagacggtgcacaggatgaggtagatgaatcctgcctgttggctttgcgagagctcttccttgtccaccttcttgcgcagcgacctgagggcgagcacctgggtgacggacagcgcgtccacgtacggggagcggatgcggatggcctggccgagcacgtggcggtgctgcagcggccacttgtcgcccacgatgcgctcaagttagtccggtcaatggctttggaaaatcatggggagtgcggctgcgcgggttcgctcctcgacaaggtgacttgatttgggaccgccgttaactttcgtcagacacatcgtaaatcccgtccaagtatccgtatcgtccgttgtgcttgtccttcgagaattcgacgatattgatgttatcgtcaagaggaatgccagccatgtgattcgtgttttcgataatgatgatttgttgtgaaaccgcttgtttcgctagataggaaaacaggcccactttcatggatgagtcttccaggggtcgtattccttcgtcaaacccatgcagaggcgtatcaataagcagccaacccggagtatgctttgactgttcattgagataatcatgaaatgcgagcataacaacgctgttaagaaatgcgcagtatcccttgccttgttcatcagccttggaataccctgctatttcgacatcaaaagaagatctgctgaaatctgcagtatcagcaccttgaaaatgacattgttgcagaatgctgcgtatggtgttattcatggaataccagaaatcactctggaaacattcgcgtggcttgtatttttcatcattctgtgttgcttgaccagcgtcatcgagtgccttgttgaaacgagcatgcagcgctatgagttccgcatattccgcatgcaattgttctgcatgggcaatttgctcaatatcttgttgcatgtgctgcgctgttggttgaatgtcggatttgagcgaatgcatattttgccgatgctgctgtttctccagatgcagctcctgttgcacctcatcggctttgtcgacgaggatggctagatcggtttcaacgtctgcttggattctgtggatatgctcaatttctgttgagacgattagaatgtcctgttcagtcggcacagacatgtggatggggctgtggcaaaactgacatgtggcgggataggcatgtgtgcgggcatgtttcattgcctgtagttgcaaatcaagacgtgcagcgtctgattcgtattgactgataagtaccttacgttggcgaataagtacctcaaggtgctcatattgttgattaagctgagagatatgtgagatggtatgggcatctcgattgaggagagtttgtctttgctgttctacgtgtaatgcttttttgtgaaggtcttccaaataggtgtgaatggtcttcccctcatttgttgcgatatggcgcatctcctcaaggtgtctgatgcgaggctctatatcatccaactgctgatggatgaactgttccacggcttttctgcgggcgtgacgttcgctggcactctctgtctgtatggagttgtcgatttttttcatcttgaactagcacgagcaacgaggacagactttgtgtgagagttgctagagaggtacttttggggaaaagaatggaggggcgtgcacgtcctatttggtcctcggggacaatcatgagatgtctgatggcattccatgtgaaagcaactgtatggtaggtttcgtttgtcgctattctacgggttgattcaacgcctagtaaggcaagaagaaccgtattgattgatttaccggcacgtgatgaaacggagtaggaaccggggacgatcattgggttgctggattttacatggatagtgttctgaacgtgaatcgaacgactaagcgaaacctcaccgccgttggtcacgaacgtgacctgtgcaatttcataggcagttttatcggtaaaggggagctctttccctccgcaggcaaattccacggtttttgcgattctggttttcccggtgttcgaagcgccgataatgcagttcagcccgcatgtgagattaatggcggattccactccgtcctttctgattgccgaaattcgacgtatccatgtgtttctcataactggttgttctctttcgttattcggttcatgatggtttcataatcgttttttatcaagagctgaacagcctgtcgataggaggcagcgtaatcgccgtgcaatgcttccgaatattggaaacattccggagtggcgcggtacaacaggcaagtggaatccacggttgctgctccaacgattacgagttgggctaatcctgcttgtattcgtttgcgacgagcatcatattcggctaaagcatgtggaccatcgccgtgaagattgcgctgtccgaatccgaatgttttcatataggtggcgataaggtcaatggctgtgatttcgtcaattgtggaaggtctagaaagaaggggaaggcataatgtcaatcgtgttgctgtttcctgtgttgtgttaaataatgaattattcattttcgtgtacccactccagcatatggtcgttgaccagcatatgacacagccctttcttttccgctgccttaatcattgatgggaattgggctataactgaaccggatagggggaaaccggctgcctgagatagcgttgctcgcatgcgtaacagtccatcggcgtaatcagatgcgcaggtatcgcatattccgtcataaagatcaaccttcagtgcatcaaattcttgctctccgttttctataacatcccgtagattcctgcgcattccttccgcatcgtaaaaatattcacgttgcttggcgtattcaggacgacatgtctgaggaagatcgtcggaacagttgattggcttgtgcaagtgatcggcataggcggcttgcatctgcgtgaggtatgtcttttcaagatgatcatctggtttatccggtggaattggataagccttccaggggaccgaagagcgcccaaggtgcaatttgccgttgttgatgcgaccagacgccagaggtaagttttcgaaaatatcgaatttcggctgaaagcttatgccgtcgatgagaatgtcacgtccaccggcattcgcctggagtattgacagaagccattttcctgtggcagaaggaagctcactgatatccgtaactctaatatttgccttgataagctccttttgaaaatcggcaagggcatcaatgctgatatcgcagcaaagacgttctactttcgagatatctaggcgctgataaaactcggcggctttccaggcaggaatcttcttgcgaccgttataaaaacgagtcagatcagtatcgttgattccagaccagaccccggtggtaatagtggtctttccgggtttgcggtttcgatgatgttggggaagtggatttcttagaccgtcatcctctaacacagcatcgaagaaatccttcataaatccctttttgtggtggtctacgccagatatataagggtttacgagctgacagaagactcccagagcataggtagcagtagtttcggccaagtgagtctccttctcgtctccatttgtcttcatccgtcgccttcccatgaggtcactgttcctacgatggaagccagattcagacgaataagccggtaaaacactggaatatcgccagtatacgccgcttacagctggatcagagaagcgcaactttcgtctattgaaaggatttgagaccagacacatcgtaatttcttcttcaactcgatgtcatgcgataaccggttatagaagtagggcattgggctgttcatccgttgtgccgcagtgaagctgactggggcttttaactaatcacatgcatgagatctgcctgcttattcatggtgacgcgtcggttttctcctgaactgacgcgtcatgcttatccagcaggttggatgctcatgtggtggcctatgcaagcaggtctcgaagacccaataactgggtgggatcgagactggaatgagaatttcattgaaacatgaggcaatgcgcgccggtaatgtgtccgtaactgatatatacaactgttcggaagtggaattacggacgatggttgaacgcgatagatgtttgcgcgcaatccgtatgggttgttcgccacgtgatattgcactacgtacccctcaaacgatacttcaggaattgtggaatgcggaggaacgttccgctcacgcttattatcgatcggaccgtgtcagcggagttatttgctcctatgaggatttggttggtgcagggcgggaaccccaggggtgttctgcttcttctgaggatattctcttatgcgcggaggatgcgagagaaagagctaactgtttgcaagctatctttgcggagatcgaaaaactgccagcaggtcagcgcaatatcgtcaggggtgtactggtaaagggggcatctcaatcagatatggcacgagagctgggcgtgtcccgagctgcggtgtccaaacagctttcaacggctgtgcgcaaaattcgtgccgctattcgcgacgaaagcaaagaaacgaagaacacgacaacatcagcagtttgtgaaagaaaggagcattaatggttcatttcagtgttatcagagtgaaaggaagcccgtcatatgacttcgatgcatgcggagacattttggctatggccaaagctgtaggtgtcatgacggaaaacatgcgcactgatcgctgcgacaatacacagtgtgatggaagtcgttgtaagggaaacactatgtttcggttggagttagacaccgaaaatcgcagagttcatcgcagacgccatgccagatgaaacgcccgaggttaacacctcgtggcgaaacggcagtgcaggtgagggcagatattgggtctgccttcagcaacaggtcccgaaggaggacatcatgactgatcagatggtgctgcagacgcagcagtggctgaacaagacatacgggaatgatccccgattcaagaaaatcaacccggacggcagaactggttggccgacaatctatgcgcttactcgcgcattgcagattgaattgggcatccagtccactgccgataacttcggtccttccacccagcggttattcaagcagcggtatccgaatggggtgcggcagcaggcagttgcggacaagagcacttccaacgtgtattccatcattcagggggcgctgtggtgcaagggctactccactggtggcaacatctcacagcatttctacgacggaacaggttccgcgatcaggaagcttaaggctgatatgggcatagagggagattccagcgtagacgttgagatcatgggggcgttgctctcgatgaagcagttcgtgctgctggcctcttatggcggtatcgactccgtccgtagggcacagcagttcatcaacaaagcatatcgtccatacacgggcatcattccgactgatggactgtacggcagggagatgaacacggctcttatccaggtgcttcagtcgcttgaaggtttttcacccagtgaggcaacggggaatttcggcaacggaactagatctcgtttgaaaacgataacagcaaataacgcatcctctaatgagtcgtgggtctggctcgccagcacggctttggcgtgtaatgggatcgggggcgggccgaccttcgtatggacgagcacgttcgccaatatcgtgaaagcgttccaggagcgttatgccattgctgtgacgggctctattgattcgaccacgtggatgagcctgttgacatctaaaggtgatcctgaccgtccgtgtgtggcctgtgacactaggttcgaaattaccgacgccaggttggcgacgttgaaggcagacgggtatgaaatcgtgggacgttatctgacggagcctggccagtcgtcgttggcgcccaaggattactttaaggccatccgtccgggtgagctcgagcgcatcactcggggcggcatgcggttcttcccgatcttccaggagtactccacgaagctggagcatttcaccccggcaaacggcgctgctcatgccaagaccgctcgtgaggcggcgcagcgtcttggcatccctcccacccatatctacttcgctgtagacttcgatgcgaccgatgaccaggtgaccagcaatatcctgccatacttccgtgcggtttgttcgtctcttggtggtggatacggagtagggatttacgcgtcccgcaatatttgttcccgcgtcatcggtgcgggatgcgcgagtaacgcgtttgtgtccgacatgtcgacgggattctcgggcaatctcggcttccccatcccggacggttgggtctatgaccagttcaccgagattgacgattacaagggccagggctgggatctggaccgtgttgcctattccgggaaggtatcagcatgcgcttcactgttgcctgccgtgccagtgcctgcgcctgatcccgatcccgtctcgccagaaacggatccgctgctaagatgggtcgccgtcacggagcaggagtgtcgcaaagcccttgccgctctgggtacccaggtagcggtttacgaggacagcatcggtcaattcatcctggaatggctccgcaaacctgaatactggtcggaaggcggtagcgggacacaagcaatgtggcacgcatatactcctgaagtttcgactccgcccgacttggacgcggcgcgtgtggtatgtgccaatgtatgcgaagcacagccttcaattaaagagaaactgccatcgactcgagatgttgcacacatggctgcaactgctctcggatacctgacatggggtatcgaaaacaatccagccaaatatggtctaggcgatttaggtggctggcctctcgacttgttgcagatctggggtgcctatcgccgtgacggcaagcatgccgacttggcagcatggctctataagcaccttgggaaagatgaaggattcgggtacgatgacgttcttgcggatgcagatgcatggctaattgcttctagtatgaggaaacgatccggttcgacggttctttctgctgctatgcgtgaaacgtttaagcagagtgagacccatcgtatcgttcgattctacgacgaacgttttgcatcaagcgcagataatgtggtgagtgcatattcaacaatggcggacggtcttgatgcacttggtttgacaaatattggaatgagcgaaagcatcctaaaaaaggctgccggtacagacaagcttcctgataagcaggaagctgaagtgagtgctcgggcgttcgctgcattcattgatcagccaagacggtagctcgcataatgcattatgtgtgggcagatgtgtcgtctgcccacacattcgctgttgtgctttcgatttggaattcctctgccagatacggggaaacttctaaaaggccgctatgccgaggaagagtcctgtaataccggtggccatcaatacgatgatggtgatgattccggcgaagatgcgtacaggaagggtttcttttccatggtttgatgggctgtccgcaactaatctcattactccagctgtaacccagcaaactgcgcccaggactagtgccaggaattctcgacaccattccgtttcaagtgcgggaatgccgacgattgatgacgggtcgcttgccagtcttggcggaatagcgcataggatacgctccaatatcaggtaaggggtatcaaaatggatcagagtcaaagcgaatgggagctgtagcgccagtcctatccaccacagcgtgcgtcggatggtcgcgagtctgtcgcccggcctagtgtccggcttgccgccttcgccctccgtcccggcaccgtccgcgggcgtgtggtccccctcgtgcgcgtccgtcgtcccgtccgtgtccctttccgcgtccatatgtccccctccgatcatccgagtctgtcgctcggcccgcgcgcccgttccgtgcgcgccgtcgccggccagtctagggccgtgcgacgcgaacggggaggcccgcgccgtcaatcggcacggaacctccccgttcatcaagcggtcggacagccgcggatcagcccgtgttccgcaggccggcggcgacacccgagcaggagtgtcacaaagcccctgccgctctgggtacccaggtggcggtttatgaggacagcatcggtcaactcatcctgcaatggctccgcaaacctacgtactggtcggaaggtagttccggcacgcaggcactatggcatgcatacacaccggagccggttactcccagcgaattggccttgtcgcgtcaggcatgcggtgtcgcatgtgatgcacagcctgtcatcaaaggcacgctgcccaatcgggacatcgcccatatggctgccacatccttgggatacttgacatggggcgttacgaacgatccaatggactatggtctcggtgatctgggcggatgggctctggatttgctgcagatttggggaagctacctggcgaataccccgaaagaggacctggcgtcatggctgcacgctcatctcggcgagcaagacgctcgtatgggattcagttacagcgatgttctcgcggactgtgatgcatggttgctggcgcggtccatgcagagcaattcttccgaaaggtctttgtccaccgctatgcgggacatgttcgcgcaaagcgagacgaatcgaattaaacggttctatcagtcccggttcaagggaagtgcggacaacctggtcatcgcatttcgaaagcttgttgatggaatcgatcttggaatattcgataacgtatccggaagtaaaaaagcactgctcattgcgtcacatgcagaccgactcccgagtcaagcggaggctggtatattggcattatcctatgctgaatctcttgaaaatccgaaccgttaatcaatcatgattgtgatcgcattgcgtggaatgattcagccattccacgcaatgcgcctctggtaaaacgtcatagagtcattagagcggaaagtagcgttatcacaagaacgggaaagaccatgaccagcacgagaaacgatatgattcccacaaggacatgcgaggcggaagaggaatgatcacgaagttccggatatacagatcgcatatatgaacgcacgccaaagatgacaagcgccgcaatccagcagactacccccataatcaatactaaggtaagtctacgtacatactcagttgccgtagttaaattcatgcacgaagaggaagagaacgttaagactctgcagattatagtatcatcatcgccattggcgccccattccgcccacaaaataagtgctggtgaaagcagcagtaatcccagccaccatagcacgcgtctggccttgcccaaagccacatagcatctactcgccttaaggaatttggtagctgctttcggtgccaaagcatatttcttgccggaaaaattttctgacgtatcttccaggccatgttttttcccaatgtcatcgatcatagccggattcgctttgcaaatgtggcgttcgtttccggcatcgccctccgccttgatgccgtccgttggcccggtgctcccgcgctcattcgatggcttgtccatgtcccctccgatcatccgagtctgtcactcggccagcgcgcccgttctatgcgcgccgtcgccggccagtctagggccgtgcgacgcgaacggggaggcccgcgccgtttatcggcacggaacctccccgctcgcttttcccgatcggtcggccgggaatcagcccgtgttctgcaggcccgcggcgacgccggagacggtgcacaggatgaggtagatgaatccggcctgttggctttgcgagagctcttccttgtccaccttcttgcgcagcgacttgagcgccagcacctgagtgacggacagcgcgtccacgtatggggagcggatgcggatggcctggccgagcacgtgacggtgctgcagcggccacttgtcgcccacgatggccagaacccacttgcgggtgagctccatctcgttgagtaccttctcattgaggtcctcgcggtcgccgagggcaaggtacatcctggcgatgcgctcatccgtcttggcgatggacatctcgatgttgtcgatgaaggtggagaacagcggccattcctcgtaagcctgacgcatggtctccagatcgccgaacttctcgcatgcggtgccgagaccgtaccaggcggccaggttgatgcgggcctgagcccaggagaagatccacggaatcgtgcgcaggtcgtcgagcgacttggcgccgaggccacgcttggccgggcgggagccgatcggcagcaggccgatttcggtcagcggcgtaacgatcgagaaccacggggcaaagccgtcggtgttcaacaggtcgaggaagcggttgtgcgcggcctcgtcgagctgagcggccatgtcggcatacttctcggtcatctcggtgttgcgcttctccacgctcggcgcggactgcagcaaggtcgccgcagccacggactcgacgtggcggatggccagcaccgggttgccgtaacgggcgaagatgacctcgccctgctcggtgagcttgaagcggcacttgacggaaccgaccggctgggcgagcaccgcgcggttggcggggccgccgccacgaccgacggcaccgccgcggccatggaacagggtcaggtcgatgtcgtgcgactcagcccatttggcgatgcgctcctgagcggagtgcagggccagcgtggcggaggtcgggccggcgtccttcgaggagtcggagtagccgagcatgacctcgagcttgttgccggtggccttcagacgagcctgaacctcggggatcttgatcatttcctcgagcacgtccaccgagttctgcagatcctcaagctgctcgaacagcgggatcacgtcgatggtgggcacgtcctccgggtgggagaaggccaagcggttgagctcgtagacatccttgatgttctgggcgctcttggtgaaggagatgatgtagcggcgggcggccttgaggccgttgcgcttctggatggcaccgagggcgcggaaggtgtcgagcacctcgtgcgtcatcggctgcagttcgccgcgctcgccgtgcaggccgtgctcgcggatatccgcaagggcgcgggcgtgcaccacggagtgctgacggaactccatctccaccatgtggaagccgaaggtctcggtctgccagatcagatcctgcagcgggccgtaagcggaacgcttggcaccggcggcggccagcgaacgctggaccaccttgaggtcggcgaggaagtcgtcgcaggagtggtacatgaggtcggcgtcgcgctcgatggtgtagtgcagacgatcggccatcaccagcatgaccgcgcggtgcatctccttggtggagatcagggcggccttgtcggtcaggcgctcgctcatttccttctggtggctccagaggctcttgagctcggcgctcggcggcgtggtctcggcttccatcgtgaggttgcggcccacggtgcgggtggcttgctcaagggcggcgatcacgtgatcggagaacttgcgggccacggcgcggctcaccttggcggtgacgttcgggttaccgtcgcggtcggagccgatccagctgcccgggtggaagaacgcggggcaagcgggctcgacgagaccggccttatcgcccaggacccagtcgtcgaagcgacggtagaccttggggatggtgttgaacagcgtgttgtcgaagatgtcgagaatcgtgtccgcttcctcaaccggggtcggcttcttcagcgcgatcggagaggtgcggaacagggcgtcgatctcgttgtagagacggcgcaggcattccttcttatccgagccgccgaggcgcttgtactcctcaagcaattcggaaacgcggcgaatcttgccttccacggccttgcgacgggcctcagtggggtgcgccgtgaagacggggtggaattcgagctggttgagcagttccttggccttggccgggccagtctcattgatgagctggtggtaggcgacggtgagctcgttgatcgggtcgaccgcctggtcaacgggcacgttgttctcgcgctcgtggagcacggaaacgcggtagttctcctcggacaggtttgccagatggaaatacgtggcgaacgcgcgggccagcagctgggcgtcgtgcaacgtcatgttgtcgatgacgttcacggcctccttcaggccatcctggtcggggttcggatccttcagctcggcgaaatgctcggcgctggcctccaccgcgtaatgacgcacggtgtcgaacgtagacagcagttcggggttgtattcgcccagtacgttacgcaggatctcaagacacagatccatgtcgtacttcaggctttcgggaagatcatgctcctccgggccctttcggccggtcccggtagtgacgatggcggcgtcagcgggagtgatctgttcttcaggtgttgccatataacctcctttgccgaataacaggttgctcggtctactggtcgtctgcggctcctccgcagttgttgagaccagtcgttgcgagcccacagcccatattcaacgtggttgttgtgtgggcaatagtgtatccccgcgaaatcgctttttacgttacgaagtccatatagtgcgccaagttgtccacctatagagaccgaatatcggacagcatatgagacactgtccgattcgcggaagatttgagcgccttacgattgctggcggggaaggcagggagtagtaatgaaggatgtgagcgaacagaagaaaaaaagtgcgcccgaagcgaaaggcgcaacggctgtacgtaaattccacacccactccattccgctggacatggaagatattgcacgcgattgggaaaaaccggtggtggacgccggtatcgccgccaaagccagcgtgattgtacgagtcggcatgttggacctgggagccggcaccggctccttccgcgtgcgtgaaatgatgcaccgcatcgcctacccgctgggcgtgcacgtacgcgccgacgtgaacctgacggatatcgaggccacctgcacggatggtcgtaaccgcatcaccgaagtcgtggatttgccgagtaccggcgtgaacaccgaacgtatctggctgctggaacatttcgccgactggttctccgtgaatctcggcaaggggtcgatgtatcacgtcgattcgcaactgtccgatggcgtggtcaagcatttggacgaacgtgacgcttcgcagtattcggccgatctggccaagcgcctgcgcgaacgtgccaaggtcgaggctgaggcggccaacggcagcgtggacgaggcgctggatcttgcgtcgaaaaccaaggtactcgtgacctccgtggccaagtccttggacgatgacaatgaagaagcccaccgacttttggcggacagcgcggaagtcactccggtcgaagacaaagcggccgaagagaaggcctacgacgatgccgaagtgtttaccggtgactccaatgagtcggttgaatcggcgaacgcggcgaacggcgcaaccgccgaaagccctgctgcaagcagtacgaagcgtaagaatcgcgtgcccaaggaatacgccgaacacttcaacgagcgctccgacgaagagaaggccaagggcggtatcaccgtgcggcaggcgcacgagcgactcgatctgattgagcgccgcaagccgctgtacaagccgtggttctccggtctggcctccgccctagcctgcgcggccttcgtgttcctgctcggcggcggcccatacgacatgatcggtgcgttcgtgggcgcgggccttggccagtggatgcgtcgccggctgtttgcataccatctgaaccagttcttcgtcacctttgtgtgtgtggccgcggcggcgctcgcctgcaccggcaccctgcgactcatcggcattttcgacccagtcgcgctctcgcacgatacggcctacatcggcgccatgctgttcgtgatccccggtttcccgctcatcacaggcggactcgacatggcgaaaatcgacttcccctcgggcatccagcgcgtggcgtacgtgctgtgcatcatcctgatggccacgctggcaggctgggccgtggccgtgatggtgcacctgcacccggaaggctttgagccactggggcttgacccgtgggtcaacggattgctgcgattcgtggcggcgttcgtcggcgtgtggggcttctccgtgctgttcaattcgccgcagcgcatgtgcctgaccgccgccctgatcggtgcgatcacggacacgctgcgcttggaattgcaagacttcaacgtggcacccgagatggctaccttcatcggcgcgtttctggcgggcattctggcatcggtgtggcgttcatccgtgcgacgtggctggctaccgccgcacctcggctacccgcgcatctgcctgaccgtgccgtcgatcgtgatcatggtgcccggtctgtatatgtatcgtgccatgtggtacctcggcagcttccagaccatgaatgcgctggactgggcgttccgtgcgttcatggtgattatctgtctgccgatcggcttggcgatggcccgcgtggtgaccgacaagtcctggcgctacgacatctgaccgtcatcttggctctcctcaggtggggggagctcggataaaacagcgtctcagtatggaaacggtggaaggtgcttgagcccttgtatccactaccatcaggcgaagtgcgttgcggccgtattcacggctgtgacggtctgtatgacgccgctccggcgtcaatcgcatatcagcacatagttctgccatggcggtagccgcttggcgtcatgattgaggaggggcgcagttggccaacgatttctggattctgctggccatggtcatctattttgcggccatgctgtccatcggattcatctactccaaacgctccaactcctcctccaaggaatactttgcgggcgggcgcggcgtggggccgtggctcacggccctgagcgccgaagcctccgacatgagcggctggctgctgatgggcctgccgggcctggcctacttcactggtgcggccgacccgatgtggaccgccgtcggactggcgctcggcacctatctcaactggaagcttgtggcccggcgactgcgccgctactcggtagtgaccgacgatgccatcaccattcctgacttcttcgccaagcgtttccatgacaagaagggcgtgatctccaccatcgcggccgtgatcatcctggtgttcttcagcgtgtacgtgggcagctgcttcgtgaccgtgggcaagctgttcgccacgttgttcggtttcgactaccacgtcatgatgatcatcggcgcggtggtcgtgttcgtctacaccgtggtgggcggctacttgtcggtggtgatgaccgacttcattcaaggcatgctcatgttcttcgcgctcgcggtggtgttcatcggcaccgtggccagcgcgggcggtgtcgacaacaccgtggaattcctgcgtgccatccccggctacctgtccggcacgcaggtggccgcgcccaagctggacccggccaccggccagcagctcgtcgaggcgggcaaggccgtgttcggcgcgccctccgactacggcatcatcaccatcatctccatgctggcgtggggcctgggttacttcggtatgccgcaggtgctggtgcgcttcctgtccatccgcagcgtggaagaagtgcgcaagtcccgaatcatcgccacctcctggtgcgtgatttcgctgggttgcgcagtgtgcatcggcttggtggggcgtgcgatgatgcccaccgaactgctgacctccaccgatgcggaaaccatcttcatcgtgctggcgcagaccctgctgccgagcttcatgtgcggcgtggtggtctccggcattttcgcggcctcgatgagctccagctcctcgtatctgatcatcggcgcttcggccatgggcgagaacatcttccgcgggctgctgcaccgcaaggccaccgacaagcaggtcatgattgtggccagggtcacgctggtggtcatgttcctgttcggcattctggtggcatacgaccagaactcgtcgatcttccaggtggtgtcttacgcgtgggccgggcttggtgcctcattcggcccgttgatgctgtgctcgctatactggcgtcgcgccaacaaggccggcgccgtggccggcatgctgtccggcacggcggccgtgctgatctggcacaacctcgtcaagcccttgggcggcgtattcgccatctatgagctgctgccggcgttcatcatttcgctgctgttcatcgtggtggtttcgttgctgaccgccaagccgaacaagcgcatgctctacgaattcgaccactacatggacgatccgctgcccggcaccctgccgtccggcaccgtgctcgtcgacgagcccatggaagccatggagtccgaggtccgcagcggcaaatgacacgtgcctgctgtgcggtcggctcgtatggcagaggagtggcttttttgtggttcggcaggaaccattgaggccaaaacggacttcgaggggctgatttgacgttctggagagatctacttccgtttcaaggggctgatgcctgagtagacgcggctccaaaacggcggaatggcgttgacgtaagggcattgatacacgtggtctaccggatgatcagccccttgaaacggaagtagacctccggcggaggccaaatcagccccttgaaatgggttttgaataccgtagcgcggtgcggacggtgcggactgactctaccgggcttattattcctgcgtcgtcggaataattggcagcagaggctcgaatttcagccgtttgtacagtggaatacggcgtagctttcggacatcgctaatttgctgggtagtttgccgcatcgtgagctggactgttttgcccgtaacctcctgtatcctttcggcaactcttcgggcaagggcctcttctcccgcttcgtcgccaatatctaatttggtgacttgaatgtacttccagccagcatcttcgatcatctggcggcgtctcgcgtcattcagccattgcccggcatgatgagagccttcgtattcgatacatatcttgaattcagggtatgcaagatcgagatatatgggtctggtgttgtttcctacgaatattggataattcacctgcgggcaattcagaccgtatttcaagagaaccaaacgagttcgtgtttccatggaggaatctgtgcccgcgcgcgccaaaagtagggcgcgacggcatttgttatacccgcggaacaaatacgaattggtgccattctctttgtcggctcgcacctgggcctcggcctcatcgagatacagagaaagggcgtcgatggttgttctgcagagccttcgatctcgtcgcatcatggaatcagcgagaacgatgagttcttcaagttcgagatacgtggagaacatggcccatgtgcaagctggtgaagtgcatgtgaattgtccctcgattatgaccgtgtctagtggaaaaggccatacaaccactttgacccccacaatgtgccgtttgtcattggcgtgtggaaccgcaacaatggttgtagttgcaaggcctctgtgtttgcttgatatgcggggtacttcaattgacaaaagctccaacgctgttgtcagggcatagggtgggcgccatgcgcttcgtcgttgaacatctgcgcacgtctgcattcgttggtacttctgcattgtcagctcggtcaatgccgttgagctacccatgatgatcaccccttcgtgatgttcgctttgtcctcgcagtgtagagtccggctaccggccctgtctaccgccccaatttttcggtggataaatgtggataagtcggtggataaactatgggtgttcatcgcagttgcaggccatcccgcaattacatggaacgtaggggtttgcaggcagccagcgggaatcgccgtcgacggcgcgattcaacttggacgaatctccatggcgttcatgcaaaggtggcatgatggccggtatgagtagcttggtgcgtattgtcaatgccggtgttccggggtctcaggaccgcgtggatgtggtgcttcgcgatggggttgttgcgtctgtcggccctgctggaacggtctcggcttcggacagcacgatgcagactaaggcgcatacgacatcgttggaatacgcgacgaatgccattgcttctggcagcgtctcaatcccaacgtcggccgccgcacccgccgacgaaaccaccatcgacgccgacggcctgtgggttattcccggcctgtgggactgccacacgcacttcacgcaatgggctaagacgctgggccgactggacctcatcaatgcccgttccgccgccgaagcgatggacatgttgcgccgtcatctggatgagcgccgcgccgccgacacgcttgacccagatgccttcgtggtgggcatgcgattccgtcactcgctgtgggccgacgacgagcagcccacactggccgcaattgacgccgtgaccggcgaacagccggtggccctctccagcgcggacatgcactgcggatgggtgaattccgccgcggcccgcaggcttggcgtacatgtggacgaatccggtctggtcggtgaactcgaatggttcaacgcctacaccgccttcgacaaggcgccgggcgctgctgaagagactgaccgtctgctgcgcgaggccgaacaggacgccgcaagcaagggcgtggtgggcatccgcgattatgaaatggccgaaaacatcgatacatggatcaatcgtttcgcggccggcattaacggtttgcgcgtggacgccggtgtataccccgagcggttgcgagccgccattgacgcgggttggcataccggcaaggaattgccgggcagcgccgggcttggccatgtgggcgccatgaagctcatctcggacggatcgctcaacacccgctccgcctactgctccacgccgtattcgggcatcgagccgctgacgtatggcacgctgagctacacgccgcagcaaatcgaagactatatgcgcctagccaccgagcatggcttcgacattgcctgccacgccattggcgacgaagcgaacaccattgcgctcaacgcagtcgccgccacgcacgtacatggatcgatcgagcatgcgcagatgctcaaacccgtcgatatcccgcgtttcgccgagctggggctcacggccagcatccagccgcagcacgccatggatgaccgcgacgtcatcacccgtttctgggccaacccggccggcatcccttatccgttcagggccctccacgacgccggtaccacgctgcgcatgggctcggatgcgcccgtggccccgctggacccgtggctggccatttccgccgccgtgctcggcaccgaaagctctgaccgcgagccgttccagcccgagcagtgcctcgatgtgcatacctcgctggcagcctcgaccgccactggccgtgaccgccttgcatccggcgacccggccgatgtggtgttgctggacgccgacccatacgccgccgatactccggaagccatgcgcgctatgccgcaacacgtcgtaatgacattgctgtgcggggagcgtacgtattgatgcaagccatcggcatgaagtgaacagaggtccgtcttgatagccgcgttgcacggaaaaacaagaaatccgcccctcgaagtgaagataggacacagcagacgccgcaatacaaaaacgccgtgtcagttgcccagttggggctgacacggcgtcttgctacgagcggcgggaaaatcagtacttcatgcccatggcctcgcgcacctggtcgagggtctcctcggcgatggcgttggcgcgcttgttgccgtcgtgcaggatgtcacgaatggaatccatgtccttggccagctcggcgcggcgctcgcggtgcggggccaggaactcgttgactgattcgatgacgtatgccttgagcgcgccggcgccggaatcaccgatctcctcggcgatgtccttcgggtcgcggccggtcaccaggccggcggtggtcagcagggcggagacctgcgggcgggcaaccgggtcgaaggtgatgcggcgctcggaatcggtcgggctcttcttgatgagcttggcggtttcctcggcggtggcgcccagcatgatggagttgccgtacgacttgctcatcttgcggccgtcgagacccggaatctccggtgcctcagacagaatggcggccggctccgggaacaccgggttcttcttggcgtaacgctcgttgaaacggcgggcgatggtgcgcgtgatttccacgtgcggcaggttgtccttgccgatcggcacgacattggccttgcagaagaggatgtcgcacgcctgatgcaccgggtaggtgagcagcagaccggtcagcgcgtggccggacgcctccatctcggacttcacggtcgggttgcggtgcagctcggcctcggtgaccaaggacaggaacggcagcagtagctggttctcggccggcacggcggagtgggtgaacatcatggtcttgttcggatcgatgccggcggccatgtagtcgagcaccaggttcagcacgttgtcttggatgtgctcggtggtgtcgcggtcggtgatcacctggtagtcggcgatgatgatgttcgtgttgacgccgcgctcctgcatggcgacacgctcacggatcgagccgaagtagtggccgaggtgcagccggccggtcgggcggtcgccggtcaacatggtgaaggacgacggcttggcctccagcttggcgagcgtttcgtccgaacgctttttggccgcgaggaagctcgcgctcatctcattgcctgccgctgtcagttgctgctcgtcggtcatgcgaaaatcctttgaatatgccctaaataaacgctttttatggtaaaagtgtgagccgacaacgaacaagccactattagtggtactctctattgttgatgaatcgaacagcacagtaatcgcagggggtcagatgggccgcggacgtcaaaaagcaaaacagcagaaaattgcccgaaagctcaagtacctgaccaccgataccgactacgatgagctggcaaaagagctgagcgagcaggagccgggaatgggctctcctgacccgttcgccgacatcgatgaccagtatgcggacaaggatgtggattccgctgctgatgaccacgcttccggtgccgccgaggcagctcccgctacgcaggaggatgacctcgacgagtacgccaagtgggctgccgaagccgccgcaaaggcgaccagcggcgagttcccggcctccgcgcctgccgcaccgaagccggccccgcgcaagccgattccgatgcccatgccttccgcgctcaagcccaagaagagctgaacgccggtcttctcgtaataatccccttgtgcttggttgagcacaaggggatttgtggttatggctgatggtgccgccgctggtggcttacttacgcttcgcgcctcacagcggcagcaggtcgctcaggtcgtcgcgctcgccgaccgcgctgatgtggccggcgtccttttcctctgcccatgtggtgatgccgcaggccagccgcagccagacttccgggtccagctcgatgacgtccggcggggtcaggttatgcgggtccgattccgggccgtccaagattttgaccgcccccacggcgcgacacgcacctccacgccagggccgggtgcgcgccgctccagcagaaacagcgagtagcgcacggccatcgcccacaccgggcgtggcaagacaggggagacggtcagacgatgtggtgtgttgtccgccagctcccgggccgcggcacgccattgcaccagcgcgtcatgcccgcgtttcaggtctttttcaagaattactgccatgtatcccatcatggcaccggagccggaagatcttccataatgcaaacgatggcatacggtgtgatgcggaatatcggggcatgtgctacgctctaaatgagaacgtatgcaagaacgctccgccatcgtcgttacggagagttcatgcttacgtttgtgcgacgatacctatcgcgcggcataataaacacgggcacttatcccggaaggaaagtcagaatgaccgaaatcaccgcaccgaagtctcctgtcacggcggaacaattcgccgacgagattcgtgaacaactgaaatacactcagaacgtcaccaccgagcaggctacccctgctgacgtgtatgtcgccgcatccaaggccgtgcgcaaccaccttgccgactcctggttcaagacccaggccgacaccgtgaacggcaacaccaaggccgtcggctacctgtccgcagaattcctgatgggtaagcagctgcgcaacgcgctgctcaacgccggtctgaccgagcagttcgacaaggccgtggaagccctcggcttcaaggtccaggacgtcgtcgacgccgaatacgagccgggcctcggcaacggcggcctcggccgtctggccgcctgcttcatcgactccctcgcctcgctgggcgtgccggccttcggctacggcatccagtacaagtacggcatcttcaagcaggagttcgacaaggacggcaagcaggtcgaaaccccggactactggctggccaacgaagagccgtggggccacatcgactacaaccgcgaccagaaggtttccttcggcggcaaggtcgtcgagaacgccgacggcaccaagacctggcagcccgcatggtccgtgcgcgccgtgccggtggactacctggtccccggctacaagtccggccgcgtgaacaccctgcgcctgtggagcgccaagagctacgacgagttcgatctgctcgccttcaaccgctccgagtacatggaagccgtgaccccgcaggtcaaggccgagaacatctccaagattctctacccggaagactccaccaaggtcggcaaggaactgcgccttgagcagcagtacttcttcgtctccgcctccctgcacgacgccatccgcgtcttctacccgggccaggacaagccggatctgacgactttcccgaacaagatcgtcttccagctcaacgacacccacccggtgatcggcatccccgagctcatgcgcatcctcatcgatgagtacggctacgactgggataccgcgtggtccatcaccaccaagaccttcaactacacctgccacaccctgctgccggaggcccttgaggtctggccggccagcctgatcggcgagctgctgccgcgtcaccttgagatcatcgagaagatcaacgcgcagttcgaggacgagctcaagtccaagggcgtcgacaagaacaccatcaaggacatggccatctacactggcgacgccgtgcgcatggcctacttggccacctacggcggctcccacgtcaacggcgtggccgagctgcactcccagctcctgaaggacgtcactctcaagaacttctccgacgtctacccggacaagttcaccaacgtgaccaacggcgtgactccgcgtcgcttcgtcaagctcgccaacccgcgcctgtccgacctcatcaccgagggcctcggcaccgacaagtggctctccgacctggagatgctcaagggcctcgagccgctggccaaggacgatgaattcgtcaagaagttcgccgccgtcaagaaggccaacaaggtcgacttcgccgcctacgccaagcgcgagtacggcttcgagctcgacccgaacaccatgttcaacaccatggttaagcgcctgcacgagtacaagcgccagtccctgaagatcctgtccgtcatctccacctacgccgacatcaagtccggcaaggtcaaggccgaggacgtcaccccgcgcaccgtgttcttcggtgccaaggccgccccgggctactacctggccaagatgaccatccagctcatcaacaacgtctcccgcgtggtcaacaacgatccggacgtcaagggcaagctggccgtgtacttcccgtggaactacaatgtgcgcctcgcccagcacctgattcccgccaccgacctcgacgagcagatctcgcaggccggcaaggaggcctcgggtaccggcaacatgaagttcgccctcaacggcgcgatgaccgtcggtacgctcgatggcgcgaacgtcgagatccgtgagcgcgtcggcgccgagaacttcttcctgttcggcatgaccgtcgacgaggtcgagaagaagtacgccgagggctacaatcccgcctcctactacgaggccgacccgcgcctgaagcacgccatcgatatggtggccgacggcaccttctccaacggcgaccgcaacgcctactccccgctcgtggccgactggctgaccaaggactggttcatgaccttggccgacttctccgcctacatggacatccagtccgagatcgaggccctctacgctgatgagctcgaatggaaccgcaaggccctgctcaacgtggccaactccggctacttcagctccgaccgctccatggaagactatttggaacgtatctggcacactgctcctctggcctgacggccgccggagcggcgcgccagctacgtgctggtttctacctcgcggctgtcgccgctcggcgtcgcctacgggaagcccaccgggcttcccgcttaacggctccgcgtatctggcacactgctcctctggcctgacggccgccggagcataagaagccccgcaaccgacatccatcggttgcggggcttcttgcgttgaaagaccgccctatcaggcttcggccggggcggctttcgcctcgtcatcggcctcatcctcggccttattcagacctaggtcgaccggcgaggagctgttctcccacggctcctcccacggatcgtaatccgggttctgctgcttgtagatgtacaggccaacaagcgcggcgagcaatccgccgaacagcagcgcgaagaacttccaaccgttagaagacttgttctccatgacggctcctttccctagggatcgtctggtcggtatgcccattcagaccgactctgctccctattctaggccgctgtttgtgacgattgggtggaatgacattcgtgggcgattcatccgcgcccgtctgcccttggccggctcggcatcttcgcggcgcgtggaacgcatccgagaccttcgatacagtgggctgcatgcatattcctacacaacgggagattcgataccagtgggagcgcggtggtccggtgatgacctgggcgctgattgttgcgtgcgtggcagtgtggctactggaggtattgttgggatttattgccccgggcctgagggcttggttgatgtacctcggcatggcggctccggtcagactggtggctgagccgtggacgctcatcacctcgatgttcctgcatgcgccgaactcgctattgcatatcctgttcaacatgattgctctgtattccgtgggcccagtgctggaacgaatgatcggccactggcggttcttgggactgtatgtgatttccggccttggcggctccctgggacttatggtgtgggctgcggtggctccgggaggcatcggctggcagatggcagcctatggggcttctggagccttatttggcctgtttgcatcattgctggtggtatatcgccgtatcggcgccgatatccgctccatgttgatctggatggcggtgaacttcgccttgccgttcgtggtcggtggcgtggcgtggcaggcgcatgtcggcggctttgtagtgggtggaatactcacatggctgctggtgggtggtgtgccggcgtggcgcggtaaaagcctgaaatggcgcatgcaggtgtacggctgggccatggtggtgctggtcattgcgttgattctgttgtgcaatatggccaatccttacgggtggatgagtttcggctccctgcactgatatggcttgatatggctgtaaaaaaaaacgattgatgccgggtattgcggaacatgcagtgcccggcatcagtgtatgtgcggaaagcggcgatgtggatatcgtcgttcggcgagtgggtgtgtgccgtatgaagatatccacagtaatgagatgcgcgcaatgacgagttatccacgataatgagttatccacaatggtgacttgtgcacaagtgtgtagaaaagtgcataagactgtggataacttatgtggataagttaggaatgccgcggtattattgggtttgttgcagtggataactcgggtgtataactgttccctcgctgtggcgatgtatgccaagccaaagttatgcacgagatatacaccgagaaacgccgcttatccaccacttatccacatggttttccacattcggtggaaaactacatgggtgtaattcatccacaggctgtggataacgtagtggataagtcgtggataagtggtggatagctgtggatgaacaggctaaggcacgaaaaaggccgacctccgcatacgggaggtcggcctttctcataagaattaaggacaacctaacgatagaaaaaaacaatctaccgatagataagcgcaacgagccggaactcagcgccatcccatcgtcatcaggaatccgatcatgatcagggcgaagccgatgccgaggttccacgcaccgatgttcggaatcggccaggaaccggacggggagaggtagtacaccacgcaccaaatcaggccgatgatcataaacgcgcagaacagcggcacgaaccaacgcgggttcgacttggtgcccttaatggtttcttcaacgcgcttggtgttctccgcctggcggttcatcatacgctgcatctgcggggtcagcgtggccttatcggcagtggcgttgagcacggcctgcacctgctccatattcacgccgtaagccgcgccttcctcggcagaagcgttctctgcgttctgctcggtgtctttgctggcggtctcgtcagcaacggtgctggatgaggtctcgctctgccagtccttctggttgttcgagtcggtttcgtgcagctcttcgtcagccatcagcatagtctccattcaataggctaaaagtcataatagtggctacactcgaaagcggcgaccagagtcggcaagaagacaggaaattcatggccagacatgtaggtaagcacggtgcacggcactccctatggggtggtgtcgcggtattcgtcgtcattgccttgaccggttttctgctgagcaccaacgtgagggtcaatcgtacggttgccgccaccaacgatacggccgatctggtggagcaaggcgtggacgaggccaaccagctgcagcaggacgtcagcgatctgaccaaacaggtcgccaatcttacggacgcgctcaaggccgatggcaccgatggcaccgacagcacacagaaccaaggcaaggactccagcaatgtggattccagcctgatgctgcccgcgctcagcggcagcggcgtaacggtaacgctggatgattctccgttgtgggagaacgcagtcaacaacaacggcacgaccgccaatatcaacgattacgtgatccaccagcaggacgtcgaatcggtggtgaatgccttgtgggccggcggtgccgatgcgctgatgattatggatcagcgggtgctgttcaattcggcggtcatctgttccggcaacgtgctgtcgttgcacggtaagaaatactcgccgccgttcaccatttccgcgattggtgaccctcaaagacttcgcgcagcgttgaacgactccgaagccattaccattcttaagcaatatgtgaccgcgtttggcattggctacaaggtggagaatgccgaggaccttcagttccccgctaccgccgccttgctgcagcagttgaaatatgccacggtcgatacgtcaaagaccacagatgaggagcagactcagcaatgagacacggcaggcacaacagcggcgtaccggcgcccattgatctcgcgtccgtgtcggacgtacagcccttccccgaggacgatgccgcacgaatggcggcagacccggccaacgccagtagggcaaggtcccgtcgtgccgcagtacgcggcgcgtcttcgccccagcggagcccggtctggcaggcactcggcatctgcgccgaactgctgattaccgctgccgtgatttgcgccctgtacatcgtctggcagatgtggtggaccggtgtcgaggcggagcgagcccagaacgaaaccacccagtccgtcgactggagcgaccccagcaacaacgggggaacggtcaccatcgccaaagcccaggagggcgatgcgccggtacagccgaaagacgcgaaatatggcgacttgattgcgcagatctacattccgcgcttcggctcccaatggcaccgcaacatcgtggaaggcaccacgctcgagcagctcaatcgccacggtctgggccattacgacaccacccagatgccggggcaggtcggcaacttcgccgtcgccggccaccgcaacggctacgggcagccgttgggcgatgtggacaagttgcaggaaggcgatcccatcatcgttcgtaccaaggattactggtacgtctaccactacacccggtacgagattgtgctgcccacggacgtgcatgtgatcgcccccaatccggaagactccactgccaatcccaccaaacgcatgatcacactgaccacctgtgagccgaaatactccacccccacccatcgatggatcagctatggtgagttggcgtactgggccaaagtgtccgacggtgtgcccaaagagctggctactactgattcgtccggtgcagtgatgttctccaccaccgaaacccctcgatcgcttcccgcattggctcgctggacaaggtggtattcggcgcgctggtagtgtggctggttctgttcattgccgctgcggtggcatggcgctggccggtgctgcgcgagattcgcgcgggtgagcgtcgccgtccggatgccagcatctatggcggactgttgcgtctgcagcccggcgtggcaccgattcgatggttgctgctggctctgctgctgttcgcagccgccgcggcgctgttccagtggggattcccttgggccgccgccaatatcccattcctacagcagatgtcgaacttcgtggcagcgagctgacggcatcctagtactatggcttgcagtacacgtccctcaaggagagccctatgaccgattccgcgcatattttggtggtggataactacgattccttcgtctacacgatcgtaggctatctgcaaacccttggcgccactgttgatgtggtgcgtaacgacgctatcgacccagccgcgccgggtgtactggacggttacgatggcgtgctgatttctcccggccctggtgctccggccgaatccggtgccagtgaggatatgattcgcctgtgcgcggccagcggcgtgccgatgtttggtgtgtgcctgggcttgcaggcgctcgctgaggtgtacggctgcactgtggaccatgcgcccaccatcatgcatggcaagaccagcttggtggaacatatcgatgacgagattttcgagggcgtggccaaccccatgaccgccacccgctaccattcgttggccgtcgagcccgattcggtgccggatacgctggtggttaccgcgtggacgcaaggcgaccacattattcagggcgtgcgtgtcaagggcaagccgatgtacgccgtgcaattccatcccgaatccgtgatgacccaggacggctaccgtctgctggccaactggctcaaggtctgcggccaagacaacgccgtggccaagtccgccggcctccagcccaaagttacgaagtagcttttccgcgcggcgatactctccccggaatgtgtcgctagaacgaggcttgcgtactggttttgcgacgcttcccgggattgttgcgctgggatagctctttatacagcaaaggggaggggcgcagaagcccttcccctttgtgttgcgtgtatgtgttgcgctatttgcgttgcatatgcgcaacacatacacgcccggcgcttacttgctactcaccggttcactcaccggttccgcccccgttgccagtaccgttgccaccgtctccggtaccggtaccgccgccagtgctgccggccttcgtggtaatggtgacggtcgatcccgcatctacctggctgccagcgccaggattgatgctgactaccacagcggtgctgccggttggaccattggcctgagccttgaggcccacggccttgagcatgagttcggcggtgacgtagtcagtgccagcggtgatattcggcacagcgaccttctccttgcccgtggacacccaaatggtgatgaacccgccctgtgcgatggaagagcccgaatcagggcttacacggataatcagaccggcctccaccgtatcggagctctcctgctccacagtgaagctgaacttgccctcatactgctgtagcacgctgtccttcgactgaccgaccaaattgctcggtacggtggtcatgccggaagaaacatatatggtgatggtggtgcccttgggaaccgactgaccggcggcaggatcggttttcgtcaccatatccttggcgatgtcggcgctgtcttcggttttgacggcggcgttcaccttgaacccggcgctttccagaatgctgcgcgcctcttcctggctgcgttccttgacatccggaacctgagtggactgcgggcctgcggagaaccacaccttcacggcagatcccttggccaccttggagccggcgtccgggctcatcttggtgcaggtgccttccggctcggtggagtcggtgtcttgcttttcggtcatcttcaaacccgatgccttgagtttgagctcgatgctgtccttggatgtggaagcgttgcacacctcagggatggtgacggtgtcttccgaggacttgttgccggagccgttcatggcgaacacgatgcccacaatgacaagcactgcaacaatcgctgcgatcaccgaaccgatgatgatcttcttgcgcttcttggccttggccgccgccgcacgctgctgcgcacgggactgcaacgccgctgagttggcaccattggccggtggaatctgctcgaactgaccggtcaccgggttgaatgcttgggtgggttgctgatgcggttccaccggcgtggtgggcaaatcacgttcggcttccttgcgggccttcatattcgacaggtccgtcaacgggttgaacgcggccgccaccggcacgccgccgttcatgtaggtcaggatgtcggtcttgaattcggaggccgtggcatagcgattctggcggtccttggccatggccttggcgcagatcgaatcccacatcttcggcagccccggcaccacggcggatggcggcgtggcgacttcggaaacatgctggtaggcgatggccacggcggaatcgccggtaaacggcgggcggccggtgagcatctcgtagagcacgcagccggcggaatacaggtcggaacgcatgtcgacggtctcgccgcgcgcctgctcgggagaaaggtactgtgcggtgcccaccacgccctgcgactgggtcatggtggctgcggaatcgtccagagcgcgggcgatgccgaagtccatgaccttgaccacgccctgctcggaaatcatgatgttgccgggcttgatatcgcggtggataatgcccatgcgatgcgaatagtcgagcgcgttaagcacgcccaacatcacctgttcgcagtcgcgctggctgagtgcgccgttgaccttgatgatgtcgcgcagggtctggcccttgacgtattccatgacgatgtatggcagacgctcggcatcgccgctttcggaagaaaccagttcttctcccgaatcgtagatgttcacgatgttcgggttgttcatctgggccacggcgtgtgcttcgcggcggaaacgggccaggaagatgtcgtcgttggccagatcggcgcgcatgattttcacggccacggtacggcccagacgggtgtcaagagccacgtggacctcggccatgccgccacgaccgatgagctggccaagctggtagcgtccgccggccaatgcggtgggcatactggtgctcattgcttattccctcccaatcttgaggccggggcctccaaaacaatgcgtggcgtgctggtcactcggcgcggcagtcgattgccggacgtggccatggcggtgtcggccatttcggtctgctgatccagcagacggcgttcgatgcgtgccagcgtacgggacaccaccagcgcgtctttcgggcgatccaacgggtccttggccagcattgacatgacaaattcgcgtaactggacgtccaccgagtccggcagcggaggcacgggattgttcacgtgcgctgcggcgatatcgaccggagtggtgccggtgaacggacgatgcccggcaaggccctcgtacgccactacgcccagtgaatagatgtccgattgcggcgtggcctgctggccctgcgcctgctcgggggagatgtattgtgcggtgcccaccaccatgccgtcctgggtgatctggccttggccggtggagtagctcacgccgaaatcggtgatcttcacttcgccggtgtcggaaaccatgatgttggccggcttgacgtcacgatgaatcacgccgtgcgagtgggccacgaacaggcctcgcgcggtctgaatcaggatgggcagcagttcgatgggatccatcgcgcccttgctatggaacagatccgccaacgatttcgaggggacgtattccataatcagaaagccgatgccgtcatgctcgtagtattcgaacaacgcagcgatgttcgggtgcgccagattggcggaattatgggcttcggcacgcaggcggcgcaacttggcctcggcgttggtcacgtccgagcgcagcgccttgatggccacttcacggccgagctgaatatcgtagcctttccagacctcgcccataccgccttgcgcaagacgcgaatcaagacgatatcggcggtgaataagctgtccttcgataagtttcactgctgcaaagcctcctgcatcatcgcgcgcatgatcgggccagcggcgagcgaaccgtatacatctgtgttatgcaccaacaccgcgacggcgatttgcggatcgtccgccggcgcgaaaccgatcacccagccgtcgatggcagagttgtcggtaccgatttgtgcggtaccggttttggccgccaccttgatgccgtcgatggccagctgcggattggcctcggacaccacgctttccatcatcgtggtgagcttgtctgcggaatccttgctgaacgcattggccatggtctgcggcttggtctgcgaaagcacggtgagatcggcggcgcgcacacgatcgaccagcgtgggctgcatcagtttgccgttgttggcgattgcctgcgcgaccatcgccatctgcaacggcgtggccgtggtgtcgccttggccgatggacgccagcgcaagcttgtcgtcggtcggatcagaggggaatgtggacgcggtggccgtcatcggggtgcccgtggattcggtgccgtcaatggtgatggtgctgccgaaaccaagcttggtggccatgtccgaaaccttgctcgcgccgagtttcacgccaagctgggcgaacgcggtattggacgaccatgcgacggcctcttgcagggagatctgcccgttgacgccatcggcctgtgcctcggcgttcggcaactgtgtggcggttcccggcaaggtatagctggcgcccgcaggaatcttcgtgtccgtctgataatcgccggtttccagcgcagccgaggcgacgatggtcttgaacgtggaccctggtgggtacagctgcgaggtggcgcggttgattagagggctattttggcccgcagaaagttcgttgtaggcctgagacgcggctttggtgtcatgggtcgccagtttgttcggatcataactgggcgtgctcaccatggcgaggatacgaccggtgctgacttcgatggccaccgccgcaccatcgcgcgtaccgagctgatcgtaggcaacctgctgcagcttggggtcgatggaggtttcgatggacgcgccctgatccgtagcgccggtgagcatggccttggcccgctgccagatcaatgaatcggcctcaccgttgagcagcatgctgcgggaggcttccaggccgcgatcggcggtctggttgatggagaagaagccggtgaccggagcatacagcggaccgttggaataggtgcgcaggtatttgaacgcgtcgttgaccggctcggatttggccatgaccgtgccgtccgaggccagaatggcaccgcggtaggcgccgagctggtggtacagcgaacgggcgttgcgcggatcgttgttcagcgcgttggcccgtaccgccatgatgatggtggacgacaggccgagaatcacgaacagcgcgaccacggcggtgaaaagctgacgaagatatttgttcatacgcgagtgcctccgttaacgggaggaagcgggggaatcgtgccggtaggcgtgtacggttcatcggcttcggcatacgacggagtggtggtatccacgatggggtcgtcaaacgatttcgactcggactgcgacgccgtagccgacgcgctgcgaggctgaacgatcggctcagtggcgcgggcccgggcctcaagttccttgttgcgcagcacggccaaagcctcgtactggaacgtatccgaggtcagctccggctcgggcgcattggccgaattcgagatgatgatgagcagggtcgcgagaatatagttggcgatcagactggagccaccggccgccatatagggcagggtcagaccggtcagaggaatcaccagcgtgatgccgccgaccacggtgaacacctggaaggccatggtgaacaccagtccggaagcgagcagcttgccgaagccatccttgattttcatggcggtgataaagccggaggcaatgatgagcaggtagagcatcaaaatggccaggacgcccatcagaccgagttcctcgcccagagaggcgtagatgaaatcggagttcgcaaacgtaacgagcgaaggatggccttggccgagaccggtgccgagcatgccgcctgatgccaggccgaaaatgccggtgaccagctgccaggagccgccgggggtcttgttgtattgctcgttgctaaacgggtgcagccaggcatcgactcgctgacccacgtggctgaacatgcctgcggccagcacggcacccgcggcgaacgcgatcagaccgatgatgatccagcttttacggccggtggccgtgtacagcatggccacgaacatggcgaagaacataagcgaggtgcccagatcatgctgcatgatgagcacgcccatcgaggcgatccacaccacgatgatcgggccgagatccttgatacgcggcagctgcagaccgagcatcttcttaccgcccacggccagctggtcgcgatgatcgaacaggtaggcggcgaagaagaacgcaaggaacagcttggcgaactcgcccggctggaactggcccagtcccggaatcctgatccaaatgcgcgcgccgttcacttcctgaccgacaaacggcagcatcggggcgagcagcagcaccaagcccaccaccatcgacacgtaggagaagcgccgcagcacgcggtagtccttcaggaagatgatgagcagcgcggaaagcacgatggcgatgcacagccagatcagctgacgttgggcaaccgcccaaccttcgctctggtcgatgcgggcgatcatggtcacgccagtggcggtcagcagtagcacgcaaggcagaatcgactggctggcgtacggctggaagcgcacaatcagcccccacagcaccagaaacagcactacgaccaatgccagcatgccggcgtattgcatagggaattcgccggcggtgcgctggaacatctggatgaacgccaacgcactgattgccatggcaatcagcaacaaagaaatctgacgtagacgggtagcgatcattgagaatctcccgtggccgcgttgtcggccgctccgataccggatttatccgaggaatcggatgagcttgacgaaccggacttgtctgacgaggagccggactggctggacgaatccttggtgccgtccttggaatcgctctgggaactgtctttggaactgtccggggaattggacgcctcggccttcttggcggcgtcggcttcctgctgcttggccagtttgcgcatttcggtgcggataatacccacatgcgactgcgcttcgtccaacgaaccgactgtgatgccttggctcagctggtcacgccatgtctgaggcaggtccgcggtggcgatattggtggtctgcacttcgtgcgaaagctcaagtccaaagagattggtcggcacgccacgataaatggctacggtgccgttgctatctcccacgtagtagtgcgtctggctccacgtgtacgcgccccagccggcgccggccaatgccagcacggcaagaatgcaggtaataatcaccgcaagcttattgcggcgcttcttggtgcgcgtggccttcttctgctcgacctgctcatcgcggatggctttggccacatccgggtcgttggggtcggcggacaggcgcccatccggcttttgcaccaccggaatctcaccggtatcgggattggctcgttcaccggtctcctcgcggacggtggacggctgcaccacgcgtgtggacgacggtttggccgtggtttgcgtggtctccgcctcgtgcgcgctggcgggctgaatcaatgctgcggcgcgctgggcgggggaatcatcctcacgcagtgcgggcgcggtagccaccggctcgttgacgatgtcggcaatcggctcaagattacggctggcggcaccgccgaccaacggcgtttggtgcggcaggtcgaacgcatcggcatccaacgccaacgtggcatccgcaataacggccgtgacattatcggtgctgcccgcccgcagtgccatctgcaccagacgctgcgcgcattcgccctgatcggacagcgtggtcatcgtctcttcgatggtggaatcttccagcacaccgcacaggccgtccgagcacagtagccaacggtcggcggggtgggctcggcgaaccgaaatatccgggcgcgggtcaatgtcaaagtcgccaagcacgcgcatcacgacgttgcgctgcgggtggttcttggcttcggacggggtgatacgaccggtgttgatgaggtgctgcacgtagctgtggtcgcacgtgatgcggctcaggcgtccgtcgcgcagcaggtaggcgcgcgaatcgccgatatgggcgatgacccagtagccggccaccaatgccactgcggtaacggtggtgcccatgccggcaagcttgcgttcgcgcttggccttgccgacgatggcgtcatgcgcggccataacggaggtttccatcatgcgggagatcgtctcgacgttgccaccggtgtcatcctgctcgatgtgggccagcgaccggatggcgatggaggatgccgtatcgccgccggcgtgaccgcccatgccgtcgcacatggcgatgagatgctcgccggcgaaggaggaatcctgattgttcgcgcgcacggtgcccacatcggacaccgtggtggaatacaggaacagcggttgtgaagcggcggattttggcatgcggctacctcagttcgaaggtggtggcgccgatgcgcacaggaatacgagcgggcagaatggtggggcggttgatgcgctgctggttgaccacggtgccattggtggagttcaggtcttcaatggcccactgcccggagcgcgtgtcacggtagacacgggcatggtgggaagacacgaattcgtcatcgagcaccacggtgttcgaggcggcgcggccaagcgtgatgtcggcttcggccagcggcacggagctgccggcaagcggaccatcgatgatgaccaacagggtaggctgcgccgaggcggcggacgacgcggaagcgctgggctggcgatgcgggcgcggcgcagctgcctgcggcgtttcggccttggccttatgcacttcacgctcacggcgacgacgcgcgcgcgaaggtcgcggactgaacgtctcgatgtccttgcgcagcgaacgtacggccagccagatgaatatccacagcaggatcaggaatccatacttgagcagggcgaatgtcagttcggtcataagtggacgactttcgggcgtgtgctcgactactcctgggcttgggcggaggcccagtacaggatgcgggtacggccgatggtgatggtgttgccgtcgagcagcgtggcggcgggcacttggtggccctccacgtacgtgccgttggtcgaacccaggtcgcgggcgatcacgccgttatccgtgatgtcgatttccaggtgcttgcgggagatgcccggatcgtcgatgacgatatcgcaaccggaaccgcggccgattaccgtcttgtctttggtgagcaggtactggttgccgttcacctcgagcaccgggctatcctcggtctgcgcatcggtggtgaccggcacggcattgccctgcacggattcggaggtgaggttgaagttgcccttggacaggtcaaggtcttcctcgaagatcacgatcaccggtcccacgaaggcgtaatgctggctcttcgcgtactcggtgaggttatcggccagttcgttggccagggtctcgctaccccatgcctcgatacggtcgaagtcaggagtactgagcttgaaacggtattcattcggggccaccgtgcggtcacggcccacgggcatggcctcggcgtcaatctcgcgctccaaggcgctggaaagatcgacaggctgcaggtctttggagccaaacttggcgaatactccgttgactgcaccctccacgcttttttcaaaacggtcgagaacgctcatagtcctccctttctaatcttcacccatcctacgcggtgatgggaatatgagacaaaaaaccggtctttcacgtgacgatgagtgcaaaatatccaaaaattcagggcggaaatgggtgcggcgcaccacccgaggtgctttaccggtggagcacctcgggtgggatgcgcgtgttatcgatctgtcaggccagcgcgtcgcgcaggaaatcgcgctggagagtgagcaggttttcggccacggtctcgtcattggtcatatgggtgatgcccgtcaacggcaggaaggtgtgcgggcgacccgccgccatcagggcttgcgagaggcgcaggctgtgggcgatggtgacgttgtcgtcggcgaaaccgtggatcagcataagcgggcgctcgagtttcggtgcgtcctgcacgatgccgttgcggtagtagacatccgggtcgaggcccagatagcgctcggtgtagtgcgtgtcgtacagcgtccaatcggtgggcggggcgccggcgcatgcggccttgaacacgttcggcgcgtccagcacggccagtgcggacaggaagccgccgtacgaccagccgatcatgcacaccttgtcgaggtccggcatgggaatcgcctcccgctggcgggaggtggcgcgaagcgccggtgggtggttctcggcgtctgcctgatcgcccgcagccggctgtgccgcacgtgattccacatcggcgttgagccgggcgacggcctcgggcagggcgttgacggcctcgacctgatcggccagcgttacgtccttcatatcctcgaagatctcgcggtcccatgccgggccgcggccggtggtgccacggccgtctgccgtgaccaccaggaagccttggtcggcccaccactggccctcccagtagaaggactgcgaggcgatgacctgctggaagccgggcccgccgtacggcttcatcagcaccggcagcttctcggcgtgcgcgtacgggctttccgggctcggcgcgatgatcgccgtgtacagctggtgctcgcccagtcgcgtaaacgtgacgttcggtgtaaagccgggtttggccgccgtggacgcgatagtggcgctctgttctcccagaatatgccgcatctgggcgcgggcggaacgcatatcgcggccggagaccacgatgccgcgctcgccgcgcgaggcggtccactggccgggatcggtcgtgaccggcgtgatcgtgccgttgtaatcgatactcaccacgtcgaaactgcgggcgtcgtggtcgccgaatacggactcggtggcggccgcatcggcccaagcgtccggcacctcaggcgcgatttcgggcgcgcgctgcaccacggccagcacatcctcgtcggtcacggcgagcaccgtgcgcacgttccagccagccggcgtgaacgggcggccgtccattgtcagacggttggtgtccgtggccatatcgttgagcgagcacaccagacgaccatccggcgtgtaggcgggcgtgccgtgaaccaggtcgatccactgctcgttcgcgtgctcctcaagcacacgcgtggcacccagcgcggccccatccgccgcgactgccacctcaagcacctgatcgcgggtctgacggcggttctgcaccagcaccagcggatcgtggccgcgacgccagttcacggcggccacatactcgtacgcctcgcgatcccaatccacatcggcgttgccggtgatgcccgcgtaccggtcgttctcatcgaacgccagcgtgatcacggtcaggtacacgtcggcgttgcgggtcagcgcgcgcgggtagcggcggccggcgtccggcttctcggggtcggccggatcgctgatgtaccaggtcggctcgtcggcggtgtcgaaagactcgaacagcacatgctgcgaatccggggcccaccagaaaccgtcgtaccggtccatttcttcgccggccacgaactcggccagaccgattttccacgtgttttcggccggattgccgtcctcatcctccacgctcacgccgtagaccgcggtgatgcggtcacctagctcgccgccgatatcgaccagcatcaggtagctgcccgtggtgtacagcacatgttcgccatccggggcgatgcgcgggttcagcaccggcgtgtacatcgccgggtcctcatcgagccattcgccggccagttcacgggtgtgcggctcgggtgcgccggtctcgtcattccaatcgatgtcggtcaggaacaggcggccgttgatggtgaacacgatgcgattgccgtcgtcatctgcggagtatccgacgatgccggtgccgccttcgcgcgcacgctcgcggcgggccttctcctcggccggcacgtcctcgctgtcggcggttgcgcccagcagttcgcgcgggtcggccagcttggtctcatggtgttcgccggactcgtcgaaccagctcagccacattgcggtcaccagatcctcggggccgtcggagcgcaggaacagggcccgcgagccgtcgcccacggtctgtgcggagcgcggtgcgccgcagccgaagcgcagcgtgcgcgcccggaggcgtgggaaatgcttgattgcgtcattgacatcattggtttcgctcatacctcacaacctacgcgcctgtgcggtcagtggcgcgcaggcttgcgacgcattcccgggaatgtgtcgtggtgtgggtgcgaggtgtgggcgtgaggcttgtcctaagatgggagccatgcaggtgacgatgatcgacgaaaacaagtacgccgaaacgatgaccgacgtggtgctgcccgcgctcgaacaatgctgcgaggagggctggttcgatccgtccgccgccgaacgttcggccgggatcgagccgctgtccggcattatggacaccggcggccgctcgggccagctgcactacctgtgctacgactccgccaaattcgacgcgattcgcgagcaaggcgccaccgccaccttccgcggggccatcgtcatcagccacggcttcaccgagttcgccgaaaagtacgacgagctcgtctggtacttcctgcttgccggctactcggtgtgtgtactcgagcatcgcggccacggcaagtccgcgcgcgacgtggacaaccgctgcatggtgtggattgatgactggcagcgctacgtggccgatctggccggcttcgccgaaaccatcggccagcagtacgcggccggcatgccgctgaacctgttctgccattcgatgggcggcggcatcggcgcggccgtgttggagcgataccccaccctgttcgacaaagcggtgctctctgccccgatgatcgcccccgccaccggcatgccgctgggcgtggcccgtgtgctggtcggcgcgctgtgcggactcggcttcggcaagaagcgcgtgttcgggcagtcgggcttcacgccggaattctcgatggaaggcaacgagggcgcttccgaagcgcgtgaacgctggtacttcaagctgcgttgcgagaatagcgaataccagacctactgcgcggcgttcgaatgggtgcgccaagcgttgaagctcaaccgggccatactgaatccgtccgcctgcgccgaagtggagacgccggtgctgctcttccagtccggacgcgacatctgggtactcaataagccgcagaatcacttcgtccaactggtcaaggacggcggcggcgaggcgaacatcgtgcgcttccccgaatcgcgccacgaaatcttctccatgcccaacagcacttacaagccctacctcgaaaagatcctcggcttctacgacgaccccatgattgcctgcgccgcgtactgatgtagctcttcacccattgttcaccgtgcggtcaccttgtggcccggcccgctttagatggcgggagagccatggaattatgggcataatgtcttctctccgccgccgcgccgccgcggttgcggccgcggcatgtgccggcgtgctcgcgttgaccggttgcacggcgttcaataattccgatgacggcacagcggacggcaacggcacgtccgccaccacgcagaccttccagccgtccggcggcaaaccgactgccaccctgagcattgcctccggctccgaaaacaaggaagtcgccgtcgccatccagaaagcggccgaccaatccaacgtagccgtgacgatgcactacatgggttcgctggagattatgaacgcgctcaaggccggcggccaggatcacgacgccgtctggcctgcctcctcgatgtggatttcgatgggagacaccaagcacatcgtcaaagacgcggccagcacctccaccacgccgatcgtgttcggcatcgccaaatccaaggccgtcaaactcggctgggctgacgacaccggtgccgccaagcccgtctccaccgcggacatcctcgccgcggtcagcgacggcaaactcacgttctccatgacctccgccacggtgatcgacagcgcgctcaacgtctaccagaccgcgctcaggaagcccagctggaccatttgggtggtcgattactccggttcgatgtctggagagggcaagaacggcgtggtcaaaggcctgaacgcggcgctcgacccggaccaggccaagaagtcgtacatcgagcccgccagcggcgacgtgaacattctcatcccgtttgaaaccgaggcccaccgcccggtcaaggccactggcacaagcaccagcgacctgctgcatgaggccgatgccaccgatgccagcggcggcaccgatatctatgaaggcctgctgagcgcgctcgacgagctgcccagcgagtcggaagcctcgcaatacaccaccgccatcgtgctcatgaccgacggccgctccaactccgatcatcaggatgaattcgaaagcgcctataagtcgcgcggccgtgatctgccgatcttctccatcatgttcggcgatgccgatcccagccagctgaagtctctcgccaccctgagcaacgccaaggtattcgacggccgctccggcgacctcgccgccgtcttccgccaagtcaagggcttcaactgatgctccaggtaatctgtggattcgttgtcggactgctgctcgccgggctcggtttcggactggtcggcggcggagtgcccggcctgatcgtggccgtggtactggccgcacttgggtatatcgccgcctccacgctcaccgagccggagcgacgcatcggcaaaatgctggtttccgccttgcccaacggtcagaagaccgccgatacgatcgacgcggcgaacgctcaactcaactcgatcgccatgctcaccaagcaagtacgtgacccagccgtcaaagccgaagccaacgacttcatcgccgctaccaaagatttagtgcaatacgtgacccgagacacctccgcctacccgacgttgcgccactacatcaccgtgtacggcgagcagaccgagaaactgttgcgctcctacgtggacgtggaaagttccggcgcacgcgatcagatagccacggcacgaatcgaaaccatcgaggcgctgcaagtgctcgaacagaccgccgccggcgaactcagccgggcggtaagcgccaagacgttgggcattacggccgactccgacgccatccaacggttggcccgcatggatggatacgacgacgtcgcaccttcgcctgtgccttcctcggctgctgatgaaggacggcatgcacccagtcagactccatctggcggcccggctcaccagtcggaccagaaaacggacgcacaatgaaactctccaaatcaaaaatcatcggactgatcgccctgcttgcggtagtgggcgtggtctgcggcacgctggtgtggcggcaatcgcaaccagcaccggccgaaccgaccgaacaggtgagcatcaccggctacctgggcggcgagaaaatcggcctgttcgatgacgccaagttcaaggcgctcgccgccaagcaaggcattgccatcgactatcgcaaggccggatcgccggccatgatggatacggaccggaaaggcatgggttacctgttcccctcctcgcgcgcggccgtcgaatacggcaatgcgaaaggcgtcaaggcccccaaagcgacatcgtcttcaactcaccgattgtgctatacacgcacaaggccgtggcggacgggctcgtgaacggcggacttgtgaccaaggacgattctggcgcgtaccacatggatatggccaaagccgtggacgcgatggtcgccaacacaacctgggccgacgtcggatacacggcaggctacgggcagttccgcatcgactcgaccgatccggtgaagtcgaactcaggcaacgaatacgcggcgcttcttgccacggtgctcaacggcgggcagccggccatggtcgattcggtggcgcgcgacggcaagaccatcgcctccatcttcgccaaatccggctggatggagacctcttccgaggattcgttcaaccagttcctgaccttgggcgtgggctccaagccgatgatggtgggctacgaatcgcagctgcttgatttggccgtgaaccagccggatgcgttcaagcagatcaaggacgacgtggtcatcgtctacccgacgccgaccgtgtggagcacccacacgctgatggccttggacgagaaaaggcggcacactgctgaacctgttgaaaacaccggcggtgcagaagctggcgtgggagcgccatggcttccgcgcggccaacttcgccggcaccgattcgatcagccgattcggcgtggccggcacgctcgaccagatcccggccgtatccgaactgcccaacaacgatgccatgcaacacctcatcaccaccctccaatccgcgcaagccaaactcgtggccgacatctccatgtacgacacgatgtacacgcagaacgcccagcaataccgcgagctgaaaatgaccgtactggccggcaagaaggcgctcgccgacttcaacgccaaccagctgccagcgctggaggccgaggccgccgccagtggcgacgccatgcaggcgcaagtgctgaagaacttcaagtccaagctcgaccgttttgccaagcgactcgacgacctcgaccgcatcagcgtggttaccttgcagaccgcgccgcagatcaaaatcatccagaacgcggaccagaccatcgtggacaagatcgacaccaccatctccaccacgattccggtgtggaagagtcagatggtgatcgcgctgggcctgtccaaccagcgcaaggttctcgacctgcagaacaaggccgacgatgtgaccaacaagctgctggcgcgtaacgcggccgccctgtacaagggtgcagtggacgcggaaaaggccaaccagtgttccgtggtggaaatcgacacgctggagaagatcaacgccgaactcatcgccaccctgaaggagaccgtgcagatccagaaggaaggcgaggccaaccgcgaggccgcccaggtcaagatgcgccaaatcgagtccgacctcaaaaacgccttgctcgaaaacgcccagcagatgtgagccgttcgcgcgccagcatgctcccgttggcggagtttgcgggaacgtgcaaccatgctcccgttggcagaggtatatgagtacgcctactggtgtgcgtatatatgctcccgctggcgggagctggcagccgtaagactggctgagggtggtcacggcgctcggctcggccggctttaccggcagccattcccgccgcaatttctctgtgggcataatcccggaatgattgccgcgctcgggaattggatgaagtgaaggttaaaggttgagagcccgggagggttccggaaccggccacgataaccgctgctagccccgcgatacgggttggcggccggcagccaagccgattctctcctaatcaaggagtaccgattatggcaatgtttccggctttgatgaatgacacgatgttctcggatctgttcgatgatccgttctttgagggttggcgcaacacggacaacacgatgagtgccgtaatgcccgccaacatgatgactaccgatgtgcgcgagaccgacaagggttacgacgtcgacatcgatatgcctggctttaagaaggaagatatcaaccttgagctcaacaacggctatctgaccgtgtccgcctcgcgttgcagcgagcatgaggacaaggctccggccgctgaggacgaggcttccgacagcaagtgtgcttgcgcgtccgattcgggcaagtggctgcgtcgcgaacgctacatgggctcctgctcgcgtagcttctacgttggcgaggacgtgaaggagtccgacatccacgccagctaccggaacggcacgctgtgcatccaggttccgaagatgcaggcccagccgcaagtcgagtccaagcaccaaatcgcgattgagggctgacgatacttgattcgtcccgaagtcccgcttcgagtagctttgccccctctgacgagggggctcccgcgaagcgggtgggggagagataaatcgtaaccaaaccatgcttcccacgccgtctgccctacgctttcaacgccgactaacctgacagacggcgggaaacatagccaatgcaaatgccgggtagggatttaccctacccggcattttgctgtttcaatcaccgaaccccaccctgttcgcgcgccggtcgcgtgccgttctgccgctgtacacatccgatgggtagagtgacttcgaaacgatgcgagagaggcggacatatggcgaacggcgcacagaacgcaagcggcacaccggcaccggcggcaagccattccggcggccacgtcgtatccgcgcgcgccacgaccatcggcctgatggcaatcctgctgtggagcttcatggccggcaccgtgcgcatcgtctccgaaaacttcggcgccacgcttggctcggccctgatctacacggtcggcggcatcctgctgctgatgttccggcgcccggccccgattcgcgagttccccaagaaatacctgattatcggcggcctgttgttcgtattttacgaatcgtcgatatccctctcgctgggtctggcctctaccgacgcatcctcggtggaagtgagcctggtcaactatctgtggcccacgatgatggtgctgctgtcggcgggcgtatcccatcgcaagcacgcggtcgtcaaggtgctgccgggcgcgatcgtggccactgccggcgtggtgttggcggtcggcggtaattccgggctcgactggcatgcggccgtgcagcatatcgccgccaaccctttgccctatgcgctggcgttcgtgggcgcgctcgcttggtcggtgtacgcggtgttcacgccagccatgagtcatggggtggacggcacttcattgttcttcccctgcgtggccgtggcgttgtggattatccacttcgcgtccgggcaggggtggccggccgagccgccgagtctggtcgcatggctgtttgtgttgattgccgcggcggcgattggcggtggttatgcctgctggggctatggcattctgcacgggtctatggagcggctggctattgcgtcctatgccacgccggtgctgtccaccggggccagtgcggtgttgctgggtttagcgctgtcgctgccgttttggtgtggcgcgctgctggtggccgtcggatcggtgcttaattacttggtcagtgcgcgcaaatagcggggtggctttgctcatggggcggtaataatcccatggggcggtaaaaccctcatggggcggtatcccaaaatggctttattctgccgtttcacaatttcttcaaaccgccccatgggccttttaccgccccatggataaattaccgcccgatgggcagcagcaacttactcgccgcgacgctcggacgggcggcgaatcgggtcaagcagcgtattcggatcggagatgccgaacatgctgcgcccgccggtggattcagggtgcttggcgagaacggccagcgaaatcgcccccggaatcataatgatcaccaaaagggccgccaatccccagttcacgaagaatccgagccccagtacgatggccaccacaaccaccaccgtgacgataatcgtcaacagtgctcgacgtgggttggtttccctggcccaagaggtgctggctgcgggctttgctgttgaactggccgcggcgtttgtggctgttgtgccatcagccgtgacggtcgtgggccttgccgccgcgctcgtcgcggggccagtaggggcgtcagacacgttatcggcggcattgccggtcgctgctggacgttgttcgtttgcgtgagtcatatccaccagcatattccctgcttccggctgaagctgggacaagcctgcgcgccgctaatccagcgccgacactggccttgaactgcgggcgccagaccggatgtgaacaggcgctgaacggagtctggggaaaccatgagaactcgcgacaatttttgtgaaattgggtgacgctctatgaatcgcgcgctagtgttgcgtgagcttacaaggcgaggagcctggagcgcgggggtgaaggatgaagaactccgtttggaaaacgttcatggaattgtctctggtccgcggaatcgtgccgcggaccgtgttcggactgaccgcgatcgcggcaatcatactgattattgggctggcattgagcaagagcaagaagcgcggccgcctgcacccgctgattgtctcgctgattgccgccgtgctcgccggcgcggctggactgctggttgcatggctggtgtccgacgtgtttatggtgttcggcgtatcgctgggctggccggtgatcttcaccatcgcgggcggcatcgccggcgtcggcttcgtgatcgccgcagccgtgaccctgcgcggggtccgccgtgcgctggccgtcgtgctggtgccgctggtgctgctgtccaccgcgctcggcgtggactcgatttacggcgaataccagaccatcggcaccctcgtcggctacacgccgtacgcctcgctcggctcaatcgaggtacacaaggccgcgatgagtgtcagcgactggcatagcaaggcgcggaagggcagcctgccgtccatgcccagccaaggcaaggtgctcaccgtcgacattccgaacgccaaatccaacttcacggcccgcaaggcgatgatctacctgccgcccgccgcgctgtccgaccgtccgccggccttgccggtgatggagctgttggccgggcagcccggtagccccagtcgcctcatcgacgccggcaacatcgccgccacgatgaatgcgtacgccgccaaacatgacgggctcgcgccgatcgtgctcgtgcccgaccagaacggcgaggccacgcacaacagcctgtgcgccgacaccacgcaaggcaacgccgaaacctacctcaccacagacgtggtgaactgggccaagaagatgctgcccgtggccaagtcggcccgcatgtgggcgatgggtgggttctcgcaaggcggcacctgcaccacgcagctcgtcccgcgtcatcccgaaatctacggcgcgatgttgccggtggacggcgaactcaagccgaccaacggcagcgtcggcaagatggtccaagagtatttcgccggcgaccgcaaggcatacgacgaacaggtgccggtcaacgccatcgcctccagcggcacatctgagcaggcgctgttcaccggtgctggcgaacgggacaaggaatcgattagcaacatgcgcacgattgccgccgccgcgcgcaaagccggcatggaggtcaccgagctgatcgtgcccggcgccggccacgactggcacgcggtgcaggcggtctggcggcccggtctcgactggtttggcgaacggaccggcttgggcgagatggcgaaatcgttgaaggagtacccacaagtggaggtgttgcaatgagcgaagaatcgcgtaagcacaacagtcatgcggcggaaagctggcgcgaactggccggcgacgtgcgacagtgggcggacggtcatcgactggccatcactgccacggtggcgctggtggtgctgaacttggtggtgtggctggtggtcgcgatggccggattcgcgttcccgctgcggctcgacaccagcatggccgaattcgatttcggcaaactcttctgcacgctgttcttggcgcgcggcgtcatccagctcattcttgatgccgtgctgtggctcgtcatgctgtcaatcgccgagccgtggcttggccgcgcacgtaccgtcggcaccgcgctcgcctgcgcgctcggcggcgtgatcgtgggcctgatcttgtgtgcggcggccggatggctgttccaggactcccaattcgtctcccgcatgcagttcgccctgagcccgctggtgttgccggtcggcgcgcttatggcggccagcgcgttctgcagccatctgttgcggcggcgtattcggctgatcggctacgtggcgattctggtcgcgctgctttacagcggcaatcctggcgattactgcattctcgccgccgcgctgatcggacacgcggtcggccgcgtgatggccgggtcgcccgcgcacgccgaaaccggatggcactggctgcgcagcacctccttcgaggcgcggcgcatgttcgcggccatcgccgtggtgctggcgctggggccggtcatcgccatcacctcgcataatcacgcggggccgctcagcacagtcggcctgctcatgagtccggtctccgtcgacgacggcacgctcgcgcgctgcctggccggcgccacgcacagcggctgcttcctgcaattcgacctgatgcgcgcctcgatgcccggcgcggtactgcgctcgctgctgcccaccgccgtgactctggtgctggcgtggggcctgtatcgcggacgtcggttcgcggccacctgcgccgtggccatcaacctgttcacggcgggcgttgccatcgcctattacctggtcgtgccgctgagctttgcgccggatggcatgacctccctgctgcagcacggcgcgatcaccgcctgcgtgacgaacaccttgccgccgctgatcttcgccatcgccttggctgcggcaatgaagcacttcccgattcgcgtcggctggcgccggctgatcggcggcgtcggtgccatcgtgctggttctgctggcgtgcgccgccgtgtacctgatgtacggcattgcccagccggacgccttctcgccgcgcgccacggcctcgtcgctgttggccgaactgccggggcgcttcctgcccatcggcttcctgagccatatgaagttgtcgttcgtgccgcgtaccccgatggcctcgatcgtgtatcagggcgtcggcctggtgttctggatcgtggtgctggtcgtggtgatccgctggatgagcgacgtgagcgaatcgaacgagcgggcgcaggcacgcgccgagcggctggtcgaaaccggcggcgaatcgatgagcttcatgactacgtgggaaggcaacagctactggctctcgcccacgggcaaatcggccgtggcatatcgcgtgctcaacggcatcgccttgacctgcaccgggccgttcggcgagccctccgagtggatggacgacctgaccggcttcacccagtattgcgtggagcggtcgctttcgccggtgttctacagcgtgcatcgcgaacagcgcgacgcgttgctggaggtcggctggagctccatcgaggtcggcagcgaaatggtcgtggacccgcgcggctggaagacgaccggcaagaaatggcaggatgtgcgcaccgccatcaacaaggccaagcgcgacggcgtgaccgatgtgcagtccacgttcctggaagcgtcgctcgatgtgcgcgagcagatcgaggacatctccgaggagtgggcgcagctcaaggcgctgccggaaatgaagttcacgctcggcggtgtcgaggaactgcgcgacccgcgcgtgcggctgctttacgccatcgacgcggacgggcgcgtgctgggcgtcaccagctggctgcccacctggcgcgacgggcgcatcgtcggctggacgctggacttcatgcgccatcgcaccgacagtcccaacggcattatggagttcctgatcgcgcgcatggccgagcgcctgcgcgacgaggggcttgcggatcctgagcatgccgtggagttcatgagcctgtccgcggcacccttggccggcatgaaccccgagcgagacaatgcccgggaaggtggggtggcggccggcgaaggcacgcaggtgctccaacacgcgctgcagatcgtggccgactggatggaacccgcctacggcttccactcgctgttcaacttcaagcgcaagttccagcccgccgaagcgccggtctacgtgtgctacccggacccggcggcgttgccgcagatcgggctcgcggtggtgcgcgcctacgtgcccagcgtgacgcccgccgaagtggccggcatgctcagtacgctgcggtcgtgaaggtgtgcacacgggtacgcaggctagccgattcgagcctgagacggggtatctgctttcaggaggtacatttggcctcttgcggacagctaactgccttcaaagagatacctaaactctgaaatcccgagtatgagcgttgcaatgacggcgtttgtactcggggtttcccgtattcagtacctctttgaacggagaaagcattctgcagaagcccgaatgtacctctttgagcggcgaaagcccagcgagaagggcgcagaaggcgctatctccgtttcgaggggttgatttggcctctccgggaggtctactcctgcttcgaggggctgatggccgagtattcacgctccaaaatcggcggaatggcgttgacgcggatgggcttttacatgcggtctagctgccgaccagcccccttgaaacgggagtagacctcctgcgaaggccgaatcagcccctcgaaagcggttttgccggtgcagaggtgtcgttgactgcatcgcgagccgcctcgacgtagtaacgtggggcgcatgagcgaacgtaacgaacacaatgacggaaatacgcaaaccgcatacttcgccggcggctgcttctggggactggagcgctacttccagaacgtcgacggcgtcacggacaccacggtcggctacgcgcaatccaccgtcgaatcgccgacctacgagcaggtatgcgcgggcggcacggatgcggccgaaaccgtgaaagtcgagtttaacccggcacaggtcagcctgcggacgctgacattactgttcctggaggtcattgacccgttctccgtggaccagcagggcgaagaccgcggccggcagtaccgcactggcatgttctacacggacgagacgcagcgcgccgtgtatgtggcggccttggagcagctggtcgaccgccagccgcagcgcccggccgtactggtcgaaccgctgcgcaacttctacccggccgaggcacatcatcaggactatctggtgaacaatcccggcggctactgccatgtgccgatcgccgcaatcgcgaacgtaaaacgccgtcagaagtacgtggaacgcatctgggatctgacgcttgagcagttcgcggtcacacagaacgccgctaccgagcgcccgttcgtcaacgagtatgacgaggagtttgagcccggcatttacgtggacatcgtcagcggcgagccgctgttctcgtcgcgagacaagttcgattccggctgcggctggcccgcgttctctcgcccgattgccggtgacttgctgaccgagcatgaggaccaccgcattccgggccgcgaccgcatcgaagtgcgcacgtcggacacacagattcacttgggccacgtgttcaccgacggcccggccgaccgcggcggcctgcgctactgcatgaattccgccgccctgcgcttcgtgccgcgctcgcgcatggccgaggaaggatacggcgactggatttcggttgtggatggggatgagcaggcatgagcatggagaatattgcgggcgctcgcaagcccgccaagcgtgaggatgagcacacggtcgccggcgagcatcgcatgatgcgccgcgcgtaaccgtggcatcgccgccacgttcgtgtcgcataattgctgcccggccacgtcataattcgccgtgccgcgtgggagcgctgtggcggctacgacgagtcgatgcgcggcgacgccaccgccagtcaagccttcatggcccaccccacctacggcgacggcggaatggccgccgccgtacggttgaggagctgatggtcagccggctaaatgccgatagagctctggatcgattggccgggccaaacgcaggaccgacagggtgaccttcacactgccctgtccggttgcgtcaggcttggtggtgagctgaggattctcaaacgcagcgacgtggccaacgtagtagtacttgccatcggcctcttccgccttgcgcatgacgaatagcgggacgaaatgtgtgtggtcccaattcgggccaatgccgctaagcgcccatcggaattccggagactgcggagtgcgtccgttcttgctgaagtatttcatttcctgtgtgctcaggaattcatcctcgtattggctggccgcgtatttcacgaagatgggcatggtgttggtttccttgtcgagcaggtaaccacccacgttttgcggagtgttttccttcttccatccgcacaggcgcatgacgtcagccatggaatatttgcgctcgtacaagaacatgtggtcgaagacctgttgcctggcggcggcctcgcggaacatatctcggcaattggccataccggtgcgcaaagtgtccgcgaagaagatgcggaacgttcggttcgtggcaagtatgtcggcgaatctgctgctcaaccgatatgcggtgtcgcttcctgtgccggtgctgttcaaggtttcgaccaatggctggttgccaaaacgattgcagttcgggccggtgaaatatgaataatcgagcacgctgatcgcagagtcgaattgcgcgtctgaaccatcggccagcgggaattcagtacgaatcgcatcgagcagttcgctgcggccgattgacgagcccgcactccaatgctgaggtacgtcgtcgtcgagccgttcgctgacgaaatggcatagctgagcaagaatgaccaattcgtgcggtcgcaatccgggcagcagcagctccgctgccatcttgagtatcgcgtcttcaacgtcggtcaccggctccaactgatcctcaaatgtcgcttcatgatgtttgcctttgcccaggcttttttcacgggaacgcacgaaatcaagatagttgctgcgcttcgatgcgatggtatacggcagtgaggggtcgtagttatagatgtccgtaagcatggggatgcggcccagctcgtaacggacttggcgatactgttcggacagctttttcatgtcggaccagtcggcggtgtccaaagacttaaggatgcgctccttggcgatcgggtcgaaactgatggacgacaggccgattgactttcgctgcaggttcttgcgagccctgtcgcggtcgccagtgttgccgtataacgccaccggaatcagatagttgttgttgtaattgccgatgaaatcgataaccacaacgctttctttgtgagggaatttgcgcagtccgcgcccgagctgctgcgtgaagataatgctggattcggtgctgcgcaacatgacgatttggttgacggcgggaatatcgactccctcattgaacatatcgacagtgaagagatagtcgagttcgccttcagtgagcttgcggacgtattcgtctcgctgcgcttgggacacgggcctgccgtcatcgtccgtgctggtaacggcagcggtgcgataggggcgttcatcttgttgattccactgctggttaaacagctgggacagcttatgggcttcctcctgtcggctgcagaacacgagtccggtgaccggaatgttgaactgcccatattcctgcaacttgtcaatgatgtagcggactcgcttttcggtggcaagctgctcgatctcgtacttgagctgtttcgagtccttcgcatcaagacccttggagacatcgagacgatgggcgattccattcggatcgtcgtcggagccaaggtattccgcaacgccgtagtagtggaatggacagagcatgttctcgtccaacgccttttgcaagcgaatttcgtacgcgatgttatgcccgaatagctcgaagatgttgatgccgtcggtgcgctctggcgtggcggtcatgccgagcatgaagtcggcatctttgaaatgattgatgacgcgctgatatccttcggctccagcgtgatgaacttcgtcaaccagaacgtagtcgaattcatcggatttgaattgcgccaaaacctccggctgccgcatcgtctgtaccgtggcgaatacgtagcggcggtcctgttgcttgctggtgcctgaatacaatcccaattcggattcatcacagccgagcaccttttggtaagagttcattgcggtttgaagaatcatctgctgttgggcgatgtacagcatgcgcttcggctggcattcgcgtacgtcgaatgcggaaaggtacgtctttccggtgccggtggccgacacgataattgcgcggtgctcgccttgttcacgaagtttcttgagattcgccaacgcctcctgttgcatggcgtttggctgaatgtcatgcccctcaaacgactgcagaatctcatgacgcggtggggcgtatttcttgaaatcttcctcatactgtttgatccactcttcggtcagcggaacggaatcggccacctgtgagtcgatttcatcctggaactgcccgaccagctctccatccgccagcgatgagactttgagattccattcgcgttgcgtggtcaatgcggctccagtgagattggaactgccaacgtacaggtcgtaatagggcgtaccgtctttcatgcggcgagaaaagatatatccctttggatggaatggctgtccttgagccattgcggccactgaggcattgcgggagccttcccacacgcgaacgtcaacaccagtggtgttctgaagatgcagcagctcccagaatgccctgggatcgttgaaatgatttttcgttgaggtaatcagtgtgcccgctcgggtcgctgtttcatggtgacttctgaagtcttcaaataagctgagcacggcctcagccgagacgaatgcgacagaaatgtcgaaggaatcgctagtagccaaggaattgccgatttcctcgcgcatggtcaatccaccggggcgatttgcgatgagggtcggcttatattcgccgggagcatctgagcgcggctcgatcagacctgagatgacatcttcgaggattgagggtgtcgggccaggatcactatgttgcgtgttggccggagagcttgaggtgctggccagattgatagacatgttgtcttgttcccttgcgattcgaattgtttgttgatgactgcatgactgcatggctgcgctatggcgcattcatcggagcgtcagctgtttgctggcgataatcgcgactgcttcgcgatctaccggagcccagttcaatgtcggcatatcggcaggattcagccatcggatatcagtatgctcggtgagatgcggtgtgccggcgatgaggtgacagacgaatgtagtgagccgtacggtcccaaagtcgtaggcgtattcgctggtgcacacttcttccgcgacttcaacttcgcataacagctcttcttcgatttcgcggtgtaaagcctgccgcgctgtttcatgaggttcgattttgccgccggggaattcccagtatccggccaacgacttccccggaccgcgttgtgcacatagtacggtgccgttggtgacgattgcggctcccacgacgttaatgattttgcgttccggatccatgaacaaccaggatacaacgcttcaagatccacaagcgatccacgatcctcgacagtttcgcaagaacgatcctgattcaatcggaactactggaatcgcagtgttctagggcatttgtggaacgaaaagaaaggctgatcaatggtgaatgaacggcagaccgatacgtgtgcggacgtgatgtacaggcgtgaacggcagagaggctgtggcgaagcagggctggacttcgcccctttcattccctcacaggatgaagttgatcagcagatgagcgcattggatgacaagcttgtgtccaaggctcaggaacaatacgcgaaccgagaaatctatcctttggacgagtgctatcagttggacgggtcgacgtttatctcagccgaggcgtttgaagagattcttggcgacgagcaaacgcattatatggcttggaaaaacggctgtattgataagctgtccattgattattgggagatgccggatgtgatggcctatcttgtggagcgcagcattgcggaaggtgacggcggtgaatgctgttatacggatgctcagccgattgattatgcggaagattgtgcgtactcgcccagcgagatgttggagtgcttaggcgccaattggcaagagcagggtgttgccgatgatggtttgagttacgcgttgtacgggcacccgaatatcaatgtcgagaacgtgtccggttcgatgatggtcgtatcgacggagcagcctgggctttcggtgatggttgattatcgcagcggaatttgggtggtccagccgtttgcccatgacgagtcatttgggtctgcgattcagtttggtgagcggcttgcgcccgttgaggctggccttttgcggcccaatgtctatcagcattttttggaggcgaaacatgcgtttgattacgcaatcgcgtggattgaagatgttggggaaggcgctctcgactattgtggtagccaagagaagcgatccgtttccgaggtgagattcgggagcgatccgactctcggcagtgattcatctacgcagacaagccaaaggagcctcgccatgattctcgtcaccaccaccccgtccgtcgacggatacaccatcaccaactaccagggcatcgtcttcggcgaagtggtatccggtgtgaacatgttcaaggatcttggcgcgggcctgcgcaacatgttcggcggccgcagccagggctatgaggaggagctgatgcgcgcccgcaacgaggccatcgccgagatgcagcagcgcgcggaggcgatgggggcgcacgccgtggtcggcgtggacatcgactacgaggtgctcggcgccgacaacggcatgctgatggtcaccgcgtccggcaccgccgtgcagatcgcgcgtacggcctgagtccatcgagcacagcctgggcccggactcgtccatcgagccgggctttgtcggttatcgtgacgcattgcactgacgctcatgaccatacgaatcgaagcatacgaccggctgcccgacgcggcccgcgccatacgcgagcaggtgttcatccgcgaacgcgactggcggccggaattcgatgaatgggatgccgcgtccgcgcatctgctggcgttcgattcggtcgattcgcccgatcgccccggcccgtccgcgcaatcggcctcgcctattcagtccggccagcccgaccaacccgggcgatacatcatcgcgcgactggcggtgctgcccgaggcgcaaggcaggcacatcggctcgcggctgctggccgacgccgaacgccgcatcgcgcaagccggcggagccatggccgccgtgcactcggaaaacgaccactacaagttctacgaacagcgcggctaccggctcactgacgaggtctatgaaggcggtcgtcacggctggctggtcaaggacttgattcttggctccgagaattaagggccgctgtctgtcccgcgccgtgttcaaatcgctgcaatacagcgagttcgaagcatcctgtatgaattgctggacgactacagcgcgcagacaatcagataaatcgccacgacgtggcaggcgtacccgatgaccgtgcccaagtgaaacacctcgtggaactcgaaccagccgagaacggggttcggcttgcgcagcgcgaagcatacagcgccggcgatatacgcggcgcctccgcatgcgatgagtatggtcgcagccggacccactgcgggagccgtccatagctgcggaataagcgtcaccggcgccaatcccagcacaacatacacagtggtgaacacccagttcggggtgcgcagccagacgatatgcagtatcgtgccgatcgccgcggtcacccaaatcaccgtgagatatggccggcgaatcgccgggctgagcgcgaacagcacgggtgtgttggtgccggcgatgatgaggaagatgttcgaataatcgatgccgcacagtacgcgagtcaccttcgcgctgcgccacggcacgacgtgcagcagcgcgctgttgccgaacagcagcatggccgaggcaccgtacactgcgcaggccgctttgaccgagccggccggcgcgatgcagatgagtacgatggacgccgcgatgcacagcggcagggtggcgaggtgaagccatccgcgcagtcgcggcttgcgattgccgaatgcatccacggggacgatctggcgcttgatcgccttcagtgcggccttggcttggcggtagcgcgattgcgcggccctgtatcgggccgatgcacggtccagtgcggtggggttggcgcttgcgctggatttttgactcgcggttgcggaaggcgcaactgttgcggcggaagccatggttcgtccagatggcgtgctgatggaaacgctcatactgatcacctcgctatggccggcgacgctctcccgaccactaacctacgctaccgtaacctagtataggcccgcgcaataatcaaggttgatttcgtaatgcttacagttcttccgtggtgtggtattcggtggtgcggttgcggaatacatcgccgagtctgtgaactcgtattatgcgtgtctgctgggtccgacttgtgtcggttcctgatttcggattgctgcgaatgatgcgcccgacgccgccccgccagttgccggattcgtacggctcggccgttcggccgagctggtcgtcggtgactccagatacttcgttggtttcgtctcggttcatgatgttatgtaatgctagtttatggcggatggaaagttgaggaaagttaaatctgcttcatgggcttctctctgatctgtatttgtcccggttcatatgtcaatcgtttgacctgtcgaccggggcagaatccgctgtcccggtcggcgatttcggcttgttttcgtgaaccgggacactccggtttcctcaactcatatcgtctggcagacggaatcggcggaataaggccgattctggaattggcacgttgtcccggttttcgcataaatcgattgacatttataccggggcaacaaaaattgtcccggtttgcaaagatcgcccgaaatcgcgaaccgggacagcggattctggcctggcttgaacgtcaaacgattgatgcaggtaccgggacattttccgccacgaaagttgggccataagtctcaagtcctaagcccccctgaaaaacggcgcttgcccgaacaaagcaaaagggctggaaccttccgattccagccctttagttgctggtgcgagtggggggagttgaacccccacgagcatacactcactgccacctgaagacagcgcgtctaccattccgccacactcgcagacaatcgactaacttacacccggctgggtaatcatgcaatcttcggcgtgtcgcatgggaggcagggatatatcgcttgtgggtctcctgcgggcgccgtgatctttgagggtggcggcactcccctcagtcacttcgtgacagctcgtccgcaattaaggacgggccttgcctgcaacctgctggttcgactatcgtctcaccttcgactacaaacagcccactgggctgtttgtttaacgtctcagcctcagcgaggggagcagagagaagttcggcacaagccgcaacgaaggagaaaaactcacaaccctggccggcgctcgccgttgccgtagaagtgggccaacgcttcgtcgcggaactcatcaaagtatccgccgtcgatcgaggcgcggatgtcgtccagcagcttcacgaagaaatgctcgttgtgaatcgtggccaacgtgaagccgttgaattcgcgtgcgcgaagcaggtggtcgacgtatgcgcgcgagtagtgacggcacgtgtagcagtcgcacccttcctccagcggcccgaaatcgaacttgtgctgggcgcgcttgatgttgtaccggccggcgcgcgtgtagatcgcgccgttgcgggcgcagcgcgcgggggccacgcagtcgaaggtgtcgccgccgttctccacgcacgcgaagatatcgtccacggaggcgatgcccagcacatggcgcggccggctctccggcatcgcgtcgcagatccaggcgcaagtgtcgccgatgacgcgtttctcgatcgcgccgccgattcccacgccgtcgaagtccagagaggcgatttgcgaggccgcacgtcggcgcagatcctcgtaattcgcgccctgcaccacgccatacaaggcctgatagggcttgcccagccgctcagccgtcagccgctggtgctcgtccacgcatcggcgggcccagcggaaggtgcgctccaccgagtcctcctggtaggagcgggtgttcatcagcgtggtgagttcgtcgaacgcgaacatgatgtctgcgccgattttgtgctggatgcccatcgaaatctcagcggagaaacgatgtgcgtcaccattcaaaggcgacttgaacgtcacgccgtcctcatccacccaggccatgcgctccttgcccttggcgatgatgtcgtccgacttcatgccggtcacgtccattgccagcgtcttcttgaagccgacgcccagcgacatcacttggaaaccgccagaatcggtgaacgtgggcccatcccagttcatgaaacgcgccaagccgccggccgcgtccagcacgtcctcgcccgggcgctcgaacaggtggaaggcgttggccagcaggcactgtgcgcctagatccttcatctgctcgggcaacacggccttcatcgcggcttgcgtgcccaccggcacgaaggcaggcgtgcgaatatcgccgtggggcgtgtgaatgatgccggtgcggccgtatcgggcaccgtctcgcccaagcccgctggccgtggatggcaggcgggtgatcgtttcgaaatggaaggcgctgcggtcgccgggctgtccgggctgtgcgcccaacggatgttcaagaaggctgatcgtcatatgttcactttaggcagaagggccagaaaagggccggaaattgtgaagaactcggtttcgaggggcggatttcgccgctcccgaacgtctacttccgcttcaaggggttcccggtcaagtaggccggctgcaaaaatggcggaatggcgttaaatgagggcccttgatactcggaattgaccgcgcgaacagccccttgaagtgcaagtagatgttcccgaaacaggaaatcagcccctcgaagccgagatgcccataagactctgcgatgattacgcatagactttcaatcaacgttcagaaaacctccagattgactgcctttactactgaggtagcacacgagaagtggcaatgggcaagtgcccgaatagccgccgaacagacgtgataggaatttaggaaaaggagcagcaatggctgacgaatttaacccgcagggcgtcgaccagaccccgcggaataacgaaaaccccaatagtactgccgataccggcaacgccgagccgaagaacccgtttgtgggtggcgactcggttgatgccggcaacgccagcgattccagcgagcagcaagccccggtttcctcggccgccctcgctgccgatcagcagcctacgcaagccgctaccgacactgccgccaccgagcccatcccggactacgcctccgccaagggcgagagcacggtggtctcctcctcgccggcttctccggcagcgccggccgcagaccagacctcggccacaactccgctgtaccgcccggccccggaatacggcgcttatgggccgaccccgactcaggcacagggccagcagggcggccaggccggcaacaatgcccagcccacgcagcaattcccgttcggccagcctgcacagcaaaccccacagggccagcagggcaaccgcaacccctactacaccaataacccgcagccgcagggtaacggcaatccgttcaatccgcccacgcagccgcagcagaacaacggcaacccgtttgccagccagtccggtcagaatggccagaatggccagcagccccagcagggcggtctgttcggtttcggcgttcccggtaccggtacgccgaacggtcaaggtccgacccagccgggacagcccggtcagcccggtcagcccggccccgccaagcagggcatgtccaagacggcgagcaacatcctcatcgccgtggtcgccgccgttctggctgcggccctctgcctgggcctcggctacggtgcccccaccagcggcctgatcaccttgccgaccagcaactcgcttaccaacgtcagctcgaataagtccggctccgggtccgccaccgccaagagcggcgaagcccccgactggcagactgtcgccagcgatgtctccggctccgtggtctccatccagaccgcgttgagcaacggcaccgccaagggctccggtgccatcatcgacaccgaaggccacatcatcaccaacaaccacgtgatctccggtgcccagcagattcaggtgacgcttgccaacggcaacatgtattccgccacgctcgtcggcactgacgccaccaccgatcttgcggtcatcaagctcgacaacccgccgagcgacctcaaggccgtggaattcgccgattccgacaagctcgccgtcggcgagaacgtgatggccatcggcaacccgctcggctacgacgacaccgccaccaccggtatcgtctccgccctgaaccgcccggtgaccgtgaccgacgacaacaacaacgagatcgtcaccaacgccgtccagatcgacgcggccatcaaccccggcaactccggcggcccgaccttcaacgcggccggccaggtgatcggcatcaactcctcgatcgcctccaccgccacctcctccgactccgccggctccatcggcatcggcttcgccatcccgtccaacctcgtcaagcgtgtggccgacgaaatcatcaaggacggcaaggtcaagcacgttgccctcggcgtggtcatcaagtccgacacggttgaagccgacggcgtgacccgcggcggcgcgaccatcaccaagtccagcgccaccggcagcgcggtcgtctccggcggcccggccgacaaggccggccttaaggagggcgacaccatcgtggccttcaacggcaacgccgtgaacaacaactactcgctgcttggttacgttcgtgccgcggctttgggagacaaggtgacgctgaccatcgtgcgcgacggcaagaccatgaatgtggacgtgacgctcgatcaggaggagtcgtcggtgaacggttcgtccggctccgattccaacggcaacagccagaataaccagaacaaccagaacggcaatggccagaacggttacggtaatggcaatggcaacagcgatggcggcaccggtgacggcggcggcttctccgacccgttcggcctgtggtaaagccgactcgacaacgtcacacggtgttgagcggtaaccgctgaacaccgtgtcggacaagcaaaggcccgtgacagtgagcaaactcctgccacgggcctttcgtatgcgcgattgtgccccgcgcccatgccgccaacgcagtttcgatatccggcatgtcgcgcaacgctcgttgatagggtaggccaagcactgagttcgggcgacgtcctgaacacagcgcataattcaatacaaaactgaatacatttctttacgccgtgtatcggaaggttgcgcgggagccgagcaaagcgaagccccaggcaaagccgccggtgggttaacaaggcgtgaccgtagcgccgattgcgcgggccacgcttgccgtaccgcaatcgactccgtatacgagcgtaaggagcaatgatgagcagactcatcagattcttcaccaaaattctcgacatctgcaagcttgtgccgatgcttccggtcgtcgtcatcgccgcaattccgttggctttactgggcgattggcgtccgtggggcaatgcgatggcgattccggtactcggcaatccgggtttcggccagtggctggttatcgcactggtgctggttattgtgattgacactgtgcgcggcatgattgacgatttgcgtcatgggcaggttggagtcgatgtgctggccgtggtcgcgatcctctccaccgtggccgtcgccgaatactgggcaagttgggcggtgacgctgatgatcacgtccggcgaggccattgaggaatacgcccaagccaaggccgagcgcagtctgaccgcgcttatggaagccgcgccgcaaaccgcgcacgtcgtcaacctgcctggcgtggggcgtgggtttgctgccgataagggcgattcgtccgatggcttccggcgcgtgggctcggcatcggctgccgccgccgcgcaccgcttcgacacggtgccggtcgagcaggtgcagctgggcgacgtactcatggtgttgccgggcgaaactgtgccggttgacggcgaactgctgtccggcacggccacgctcgacctgagcaatatcaacggtgagccggtgccgcgtgaagtgttcgccggcgcccgcgtgatgtccggcgcggtgaacggctcgactgcattgaccatgcgcgccacccaggtggccgccgattcgcagtaccagcgcatcctcgagctcgtggcctccgcgcaggagtcgcgcccggccgtggtaaaaaccgccgaccgcttggctgtgccctttaccgtgctctcgctggtgattgccggcgtcgcatgggcggtgtccggggtgccgacgcgattcgcccaggtgctggtgctggccacgccctgcccgctgctcatcgccgcaccggtggcatacatcgccggaaccggacgcctcgccgcagccggcgtgcttatcaaagcgcaggacgtgctggaaaatctcggccgcgtcacgcaggtgttcttcgacaaaaccggtacgctcaccgtcaagcagccgcaggtggtgcgcgtcgagatgttgcccggcgctgcaacccgtctcaacgaagaccatgtgctgatgatggccggcgcggtggaaagctactcggtgcacatcctgtccaaaggtatcgccaaggccggcgcggaggcgctggccggactgcgccagcggttcgaggatggtcagcgcctatgccccgagccggaggccagctggcccggccatggacgggagtatccggtcgtcaagaacatcaatgaagacgccggcaaaggcgtttccggcgaggtgaacggccacgcggtgcgcgttggccggctgtctttcgcggccgccggggaggatggattcttggcggtcggcgaggctgttcccagtcggtctgaggatgacctgcgcacacgatttgggctgcttcagccggacgaaatggcgtcgtatgtgtctgttgatggtcagctgatcgcgcgcattgtgctgcgcgacgtaccgcgtgccaacgccaaggcagtgctcgccaaactgcatgagttgggcgtcaccgagctcgccatgcttaccggtgacaagcgggcttccgccaatatcattgccagcgaagtcggcattgacgaggttcacgccgaactgttcccggaggataaggtagccgcagtcaaggccgctacaggagccggcaaaaccgtcacgatgatggttggtgacggtgtgaatgatgccccggtgctcgctgttgccgatatcggcgtggccatgaccgatggcacgtccaccgccgcttccgaaagcgctcaggtggtcattatgaatgacaatatcgccgccgtgccgcgcgccatcgccattgcacgccgcaccaagcgcgtgatgcttcaagccgtaatcgcgggccttgtgcttgccgccatcggtatgatcgccgccgcgttcaacctcattccagtggtcgtcggagccttcctccaggaagccatcgacgtggtgagcatcctctgggctctcactgctctgattgatcgggattgattaagataaaccggaattgattggagccgcatccggattatgtgcaatataacaagttgatatcaatattttgtgtgtgcttaccggatgcgggcgccgtaggtggcagtctattagactaaaggctgtttgcagcatcatttaggggcattgaggcccttgccagaggagtcgatatgtcagagggtgaggaagagctcaatgtgggcgcagtccgtttggaggaagtggcatcggcggctaatgtatcgctgtccactgcgtccaaggccttgcgtggaaagcctcacgtcagcgagaaaacccgtattcgagtgattgatgctgcgcagaggttgggctatagcgctgcagaagctatggcatcgatggcaaggttaagcgtcagggattctcacggcgtgcaggattttcgcgttggcatcattggcgttgatatgaaaggcgtcttttccccgaccattcttattggagcggagaatgcgtttcaagcgcgctcagccgcagcgctgctgttcaatgcgtcaggcaatgaggcattgttccacagtggtattgaacgaatgttggtgcaaggagtgtcgggactgttgattatcagcaggcgtacggatccggtgccatactacgtggattctccggtacctgtggtctacgcctatggcccgtcccgtgatcccgatgattgttccgtggcacaagacaatgtggaatcagggtgtttggccgttcgccaccttctttcctgcgggcgcactcgtattgcgattattgctggcgactccgagtactcggttgcacatgaacggatgcggggtgcgctcaaggccttgcatgatgctggattacagttggttggcgaagcgcggttcggttcatgggaagcggaatgggggcgcgccgctgcccgtctgctgctcaatgacggtgctgcattcgacgcagtgatatgccaaaacgatgtgttggctcgtggctgcatcgaggaattggaacgtagcggatgtcgcgtgccgcaagacgtagcggttatcgggcacgacaacagtccggattatgtgtcgtacgcgcatccgttgcttacttctattgatgacaacaacgaaatgctggggcgtcaagctgccctatgtctactggatgcgattgcggggcatcctcaccatggtgtggagcgtgtgccggtgaagctaatccaacgcgagtcaacgttgccgttggattgataacgtcaccggataggcggcagcagccggtttacatcttgcgtggcatcatccagacctttgcgaatatcattgatgccggaatcccgtacaaggccgtgaacgtcgatgttgctttgttcgctcaacgcttggccgcgtacgcgcatgctatggataaatcgtccggccttgcgtgcgtagtcgggcagcttgtcggggcctaccagcactaaagtgatgacaagaatcaccatgagttccgtgcccgaaatgccgaacaacatattattctccttctgcagttattgttgcaggggcttcctgtttgccggtgcgcttggctttgcgcgccgcgcgaaatggtaacgcggcgcgcattttatgtaaaagtttgagaagtttgggttcttcgcccgccgcgcgcatgactttccatagctggatgtgctcgtatactgcgcatacggctatggctgcgaaatagattgcgatgatgggcaaggcgagtgcacataatgtgcctgggtcgccggttggcgtggccacggccgcgaagataaacgctatgaccgttgcgagacgccactgcttcaaccatgttcgtgtttcgaccgcattcatcatcgtcaatgccaccatgactgcgggtagcaggaatgagaggccgaaagcgactgtcatgcgcagaatgaaatcaaaatagacgtcggcgctgagcaatgtggcggtgtttgcgggggcaaagccggtaaggatcgccaccgcttggggcagcagataccatgccagtccggctccggtgaggaacagcggcactgaggctccgatgaatgcaaccgcggtccggcgctctttgcgcttcaaccctggattaatgaatgcccacacttggtatgaccaccacgggcaggaggccgtcagaccaaggaagaacgcaatctccagctttacgttgaatgcggagaccacgccattgaatgtgatgctcatcagtccctgttgctgcccggccgccgtcaggaacggctgttgcaggatacgaaacacctgatcgctgaacatccatcccaccatcgacatgatgatgatgccggcaatggcccgaacaaagcgtttgcgaaattcgacaagatgatcggccagaggcatcaccgcatcggggttgcgaggcttgcgcgttttggacttgcgccctacaccccgcttccaccggcgtgtagggcgttgcgcacccgcgctggcctgctgcgtggcctcgtgtgagtgatcgatgagatcgtcgaggtcaagatgtgtatcccgatcgccgggatgcatcgccggtgcaaggggtgccggaagcgcagggtttccgggaaccgtgctcatcgctgttcggctccggttgctgtagtcggggcggcggtggcgttcatcgtgacggcttggggtacggcgggagcgggagccggtgctgccgccggagctggggcaggggcgtcgctgactgtattgacggtttgttgtgttgccgggtcatcggtcttggtctcggcacggaaaatcttcatcgattggccaatgcttttggctagctcagggagcttcttcgcgccaaacagcagcacgatgataagtagaatgataatgagctcggtggggcgaagattaggcatgatagtatgtccttccaatttctgtgttgtgacaggggaagggtatacctcattaacgcaccaatttatcagtatagcgaggaatggtgtgttgttcaagttgaagtgcggtgttgcgtttgagctgcttgtgagagttgctcgggaacatgttaatttgaatgcatttactgtgttattggtgagcatatgtgtttgggttcgttggttttcgcaagaggaaaacaaaaggaaaattacgaaaatagcatggctggaaatgctgataaagactgattttcattggtattgtgcgctacgaaaaccagagaaaaaatgagtgagtcgctttctttgacgcatggtgagaatcgtctgtttgagttattgtgaacgcgcacaacgaagacaagcggcatggagggcgcgcaaaaactcgaataatcgcatatggtaactgtttgctttaccgtcatctctcccatacatacatgacgacggggacgcaccacaatgatgtgatggtaaaacgggcagtaccagacgattccgagtatgtgtgtgccatccactgacgcatcttacctgcgtcgtcgggccattgaatggattaagtgcattgaatggttgcgaatgcggcagagtgtcttcgtccgtcatgcctcgcaatgaacgcgcggcagtccaacgaaggagcaagatgagttcaacggaagcaacaaacggcatctctcgccgtgctgtgctcgcaggcgcggccgccatcggcggcaccatcgccgtggcgagtgcattgggtacaggagtgacaacggtgcaggcagcgccatccgtcgctggcacggcaggtgcaacgggcgcgaacggcgcgggcggcgtggccgttcccgcagcgcagcgcaccacgaaaagcgcgaagaccattaccgacgcgcccgctctgccgggctggaaggtagctccgttccctctgcggaacgtcgccatcacctcgaacagcgtgttcgatcgtgccaaggaagggatgctcgactatgcacgcaactatccggtagaccgctggctggtttgcttccgtgcgcaggcgaacctgctgcctaaggacaacacgacgcagccttccggtggctgggagaacttccccagcggctcgctagacaaggctgttgaacagcaatggggcgatgccgaatacacgcgtggccagaacaagaacggtgctgatggtctgttgcgcggccactttgccggacatgcattgcacatgctctcccaagcgtatgccgaaacgggggaggaagcgattctcaacaagatcaacgagttcgtctccggcctgaaggaatgccgagattccctgcgcgagatgaagtataacggcaaagcccgctacagccaccccggcttccttgccgcctatggcgagtggcagttcaaggcattggaggaatatgctccctatggcgagatttgggcaccgtggtacacggagcacaagattcttgccggtctgattgccgcttacgagtttgccggtaatgccgacgcgctcgacctggctgaaggcatcggacattggacctatgcgcgtctgagcaaatgcaccaaaacccagctgcagaagatgtgggacatctacatcggtggtgaatacggcggcatgaatgattcgctggtggatttgtacaacgtctccaaggacaaggaccgtagcgaatttcttaaggcctccgcatttttcgacactgacaagctcattgacaactgtggtgctggtgtcgatatcctcaacaacttgcacgccaaccagcacattccacagttcgtcggttacgccaaagacgcggccatgggcgacgcggatatcgatgctgatgctcgtgcgcgttatctcaaggccgttgaggggtactggggcatgattgtgcccggccgtatgtatgctcacggtggtactggcgaaggcgagatgtgggggccggcacatactgtggccggcgatatcggcaagcgcaacgcggaatcctgcgcggcatacaacatgctcaaggtggctcgctatctgttctttatcgaacaaaaacctgcctacatggactattatgagcgcacgattctcaaccatattctcggaggtaagtcccgtgacctcgattccggcacggccctcacgccgggcaactgctacatgtacccagtgaatccggctacgcagaaggaatatggtgatggcaacatcggcacttgctgtggcggcaccgctctggaaagccactcgaagtaccaggattccatctacttccactcgacggacaacaaggaactgtacgtcaatctgttcacagcttccacactcgactggaccgacaccggcctgaagctcgcacaggaaaccaactatccggaggaggagacctcgacgatttccattacggccgcgccgaagagcgccgtcaccttccgcatccgcatccccgcgtggagcaaaggtgcgaagatcgaggtgaacggcaaggctatagatggcgtcaccgctggcgaatacgccaccgtggccggcagctggaaggtcggggacaagatcgtcgtcaccatcccgctgcagctgcgcaccgagtcgactgatgaccgcaaggacatccagacgctgttctacggtcccacggtgctcaacgcgctcaacccatccaccaagttcatccaacgcggcttctacgagcgcaacggcttggatggcaccatcaaactgggcgtacagaagaaggaaggcacgaagaactacttcatcattgacggcgacgagttcgagcccgcctacaacggcgacaacaccccgtaccacatgtacttccagcgcaaggacgagtatgtgggcttcgcaggcaagctcaccgatgtgctgaacccgaagcgcccggctgcacaggaccgtagcgagagcacgctgatggatgacatctgggcgggcgcgccgttcaaggaccgtgccgccttcatcaagaaggtgcaggaggtcacgaagacctatcaagacgaggggctgctttccagtcgtgatcgtcaggtggttctgcttgcctccgctcgcgccaagatgagctgacgttttcctgcgaccaaaccgtctcccgtagtgcacgacacggcgggagatgagtgatacaaaccataacgcctaacagaaagaatattatgaccatcgaaagcactacttcggccgtgaagggcggtgtggcgaaacgattcgccgcactgttcgtagctgcggccacgctgctggctggcggtgtcttctccgtatcggccgcgccgagtgcactggcggacgacgctgaaacgaatgttgcgctcaatgcagaaaaaggcaacgacaatgcaccagacgttcaggtcagctatgtcactggctggaacagcactgctgccatcaatgacgatagcttggacggcaacgccagctatggcggttggggcacttggggcaacaccagtgccagcgaaactgccacttacacatggaatcgcgccgtgaccacgtccaagtctgtgggctactactggacgaacgtcaagaccggtgatggtggcgtgccgctgcccaaggatgtctcgattgagtatctcaatgctgattccggccagtacgagaccgtgccgaacctgaaggtggacaagacattccccgccgacgacgagctcgacgccaccaacccggtgtatggtccgtatacctacaccttcgaccaggtcaccaccaagtccatgaagcttgtggtgaacaagaaggccaatgacaacaagggtattaccgtcactgagtggcaggtgtttggtaccagcgctgcactaccagtggatccgggcgacccaggtgctttcttagacgtgcagcaagttgccgtgcgcaccacgccgggcgtggacccgacctcgaagttgcctgcagaagtgtgggcgacacctcaagatggtcccagcattaaggttccagtgacttgggaaaccgttccggccgacgcttatgctacagctggtactaccgccgaagtcaagggcactactgctgccggtacctatgacaacatcaaagttgcggccggtcaggcgacggccactattggtgtctacgaccagctcaacaccgaggtgaccgacgcggagtacgtctccaccatcaccgctcccggtgtcaagccggtattgcaggataccgtggcgctgacctacgctgacggctcggtcgagtcgggtcacaaagtgacttgggacagtatcccggccgccgagtatgctgaagccgaacaggtcggcttcgtggaaggctctatcgagggtgtcggcaatatcaaggcggaaggcacgttcttcgtcgtcgcgccttccgacccgaaagcccagccgattgttgctatcgatttcgactccgcggcccccggctccggctggtacaccactgccccgaagttcaccatcaccgcgcagcgcggcgtctccaccgtgccgataaagacgatcgagtacaagatcggcaagggcgagtggaccagtggcaagggcccgatcagcgtgaccgcgcagggttccgtgaccatttccgcccgtgccaccgatgaaaacgacaacagccgcgaggtctcccagaccatcaaggtcgacaccaacgtgccggtggtcaccgctaagcaggagagcaagaacggcaacgatgtggtcgtctctctcaccgctgatgacggtgccgcaggctccggcgtgacccgtgtgctgtactccaccggcccgtccagcaacccgaagtccaacgagaacacgatgtggggcacctacaccgacgaggacaaggtgaaggtgcagctctccgctgaccacgacacttacgtgcacttctatgcgcaggatgccgccggaaatgagtccgactacgccaacatcaatctcggcaagggcgaagccgtgaccccgaccccgactccgtctgtggattccgttgccgtctccggtgatggtgtcaaggatggcaagctggcgctggtcgctggtgatactgcccagttgtcggccgaggtgaaggtgaccggtgatgcggccaagaccgtggcctggaagtcctccgacgcgaaggtcgctactgtggacaaggatggcaaggtgaccgccgttgccgaaggtacggcgaccatcaccgccacctccacggttgacgagaacaagtccgcgtccgtcgaagtcacggtaactaagcccgaggctccggttccgcctgccaccgatgaggagcgcaagcctcttaccgacaagatcgccgctgttgagagtgagaagctcaaccagaacgactacacggctgattcgtggaaggcatatgcggatgcacttgctgccgcaaagcaggtagtcaaggatccggccgcaaccgcaccgcaggtgaccgctgcgctcaacaaactcactgccgcacacgatggtctcgccaagaaggatagcggcgaaaagcctgaaccgcagaagcccggtcagcagaagcctgggcaaaaccagaagcctgaccagcagcagaagaacgctactaccactgcccccacgggtagtgcggtggctgccgttgctgcggccgtagttgtgctcggcgcggctggcgccggtctggttatctggcgcaagcgccgtgcctgacgtgaggctattgcccctaggctaataacaacccaataattgaatacaggtcttatacctgaagttgatctgcgtcgcactggcttgaacccgaatcgatgttcgggctaagcctgtgcggcgcatttcgttgcggctgtgttgctcataatccggtatcggagttattcattaggtcggtttgacgtttattaggtcggtccttggtcggagcggcccttgaaaccccgccgttccaagggatggcttcagcaccctccgacctaatgaacgaagaaatggcctaatgaatgcaatcgaggtcgtaaagagccgttggaggtgacgtcttcagtgtcatcaagggattcgccggttgtgcagtattgttattgttctgcggcggctctttaccgtcggccttctagccaatcgagggcggaagtgacgcggattccttgtgagacataactatgttcaacccgactggttacgtactgtcgctcacacggtataccgagaacattgccaattaaagtgaggtgccgagcgaatcggtcatgataggtttgtccggatttgatttctatgagcatacggttgttaggatcggtgaaatccaacaaatccacctcgaccttgctggcatcgcggtagaagaataattgtggctcctgattggcgttcaaatgctgtttcatggtttccgcaatgatgaggttttcaaatatatcgccgaacttggggtgcgcaaccagtgcttcgaccgtccgaatgcccaagagatggcacagcaagccagtgtcataaaaatagagtttcggcgttttgaccacctgtttgcgtgcgttcgtgtagaacggtatgagatggaatgcgatgtaacttgattccagaatcgacatccatgcctttacggttcgcggacttacaccaagttcattggcgatgttggtgtagtttatgagtgctccggaactgagtgcgcaaagagtcaagaatcggcggaagtcagccaaattgcgtacatcaagatattcggaaacatcacgttcgatataagtgtcgatgtagttcgagaagaacagattgagcggcattctcgtgtcgtaaatgcgtggataaccgccttgcagcataaacgtatccggagtaagggcctgatccgccttgcatgcttcttggaatgagaacggcaataacttgaccaataggaaaacccataatctgacattagcagtgctcgtaggtttcccaaacgcacaaactatggcctaatacacagaattcccaccaccctccctctgttgcaacggaaggctttgcgttaggctagagcgcgtgactgaatctgtgaatactgaactccgcattgctgtaatcggcgctggcccggccggcgtctactcatccgatatcttcctgcgccagctcaagaagctgggcgaagaacttggcctcggcaccgaagcgcgcatcgacctgttcgagaagctgccggtgccgttcggcctggtgcgttacggtgtggccccggaccacccgtccatcaagttcatcgcctccgcgcttgagaagacgctcgacaacccgaacatccacctctactgcgacgtggaattcggcaaggacgtgactcttgacgacctgttggcccgttacgacgccgtgctgttcgccaccggcgcggtcaaggacaagccgctgaacctgcccggtgccgaccttgaaggcgtgtacggcgccgccaagttcgtcgaatggtatgacggctaccccaccggtgcccgcgaatggccgcttacggccgagaacgtcgccgtaatcggcggcggcaacgtggccatggacgtggcccgcgaactcatgcgcaacgccgacgacctcaaggtcaagaccgacattccggacaacgtgtacgagggcatcggccagaacaaggccaaggtgctccacctgttcatccgccgtggcgtggcccaggccaagttcagcgtgcaggaactgcgcgagatggagaagctgcccggcgtgcagctcatcatcaacgaggacgacttcgatctggacgacgagaccatcgaggtggccggcaaggacaagctcacccgccagatggtcgaggagctgttcgccatccgcgagatggccgaagacatggaagacgacggcgacgtcgacttcgaaggcaacccggccgaccgaaagtactacgtgcacttcaactccgcccccaccgagattctcggcgaggacggcaaggtcaaggccatccgcgtggagcgcaccgaaaccggtgccgacggcaagatgcaccgcaccggcgagttcaccgactacccggttgaggccgtctaccacgccatcggttacaagcccgccgaagcccccggcattgcctacgacgagcacggcgcccacctggccaacgccaacggcgacggccgcatcaccaccgaggccgacggcggcgaagtgcgcgaccgcctgtacgccaccggttgggccaagcgcggcccggtgggcctgatcggctccaccaagtccgatgcgctcgccatcgtgaccaacatgctcgaggatctggccaaggccgctgaaggtggccgtgtggcagccgaccgcgaccccgaatccatcgaccgactgctggccgagcgcggcattcgcccgatcgacttcgccggctggaagaaggtcgacgctttcgagcgcgccgagggtgccaaggaaggccgcgagcacaagaaggtcatcgagcccgaccagatgcgcgagctcgcccacgcctgacggcccgcccacgcccgtccggcattcgtccggcattcgtccggcattcgtccacccggccgcgccccgtgcggacgcggccgggctcggggccggacgggccgggcgaatatgggacatttctcgcggcgcatatccagcaatcattcagcctgcgattttagtgtgtgcattatggatgccaaagtacgggtgcacggccatttcaacggcctgaagacaacgctgctgtttgccctgatgtgggccatcatcatgctgatttggtgggccacgggcggcagtcggcaaaccctgagcatctatattgtcatcggcctgattaccacgttcggcacctactggttctccgacaaactcgccatcgcctccatgggtgcgcgggaagtcagcgaacaggaagccccggaaatctaccagatcgtgcgtgaactgagcgccaaggccggcaagccgatgccgcgcatctacatcgcccccaccatgagcccgaacgccttcgccaccggacgcaacgaacggcacgcggctgtctgctgcacccaaggcatcctgcagattctcaacgcccgtgaactgcgtggtgtgctgggccacgaacttatgcacgtgtacaaccacgacatcctgacttccgccatcgcctctgccatggccactgtcatctcctatctgggctattcgctgatgtatttcggtggcggctcgcgagacgaccgcgatagttccggtggcctcggcctgatcggcgcattgctgagcgtgattctcgcgccgattgccgcgtctttgatccagatggccatctcccgcacccgcgaatacgacgccgatgaagacggcagcttgctcaccggcgatcccgaggccctggcttccgcgctgaacaagatttcctacggcgcacagaccgcgccgatgcgcaaaaccgccggcacccagtccgtctccgcaatgatgatcgccaacccgttctccgcggtcggtttctcgcgcttgttctccacgcacccgccgaccgatgagcgcatagcgcgtctcatgcagatggccaacgaaatgaacggcacgccgatcgctccgcccacctactccacgcgcgtcggcaggtgacgtgctaggataactattcgtgcctcgtttggctgagcatgctcgtcacgtgaggtgcagcagccgtaaggcatgcggacatagttcatcggtagaatgaaagcttcccaagctttagaggcgggttcgactcccgttgtccgctccattgattttcaatgattttcattatttccgggaaagtgtcgcgcacgatcgcaaaactacgcgctatttgagcgctttgcccgcggaacccagctgccggcaagcctcgaccacgcgggcggacatggaatcctcagccttacggccccaagaacgcggatcgtagaacttcttctcgcccacttcgccgtcgatcttcagcaccttgtcgtagttctcgaacacgtggtcggcgattggacgggtgaaggcgtactgggtatcggtgtcgatgttcatcttgatcacgccgtagcttacagcttcggcgatttcttccgggcgtgaaccggagccgccgtggaacaccagctcaaacggcttgccgttggggaaatcgactatgccggccgcgctaggcaactcgccttcggccaccgcgcgcgccacacgcgcctgaatgtcgccgagtagcgacggacgcagcttgaccacgccgggcttgtaggcgccatgcacattgccgaatgtgaaagcggccatgtaccggccacgttcgcccaaacccagtcggcgggcgacttcgaggccatcttccggagtggaatacagcttttcattgatttcggcggagtgaccgtcttcctcaccgccgaccgcgccgatttcgatttcgagcacggtgtgcgccttctgcgacttgtcgagcagttcctcggcgatgtccagattttccttgagcggcacggtggagccatcccacatatgcgactggaatgtaggctcctggcctcgtgccacctgatcggcctcatgcgcgagcagaggacgcgcccactcatccagatactgcttggcgcagtgatcggtgtgcagagcgatggtgatgttcgggtatttcgcagccacttcatgtgtgaaagccgccagcgccagcgagccggtaacgcgatcattgaccccctgccggagacgtaggccgcgcctcccacggaaatctggatgatgccgtcggactcggcgtctgcgaagcccttcaacgcagcattcagtgtctgtgagctggttacgttgatggctggataggcgtaaccgcctcggcgggcggcctcgagcatttcggcatagcgttccggtgttgcgatcgtcatggcttcattatcgcgcgaggcatgccctctaggccccgttcttcaacctgtgcgctgtgcgattggtcacagcatcgcctcgtacgagtagaaattcgtcacccattccgggttgtcgcgcctccagcctcgccctgcgtgagacgaaacttcgcagggtagagggtgtaaggtagtctgtttccggcggaatcgtgcgaatgcggaggtgcatcatgcctggaattgttcttatcggtgctcagtggggcgacgagggtaaaggcaaggctaccgatctgatcggcaccaaggtcgattacgtcgcgcgcttcaacggcggcaacaacgcgggccatagcgtggtggtcggcgatgagtcgtacgccctgcatctgctgccctccggcatcatcaacccgaacctgaccccggtgatcggcaacggcgtggtcgtggacccggaagtgctcttcgaggagatcgacggcttggaatcccgcggcatcgattgctcccacctcaaggtgagcgaggccgcacacatcatcgcgccctaccaccgcacactcgacaaggtgactgaacgcttccttggcaagcacaagatcggcaccaccggccgtggcatcggcccggcctacgcggacaagatcaaccgtgtcggcatccgcgtgcatgacctgttcaacgccgaccatctgcacgacaaggtggaggccagcctgcaccagaagaaccagatgctggtcaagctctacaaccgtcgtccgatcgacgtggaccggaccaccgaggagctgctgaagctcggcgaacgcctcaagccgtacgtggccaacaccggcctgattctcaacaaggcgcttgacgaaggcaagaccgtactgtttgaaggcgctcaggccaccatgcttgacgtggaccacggcacctacccgttcgtcacctcttccaacccgaccgccggcggcgcctgcaccggcaccggcgtgggccccaccaagatcacccgcgtaatcggcgtctccaaggcctacgtcacccgcgtgggcgaaggcccattccccaccgaactgctggacgagtccggcgaatggctgcgtcagcagggccacgagttcggcgtgaccaccggccgcccgcgtcgctgtggttggttcgatgcggtcgtcaaccgttacgcctcccaggtcaacggcctgaccgacatcgtgctcaccaagctcgacgtgctcaccggcctgaaggagattccgatctgcgtggcttacgacgtggacggcgaacgtcacgacgatatgccgaccgatcaggccgctttcgccgccgccaagccgatttacgagaccatgcccggctgggacgaagacatctccgactgccactccttcgacgagctgcccgccacctgccaggcctacgtcaagcgtttggaagagctgagcggctgccgtatctccgcgatcggcaccggtccgcagcgcgatcatgtcatccagatcaattcgctggtcgactgaccgtctgcaacgaatttcccggcttgactggtaacgacgcggcacatgatatccgccggctgattccgcgattcgaccacttgaagtggaagatggcggcggccggcatagtcattggtctggtttcaggattgctggttgtcgtataccgtctcggcatcgaatacggcacggatgcgtcccgttggatatatgcgcggattcgcgagaccccgtggctgattgcgccgtgggcggttgccgcggtggcggccgcgctggcgatcgcgtggatggtcggcaaggagccgatggctggtggcagcggcatcccgcagaccaacggcgtggtgatatgcggcttgaagatgcgttggcagacgattctgccagtccgtttcgtcggtggactgttgggcgcgttgtttggtctgtcgctcggccgtgaggggccgtccattcagattggtgcgtcgggcgcgcagtgtgtgtcccaccgtttgcgcggccgccgccgtgaggacatgcaggagcattatctggtcaccgccggtgccgcggccggcttgtccgccgcgttcagcgcgccgctgtccggcatgatgttcgctttggaaggggtgcatcggagtttttcccctgcgattctgatgggcgccaccgccgcatcgctgaccgccgatttcgtctcaaaatactgtttcggtctgcgtccggttttggatttcggtgatatcggtcagctgtcgttggaagagtatgtgtggctgattccgttgggattggtggccggtttggttggttcgctgatgaaccgctcgttgcttggcttccagacgctgtacggcaaactgccggcatggagccgcccgatgattgcgattgcgatcgcgttgcctgtcggcatctggttgcccgatgtgctcggcggcggctcgaatctgattgataccgccgaacatgcgcgcgtcggcttgggaatgctgtgtctgctgttcgtggcgaagatgctgttcacatccacgagtttcggctcaggcgcgcctggcggtattttcatgccgattcttgcggtcggttcgttggccggcggcatctgcggtgaagtgttgcatcgattcggtgatctgccatccgacgcagtggcggtgtttgcggtgtgcgtgatgacgggcacgctcgccgcgtccgtgaaaacgccgatcacgtcgattctgttggctgtggagatgtctggaacgttgacgcacatgctgccggtcgcggccgtcgctttcgtcgcgctgttggtgtccgatttgctgcgcaccaaaccgatttatggggagttgctggagcggtacgtgcgcgcgcaaggcatgcagatggcgatcgcaagccatgtgggcagcggcattatggaactgccattggaaatgggagcgattgcggacggcaagcgggtgcgtgacgtgcgttggccgtctgggtgcctgatcatcggcctgcgtcgcggcgaaagcgagatcgtgccgcgcggcgatacacggctgcgtgccggcgactatctggtggtgctgttcagtggcgaggaggagcgcgaggtgcgacctgcgatgcggcggctgtgtgatgcccggcttgactgagcctggctgaattcggctggactctggatgtacgaatctgcggaatcggacatccagggtgcatacgttggcgctccgtgtaaactcatatgcgttaggaaggcggcaaccgcggcccagctcgttgttgcacggcctatgggcggaacaacgctgtccgcggaaggccagtacaggggagcgcaatggaatcgcaagaacaatcgccgggagacgtggtgactgcgggtgaggactcacatcccatcacgcaggcaatcgacactgttgaggtgatgcatgctggtgcaaccgcgcccgccgctaacaccatggatccgcctacgattcccctggcgccgatgaaacgtatgcaggcgcggttcaatccgctcgccgacggactgatgtatgttgtggtgttcgtcggtggatttgttggagtcggctgtcggcatgcgttggatatgctcctgccgtcggtcagcgggacgccattcgttgtgggcacgtttgtgtcgaatatggtcgcctgcttcctgttcgcgatgctgaacgaattcatggcgaccgcttcgtggctgcgtcgccgggtgcggcaggttgtcagccgtggcgttgggctcggcttgctcggcgggctttcgacgatgtccggcgtgatgctggaaacgatggaaggtctgcacgagcggcatatcgccagtgcgcttggctatcttgcgggaaattttgcaggcggtttgctcactgccgccgccggcgtggttctgatgcaggcactgctgtcacggagtactcgaaagcgggttcggggtgcgttttcagctgtttccgtgtccgattccgccgaatcggacacgcagggcgtacgccatgtgaaagtggccgacgtggcgcgttctgccgcgcaggccgcaatggaagccgcgcaggcggcgcagcaggccgcgcagacggcccagcagattgcacagacgggacaggttccgcgagtcgaaacgccaaccgtgccgccgactgccatccagcctatgcagacaggccacgttccgcagattcctccgctggtcgttcctcagctgacacagtcatcgcagccgttgttgcgcgagccggatacttcagacttggggcagctgcccgagccgattcagcagtcgcaaccaatccagcagccccagcagcagtcgcagccaatccagcagccggccaacccgcttccacccagcttcgagcccaaaccgatcactgcggagatttcgcttgtcgccgacccgactaccggggaggtgcgctgatgatgtggatgatctgtctgttcggcggtctgggagccatggcccgttacgtgctcgacgtgtcaattcaacgaggctggaaccgcgagaatcgaagaacgaaccgcaacttcccgctatccacgctcgtcatcaacggcgtcgcctcgctatgcgcgggcatcgccatgatgtcctactattcgcaatcggtggatatggacacggtcatgatgttcgttgtcggatttctcggtggtttctcaacattctccacggcgctcaacgaagtggtttcattgattcgccagcgtcgttttacgctggctctgggctatggaatagcaaccgtcgcggtgcctctcatttgcgtggccgccggtttcggcattgcgctgcttgccaatccggcgtaattttcacgttacacggacggtcgctgagtaacgtgaaagaaatctgagcgccaccgccatcaaggccgccagtccggatgcaacgctggtgattgcattcgaccagaccaagccgctgctgaaggccttcgcctccgcaggagtcgacactaagaagctgtatttcgttgccggactgtcgaacaggttcgagagaatgtaaatgaatgtaatatttcgtggtaagcacgtgagcatacaacgatagaacagtgataacggggaaggtgcgatcatggtcggcatgcgcgatgtggcgaagaaggccggggtgtctctgagcaccgtctcgctggtggtgaacggcaacgggtacgtgtctgatgacatgcgcgaacgtgtgcgcaaagccatgcaagccctcaattatgtgccgaacgagcttgcccgcaatctgtatcatgattgcacgaatctggtcggcgtcatcgtgcctaccatccgccacccgttctttgcgacgtttaccgcacatctgcagcatgcactcgccgcgcaaggattacgcactatgctgtgctctaccgcagatgaggcggatggcgaaatccagtatgtcgacatgttgcgtcggcacatgatggacggcatcgtcatgtgtgcgcacacttcgcatcccggcgattattggacgtcgattcatcgcccgatcgtcgcgttcgaccgtgtgcttggagacggtatttcgtcaatcggatccgaccacgagcagggtgggcgattgattgcgcagatgctgatccgcaatggtgccaaacatgtggtgatgattggcggtccgcgagatcaattcttcgatttggctgcgcgcggagaagtcgaggaaggaccgttcgatttgggaaagaccacgttcccgacggtgcgctactacctcacgttggaacaggaattgacctccgcaggcgtgaaatacgagtatgttgaagctggcgaagtgatggattttgccggctatcatcgtgcggtcagcaatgcgctcgacaaggtgacgaccgacggcgtcgatgccgtggtcagttccgatattggtgcatcgttctgcgtgcgcgaagcgttgggccgtggaatttccattcctgacgagctgcagatcgttgcctacgatggtacgtatttgactgatttggccggcatgaagctgaccgcggtcgcgcaggatttctcggcgatcgcacagtcggcggccgaccatatcgtgcaggcgattgccaatgaggaagtggccgcggctaacgcttcacgcaagaacatccccaagccgttcgagccgaacgtgcttattcccatgacactggtgccaggcgataccacgcgttgatactgtgcgtcttcatgcgtgtgcccggtgtggatcgcatcgatttcagcggcgtccacaaccggcgaacgcccgtcgatagtcgtgctcatcatccgacttgtgcacatgtgtccgattctgccgaatcggacgtctgagttccgaaaaatgtgttctgtgtgtccgattctggagaatcggtcatgtgtgatgtgaattgggatgtttggatgtccgtttctgcagaatcatctttgctctgtactcgttgattcgcaaatacggcgcatggctcgtcataccggccatgctcggcggcgcggccttcctggcggactcggtgctgacgccggccgtgtcgatctcgtccgccgtcgaaggcctgaagacgctgccggcgttggagcatctgttcaccgagaacaaggatctgacgatgatgatcaccgcggtgatcatcgtgatcctgttcgccgtgcagtcgcgcggcaccgaatcgatcggcaaggtcttcggctcggtggtgatggtctggttcgcgttcctggcgatcgtcggcgtggtagccatcggcaacgactggtccgtgctcgccgcactcaacccgtactacggcatcaagttcctgttcagtccgaataacgccaccggtctggcgctgatgggcaccgtgttcctttcgaccaccggcgccgaggcgctgtactcggatatgggccacgtgggccgcggcaacatctacttcacctggccgttcatcaaggtggcgctggtgctcaactacttcggccagggcgcgtggatgctgcgcaaccagaacaaccccgaactggccgacgccgaggggatcaccccgttcttccagatgatggatccgaacgtgcgctatgtggccgtcgtgctgtcggccaccgccggcatcatcgcctcccaggcgctgattacgggcgcgttcaccatggtctccgaggccaccggcctcaactggatgccgcatctgcaggtctgttaccctgcccgtacccgcggccagctgtacattccggtcgtcaacgtggtgctgtgcgtggccacgctggccgtgctgctgctgttccgcgattcggaacatatctcggcggcctacggcttggcactgaccatcacgatgatcaccaccacgatcctgctgggcatctacctgtggcaccgcagcaacaagttcggcgccgttgtgttcaccatcgtgttcctggcgatccaggtcctgttcttcgccgcctcgatggccaagttcctgcacggcggctggttcacgctgctgctcacgctggcgatcctcatgatcatgtacacgtggaacgagggcaccaagctggagcgctcgcagcgtcggcacatgatgccgaaggacttcctccccgcgctggacaagctgcacggcgatagccgcatccaccggttcgcggacaacatcgtctacctgaccagcgatccggacctgaagcgtctcgatacggacatcttcttctcgatcttcgccgaccaccccaagcgcgcccgcgcatggtgggcggtggccgtcgagaccaccgacgagccgttcacccgtgagtattcggtcgagagcttcggtaccgactacctgttccgtgtgcgcatccgcctcggcttcaaggtctcgcagtccatcccggcctacctgcatcagatcatgcacgatctggagaagaccggcgagctgccgaaccagcagtcgatctacccgaagcttgacgccgatcccggcatcggcaccatccgctacgtggtgatccacaaggcgctgatgcccgagtcgaaggtctccggccgtggcgccctctcgctgcagatcaagtacgcgatccgccgcgtggccggttccccggtcaagtggttcggcctggcgccgtacaacccgctggtcgaggtgcagccgctgttcgtgtccacgcgccgcccgccgcgcctgacccgcgtggccagccaggcgcccaagcgcgagggctgagccggcaggccgaacagccggtgcgagccgggtggcctaatggcatgtcagggggccgcgaaccgtcatcgtacggttcgcggcctttgcatatgcgaatgatgcagagtgggcggtactgcttgtgaatgtagcgggtggacgggtgacgtggttgatgccttttgccgtatgttcacggtggctatgcgtcggatgggactgtaattcgacttcttgggatcttttttgctgcagtggtgcgccaaaaggtctcagccgtctctgcgccacgccttccggcagtcagtacaaggttgtactacactggtggctgccacacggatgtccccggtcgcccgcgcctccgcggtacatcgttgtatggatacgtgtcacgtatgcagagtgcatgcagatatgtagaaaggaatcccatgccccagcaggaccatctgaccgcacgtctcgtcgtcgatgacgattttgaggtcgctccggtcaacaatcgtctgttcggttcgttcgtcgagcaccttggccgttgcgtgtacaccggcatctacgagcccgaccacccgaccgccgacgagcacggcttccgcaaggacgtcatcgacctggtcaaggaactcggcgccaccaccatccgctacccgggcggcaacttcgtgtccggctaccgctgggaggacggcatcggccccaagcaggaacgtccccgtcgactcgatctggcctggcattccagcgaaaccaacgaattcggcctgcacgagatggccgaatggcttgaggccaccggcggcaacgagctgatggaggccgtcaacctgggcacgcgcggcctgcaggaggccctggacctgctggagtacgcgaacgtgcccggcggcaccgagctgtcggaacgtcgccgcgccaacggcgccgacaagccgttcgatatccgcatgtggtgcctgggcaacgagatggacggcccgtggcagctcggccacaagtccgccgaggactacggcatgctcgccgcctccgtggccgccggcatgcgccagatcgatccggatgtggaactggtggtgtgcggctcctccgcccatggcatgccgaccttcggcaagtgggagcagaccgttcttgagaagacctacgagaacgtgaacttcgtctcctgccacgcctactaccagccgttcttcaaggaggacggcacgcgcgacatggccagcttcctggcctccggcgtggatatggacggcttcatcaaggacgtggccgccaccatcgacgccaccaaggcccatctgaagagcgcgcacgacgtgtacatctcgttcgatgaatggaatgtctggtaccagggtgaggagccgagcaagacccccgagggcatcggcaactggccggtggccccgcgtctgctggaggacatctacaccgccgccgacgccgtggtgttcggcgatctgatgatcacgctgctcaagaacgccgaccgcgtgcgcgccgccagcctggcgcagctggtcaatgtcatcgccccgatcatgacggagccgggcggcccggcctggcgccagaccacgttccacccgttctccgtgaccgcgcgcctggccaagggcggcaccgtgctggagccgaagctgtccgccggcaccgtggatacgccgcgctatggcgaggtcgacggcgtgaacgccgtggccgtgcgctgcgccgacggctcgctcgccgtgtttgcggtgaaccgttcgctcgaggcgaccgccgagttcgagatcaggctgcaggacggcgcgcagccggcatccgtcgaggcgcagacgctgcacgacgacgatctgttcgctgcgaatacgctctacgaccagaaccgtgtgaccccgcacgccaacgggtcggccatgtacgatgccgagtccggcgtggtccgcgtctccctgccgccggtgagttggaccgccctgcacatcaagtgacgcgatgggccgcgcggtccgttccggagaaggacggatcgcacggcccttgcttcccgggccgggcggaagggaccggaccggccggggaaaacgcgttatgctggaatcagacgggcgttccgcctgaaccgtgcggaacatgcccgatggtgcgacgagaggggtgctgtggcgaaacgggtgaccatcaccgacgtggcgcgcgagacgggcgtctccatcaaaacggtgtcgaatgtgctgaacaacaccggcagtatgcgcccggagacgcgccagcgtgtccaggatgccatcgaacgcctcggataccgcgttaacgtgtccgcccgcgccatgaaaaccggcggcacgaagctcatcggactggccatcaccgatttctgccagccgttcatgccctatctcgccgacagcatcgtggcggcggcacgttcccgcgggtacgcggtgatcaccgatacctacaacagcgccggcggcttggcgcaggcgatcccggagacgaagaagctggccgcggacggctggattttcttcatgggctcgccgatcacggatcgcacgatactgcaccagccgtatccgttggtgattgtgggcgattacgatacgcagggactggccgattgggtcacgatgccgaacgtggaggccgtacgcaccgcggtgggggcgctgctggattcgggatgccgtaggatcgcgttgatcggcggcaccgcggagaacgcatgcccggatgccgaccgcgagtcgcggcccgaaaccaccagcacgatgcgtacccgcggctatgtgttggcccatgaggagcgtggcctgcaggtcgattggcggctggtccgtaacgcggattgggtgcagtccggcggccgcgatgcggtggcggggctgttggacgatccggatgcgccgcgtccggatgcggtcatgtgcctgaacgacgcgctcgccatcggggtgattcatgagctgcagcggcgcggcgtgcgcgtgccgcaggatatgcaggtcattgggttcgacaacgtgccggatgccgagtactgcatgcccggattgacgacgatcgacccgcatgtggatgattacgcgcgacatgccgtggatatgctgatcgcgcgcatcgaggggtcggcggatccgttccgcacgtatgtgacctcctacgatctggtgcgtcgtgcctcgacgtgttgacggcccggcgttcgcctggacatgggtctgtgacgggctgctgtcgcctctcccgtggcgtattccgggagaggcgacatgcgggctaggatcggagcagcacctccgtcagcgcttgacggacggcgctcggcatatgcgaatcggagcaatcttccatgtccggcccgctgacgtgctcgagtgaatccatcgtggccaatgcgtcgatgccgttctccgctatggcggcataagcctgttccttggtcagatatcgcatttcggcatgccgaaggatgtcgaagacgtcttccatgcggggatcgggggccatcgtcgtgtcgccgatggtgacacgtatctcgctgcgggtggatacgtcggcgaccgttacctgcaatgtgagggtttcggcatcataccggcgatccgaatcgacggatgcgccgtcggcctgtacggatatgtcgctgtcggtaatgcctcggaacaggaaatcccatgttctccgggccggcagagcgtgaacgtctccctgggctggcgataccgtgagtgcggatgtggcgccgtccttgcgccatcgataggtgatcgcggtggtcgccggggtgatctgccgagagtaatgtcccgaatcctccatcagcgtgaagtcgccgtccgctccggggaagacgatgatctccagatgctgcgggttgtcgacggagttgatggaatccccctcggacaggggctgcatcggcacgatgccgccggccttcgcgaacacgggaattccgtcgagcggacgccagacggtcatgcgccgtccgttgggcgaagacgcgctataccggcgcccggtgaagaagtcgaaccagtcgccctgcggcagccatacgtcggccttgccccgtcgggaggatttatccatcggttccgtgatgggcgcggccagcagttcggtgccgaacatgtattcgttgggaacgtggtatgcggcgtcgatgtcgggcgatccccaatacatgggctccaccaggggaaggcctgtccgggatgcgcgccagttcatggtgtggaggtacggaatcatgcgatggcgcaggcggagcgcatcgtccatgatcgcacggagggggtgcggatgtttttttggacggtcaggcggccagtccaagacttctgcggtattgcacggggctcatccagtccagtgacttcttgatcctggtttcattgtagtgggtcaggtaggcggccaggcgttcgcggaactcctcgtagcccacgcccctccagtcccgcccgtagaataactcgttcttgagcctgccgaagaacccctcggcggccgcgttgtccgggctgcatcccttggcgctcatcgaccggatcagcccgtgctcctcgcagatgcggatccattcgtcccaccggtagtggcagccgcggtccgagtggatgattggatgttccccgtccctgagcgtggcgaccgcgtcaaggagcatccggttcgccatgtcggcgttcggggagcgcgacaaggtccaggagaccaccatcccgtcgaagcagtcgaccaccggggaaagccagcacttgtacccgtccatggtgaactgggtgacgtccgtgacccacagcatgttcggcgcgtcggcgtggaagtcccgctccacgaggttcgccggggcctcgccgatctcgccggcgtaggagctccaccgcttcggccgcttcaggtacacgggccgcatggccccctcgcgcatgatccgcctgacgaccttctccgagacgacgatcgggtcggactcgtcaaggcgcagcatgcggtggatggtccggtatccccatgcgcgcccaccctgctcgaacaggccggcgacgcgggcccgcagcacggcgtacctgtcgcccgcggcgatcgcgccgcgctcgtaatagtaggtgctgcgtttcagccccacggccttcagacaggccgccaggccgaattcacccctgatcgcgtcgacgacccgcgtcctctccctgttcgtcagcatggacgggtcgaggcgcgggtcgtcggcttttaaaacatcgatcgtctcccgcatcaccgcgttctccagccgcaggacctccacctgccggcgcagctcctccacgtcatcgccggccgcgggcatcggttcggccggcatcggcgcgtttctcctgtccatcagtcccagtatcccctcgctccggtagcggcgcatccactggtacacgctcgtcggcgtgcaacccgcgtcgcgcgccacgcgggcgaggggctcgccctcgagcgcgcgtctggccgcattcgtcttgcattccagcgtatacgaacgcctgcacgcgcccgtgatctcgtcggcctccgcgtccagcatcgcgttcaacagctgttcgaccttctccgacaccaaccggtccagcttcgtctcgagcatgttctcgtcgacctgtagaatctgattcggcatggttccgtcgccttcctaaataggttgatttggtttggcgactgaaatcgtacccggacgacggaccatgtctctcaactcaagcctcaaccaaaatgcgcaacaaaccgggcgttatcaatcggacacattggagtcggacaggctaagctgcatagaacaccgcatctaatcggttcgacacgcgcatttcactgcgcgactggacattgacgtccctttcgaggtaatatcgaaccggttcgatacatacgtgagtatgcaaatacgtaaacaacaaacaggcagatgcgcacgcaaattgcacccgcgcccatgagccaagggaggtcccatgaaaaacaaagtgcaactcatcacatacgccgatcgtctcggcgatggcactcttagctcgatgaccgacatcctgcgcacccgcttcgacggcgtgtatgacggcgtgcatatcctgccgttcttcactccgttcgatggtgcggatgcaggcttcgacccgatcgaccataccaaagtcgacgaacgtctcggcagctgggacgacgtcgccgaactctccaagacccacaacatcatggtcgacgccatcgtcaaccacatgagttgggaatccaagcagttccaagacgtgcttgaaaaaggtgaggaatccgagtattacccgatgttcctgaccatgagctccgtcttcccgaacggcgccaccgaagaagacctggccggcatctaccgcccgcgcccgggcctgccgttcacccactacaagttcgccggcaagacgcgcttggtctgggtgagcttcaccccgcagcaggtggacatcgacactgattccgccaagggttgggaatacctgatgtcgatcttcgatcagatggccgccagccacgtgcgctacatccgtctcgacgccgtgggctacggcgccaaggaagccggcaccagctgcttcatgacccccaagacctttaagctcatctcccgtctgcgcgaggagggcgtcaagcgcggccttgaaatcctcatcgaggttcacagctactacaagaagcaggtggaaatcgcctccaaggtggaccgcgtctacgatttcgccctgccgccgctgcttctgcactcgctgttcaccggtcacgtcgaacccgtggcccactggaccgagatccgcccgaacaacgccgtcaccgtgctcgatacgcacgatggcatcggcgtgatcgacatcggctccgaccagctcgaccgctccctcaagggcctcgtgcccgacgaggacgtcgacaacctggtcaacaccatccatgccaacacccacggcgaatcccaggccgccaccggtgccgccgcgtccaacctcgacctctaccaggtcaactccacgtactactcggccctcggctgcaacgaccagcactacttggccgcccgcgccgtgcagttcttcctgccgggcgtgccgcaggtctactacgtgggcgcgctcgccggccgcaacgacatggaactgctgcgccgcaccaacaacggccgcgacatcaaccgccactactactccaccgccgaaatcgatgaaaacctcgaacgcccggtggtcaaggccctgaacgccctggccaagttccgcaacgaactgcctgcattcgatggcgagttcagctacgaggtcgatggcgacacgtccatcaccttccgctggaccgccgccgacggcacgtccacggccgccctcaccttcgagcccggacgcggcctcggcacagacaacgccaccccggttgccagccttgcctggagcgatgccgccggcgaccacgaaacccgcgatctgctcgccaacccgccgattgccgatatcgactaaccgttggcccataaacgccactccgctgtgcgcgctccaagtagtgcgcccggcgtaagctgggttcatggagagcaaaccgcccgcagtgcactgaagccagtgcgcccgggcggttttgcgtatgcggggttgaaggtcatgctcctgcgggcgcggcccaagcatcccgccggaatcgacgagacgagcagcagaacagagaaagagcagcatcatgttggaaccgtatgtgcgtccgggtattgatgatcgcccggatttggacaaggtcctaagtcccgaagacaaagccgccgtggccagactggccatcaagaatcgccgccgcccgcccgaagcctctgcggaccagcctgaggcccaggctgtgcgattggcttccgccggttcttcggcagccgctgctgcagccgccagtgtggacactcccgcgccggatatgtcgtccgcctacctcgacatgcgcgatcccatggtcgccgtcaatggccaacgccctaccgcaggtcaggtctcccgactcaactggggtttcttcgctgcttcaattctggtcggcgcaccttgggtggcgttgaacaccattgccatgcccaacgcgattgcgcgtacgttcggctatgacactgctgttgccggtcatatcgccatcaatccggccactggccgcccgttgcccgtcgccaccgaattggcgatgcccctggccgtgttggtgattgtcggcgtagtggcctccatgtttgcgatgccgctgatttcagtgttgtccgaccgcacacgcacgccattgggccgtcgtaccccgtggatggttggcggaggtctgctgtgcgcgctgatcacgctgattctggggcagaatatcggcatcattgtgctttgtattttctgggtgttcctacagttcgcctatgcgatgctttccgtgccgttgaccagcgccatcagcgaacgggtgcccgacaagttccgccctcgcatcgaacgctggcatggcatcggtgtgatgctcggccaagcgcttggcgtgtgcatgggtgcgcttggtgtgatgttcaattcgtttgcgccgtttagttacaccgccgtgctatttgcagtgtccggtattgccaccgtattgattctgcccaaggagccttctagcgctgagcagccgaaccagctttttgaccgcagtcaggtacttgaccaattgcgcccgccggcccacgctcccgagttctcccgggtgttcgccgcccgtacgtgcatgatggccggtgttgggctgaccggtgtgtttctgtggtatctcgtacgtttctgggtttatggcaaggccgtggtacttacgtccgcgccgctgaccattccggccggattcctcattgccggtatggctgtggccacattgatcggtgccgcgctcgcctcctgggccgccgggccgatttccgagcgaatcgaggaaaagaacattcccgtggcccgtgtggtggccggtgcctgcctgctgtatgcgattggtctggggctcgcatggggccttggcgtctggtccaccggcactgcccgtgaaaacggcatgctgctgtttgcgttgatctccggattcgccttcggcatttacgattcgctcggacttgaactggtgatggactctttgcccgacccgcgccgagccggccacgacctcggcatttatgcgctcgccaactcggccggtctggcgctcgccgccatcatcggcgcgctactggtgaacgccttcgagcatagcttcggctattacctgctcttcccgtccgccatcgtcatggtgctgctggccggaatcgtcaccctcaccaccaaatctgccgaataataaaccggttcgagtacactggtcagcagtgatccagtccagtactcgcaggggagcaaaaccatggtcggcatgcgcgacgtagccaaagcggcaggggtgtccttaagcaccgtttcgttggtggtcaacaacaccggctacgtctcggccgatatgcgtgccaaagtcgagtccgcgatgcgccagctcaactacattcccaacgagctggcccgcaacctctaccgaaaccgcaccaacaccatcggcgtgatcatgccgaccatcgcccacccgttcttctccacactcaccgcgcatctgcagcgcgagttcgccgcgcgcgacctcaaaaccctgctctgctccaccgccgatacagacaagggcgagagcgagtacatcgacatgctccagcggcacatgatggacggcatcatcatggcggcccacaccgagcatccggccgactactggacctccatccatcggccaattgtcgctttcgaccgcacgctcggtgagggtgtgccggtcgtccggtctgatcatgaacagggaggccgtctgattgcgcgccagctcatcgattccggcgcgcgccacgtggtgctcgttggtggcccgcgttcccagttcgcggaaggcaccactttccccacgattcgctaccatctcaccgtcgagcgtctgctggctgaggccggcattgcctgcgattatgtcgaagccggcaccgtggccgacatcgccgcccacgaagccaccgcatgcgccattttcgaacagtatcctgatgtcgacgccatcgtcggctccgatgtggtggcatccgtggcattgcaggaagcctcacgacggggtatcgaggtgcctgctgatctgcaagtcatcgcctatgacggcactctcatggccgaaaccgccggcaaacgcctgaccgcgattcgacaggacttcccggccatcgccgccgcgctcgccgtccgcatggactcacagatcgccgccgacggtggccccgcctctccgtccaagaacgatagcgcttcgaacgttgacacccaacccactcccgaagaagtcatccccgtagccctcatccccggcgaaaccacccggtgactcctatcttggctcccctctctgaggctgagctgtgaagcaaacagtccagtggactgtttgtaggcgaaggcgagccgggaggcgagcaggcagactgcgggcggtagcccgtctgtaattgcggccgagctggcggcgtaggcgactgaggggagccgagtcacggccgcccacagtcacccatctcacatgactcctacgtcacaatgtccacaatgtgaacccttgctggattggcaagacatacaaacctatgtttacattccagttcaggtcgaacggcctgaggaaataccgaaaggaggccacgcgatgactggattcaatgcttctgcgtttgtatccgcacgaattattagcccgtcttcgctggcggactaattcggcactgatgcttgaagccccgtcaacgaaggcagggccaatcaagctgacacaatcggcacggccctgcatgatgcggggctttttttgttgcgctcacaaggcttacggcagaatcccgcagacggaaacggtagcggacagtacacggcaacaacacagcgacagaacaacaacctccctgtggggcgaaataatcgcccgccgatgagagtgaacgagagcaaaacaggagtaacaatgactgcagcagtcgaagagactggcttagggcaggcggcaggtaaagccgctaccttggtacgcgattcggtcaagaccgtgatcgccgcgtcgatggtcggtaccgccatcgaattctatgacttctacgcctacggcaccgccgcggcaaactacttcccgcacatcttcttctccgcgaaggacaaccccaccgtcgcactgctgatgagcttgctgaccttcgccgtcgccttcatcgcccgcccgctgggctcgctgatcttcggccacttcggcgatcgcatgggccgcaagaccacgctggtcgtcagcctgatgaccatgggtgtcggcaccttcctgattggctgcctgcccacctacgatcaggtcggcgttggtgcagtcgccatcctctgcctgctgcgtttcatccagggcatcggcctgggcggcgaatggtccggcgcggcactggtcgccaccgagaacgcgcctgaagacaagcgcgcactgtacggctccttcccggagctcggcgccccgatcggcttcttcctgtccaacggcacctacttcgtgctcgaatccttcaacaatcaggacgcgatgctggcttggggctggcgtgtgccgttcctgctgtccgccatcctggtgatcgtcggtctcgtggtccgcgttcacatggaggagaccccgatcttccgtatggctcaggagcagaagaaggttgtcaagtccccgctgaccgaggtcttccgcaagtcttggcgtcaggtgctgcaggccaccttcctcgtggctgtgacctacacgctgttctacacgctcgccacttggtccctcgcttggggcaccaaggagcagggcgaaggcggcggcaaccttggcttcaccaaccaggaatacctgctcatgctcatgatctccatctgcgtgttcgccctgttcatcgtgctgtcctgcctgtacgcggacaagatcggccgccgtcgcgtgctgaccttctcctcctgcgcgctcgtcgtgttcgccgtgctcttcccgttcctgctggacggtggtctggtcggccagaagaacttcttcgccaacatggtgttcctgtgcgtcggctttgccctgatgggcatcgccttcggcccgatcggcgccttcctgcctgagctgttcgacgccaacgtgcgttactccggctccggcatcggctacaacctggccgccatcgtcggcgcggctttcgtgccgaccatcgccacttggctgagctcccactggggcgtccactccgtgggcctctacctcgccgtgatggccgtgtgctgcctcgtctccgtgctcacttgcaaggagactaaggacgttgactttaccaagtgacgatgttcacaacgtgaaaaatctcaattccacgaagtgaacccctgcgaggcttttccggtgcaacaggactaaacctgcatatcggaaaagcccacaaggaaagccacaacagaatatcgctcagcgaaaccccgcagagcacaagaaaatttcaacccccataaacaaataaataaaaggagcgccaaaaatggcagcaactatctggtacgagaaggacgccgatctgtccgtgttcgatggcaagaaggtcgccatcttgggctacggctctcagggtcacgctcacgcactgaacctgcgtgactccggtgtcgacgtggtcgtcggcctgcgtccgacctccaagtctgtcgagttcgccaaggagcagggtcttgaggtcaagccggttggcgaggccgtcgccgaggctgacgttgtgatgatccttctgcctgaccagtaccaggccaaggtctacaaggaagaagttgagccgaacctgaagccgggcgctgccctggcgttcgcccacggcttcaacatccactacggctacatcaagccgtccgaggatcacccggtcttcatggtcgccccgaagggcccgggccacatcgttcgtcgtgagtacgccgctggccgtggcgtcccggtcgtcgttgccgtcgagcaggacccggacggcaagacctggccgctgtgcctggcttacgccaaggctctgggcgctctgcgtgcaggcgccatcaagaccaccttcactgaggagaccgagaccgatctgttcggtgagcaggacgtcctcatgggtggcatcaaccacctgtgcgacctcggtttcgacgtgctgaccgaggctggctaccagccggagatcgcctacttcgaggtcttccacgagctgaagatgctcgtcgacctggctaacgagggtggcctgaacaaggctcgctggtcctgctccgacaccgctcagtacggcgactacacctccaccgtcatcaccgacgagaccaagaagcgcatgcagtaccagctcaagcgcattcaggacggctccttcgccaaggagttcatggacgaccaggccgctggcgccccgaagttcaagaagctgcaggaagagtactctcacccgcacctcgagaccgtcggcccgaagctgcgcgccatgttctcctggaacaacgccgaggccaaggacaaggacgaggccgagtccttcaacggcaagatcgctcgtacccaggttcagtgattgccgcccctgaaggggatttaagctagcaaaccgccgttcccgcccatacgggagcggcggttttgtgttgttgcgcgcagcgaatcattctcaataacaactatgcgctgatttcttgcaggcaaacgaacaccgaatatgcaagatcgttgatatctcagcctttccccatatgtgggattgtgcgattctgttcaaaagggtgcagagttgttatcgagaatcgttctctgcacacggctgtccatactccaatagtgacctagctcacgttgtggactccagcggggctgcgacggcgttctcggtaggattgaactcggtttgaaggacacaatcctcgcaaaacaggacttatctgcacaccgtagatacccccggcgcccagcggcgccacaacccactactgaaaaggagtgccaataatggcagcacaaatctggtatgagaacgacggcgatctttccgtcctcgaaggcaagaaggtcgcaatcatcggctacggttcccagggccacgcccacgcgctgaaccttcgcgattccggtgtcgacgtggtcgtcggcctgcgtccgacctccaagtcggtcgacttcgccaaggagcagggcctcgaggtcaagtccgtggccgaggcttccgccgaggccgacgtgatcatgattctggcccccgaccagtaccagcgcaccatctgggccaacgacatcgagcccaacatcaagccgggtgccgctgttgcgttcgctcatggcttcaacattcactacggctacatcaagccgtctgaggatcacccggtgttcatggttgccccgaagggcccgggccacatcgttcgtcgtgagtacgccgctggccgtggcgtgccggtcgtcgtggccgtcgagcaggatccgcgtggcgacggctgggctctgaccctggcctacgccaaggccctcggtgccctgcgcgccggtgccatcaagaccaccttcaaggaagagaccgagaccgatctcttcggcgagcagaacgtgctcatgggtggcgtgaacaagctcgtcgagatgggcttcgaagtcctgaccgacgccggctaccagccggaaatcgcctacttcgaggtctgccacgagctcaagatgctcgtcgacctgatgaacgagggcggtctgaacaaggctcgttggtcctgctccgacaccgcccagtacggcgactacgtcaacaccgtcatcaacgaggactgccgcaagcgcatggaataccacctgcagcgcatccaggacggctccttcgccaaggagttcatcgacgaccaggatgccggcgccccgcacttcaaggaactgcaggagaagtactccaacgagcgcatcgagaccgtcggcccgaagctgcgcgccatgttctcctggaacaaggatggcgtcaaggatgccgacgaggccaactccttcaccggcaagatcgcccgcgcccaggttcagtgattcttccttggctcccctcgggtgaggtgcgcacgaacagcgagccggcaatcgcagccttcaggctgtccgtgttgcagtacgctggcgcgtaagcgcctgagggtggtccccagtgcataccaaaaggccgccgctccgattcattcggaacggcggcctttcgcttattccaagggatctacttgataacccacgcagaagtgtcggtggggagctggccttcgggggtcagcgggccggacgccagcaccacggagccatcgggcagcgcgaccggggcattgccgaagttggtgattgaggtgaacacccgcccgccaaccgccgcgcgggtgtacgccaccacatcgtcgcccatgtccacctgctcggccgtggtgtcgcgcgtggcggtcagcgactcctggcgaatcgccagtgcggcgcgatacagcgcgagcatcgagtccgggtcggcttgctccacgtccaccgcgtaatccttgaaccacagcggttgcggcaggtgcgggtcggcggccggcgtcacgccctcagcgcgcgtagccggcgagaagccgaaggaagcgcccgtgccgaactggccggctgcgcacagcggcacatggttttcgccggtaccgtcatcggccggagccggacggctgaaatcggccaaggccggctcatcggcggcggtccacggcagcggcacgcggcagccgtcgcggcccttgtccatcgtgttgcgggtggtgtggaaggcggtcggatcctccaagtgatcccacggaatatcggccacctcaaacaggcccagttcctcgccctgatagatgtatgcggcaccgggcaggccgagctccatcagcgcggcggcacgggcacggcgggtgccgagctcgcggtcttcgggatatgtggtgccgttgcgcagcagccagtcgtgcggcagctggtggtagggcgcgcccttgacctgcggcagaccgtagcgggaggggctgcgcggcacgtcgtgattgttcatgacccacgtggtggtggagccgccggtttcggccgccgccttaagacccgcggcgatggccttgcggaactcgtcggcataccagttggcttgcgcgaagtcgaagttgaaggactggcccagctcgtccatcgaagcgtacaggtgctggtgctcgggcaccacccacgcctcggccacggcaaagcgcggcgggtcgtactcgttgaacaccttgcgccattcgcggtagatatcgtgcacctcgcgacggtcgaacagcgggtggctgaagtcatgattcagcacgccgaccacgctgtattcgcggccgagctcttccaacggcttggattcgaggtccttggccaggccgttcgccacgtcgatgcggaagccgtcggtgccgtggtcggaccagaaacgcagggtcttcttgaactcctcgtggatgtccggattcttccagttgacgtccggctgcgccttatcgaacaggtgcagataccactggccgtcggccacgcgcgcccaggccgggccgccgaagaaggattgccagtcgttcgggggcagttcgccatgctcgccgcggccgtcgcggaagatgtagcggtcgcgcgccggggagccgggctcggcggcgagggcctcctggaagaacacgtgcttgtcggcggtgtgattgggcacgatgtccacgattaccttgatgccggcctcatgcgcggccttggccatggcgtcgaagtcgtccatggtgcccagtcgcgggtcgacgttgcggtagtcgatcacgtcgtagccgccgtccgccagatcggaggggtagaacggggagagccagatggcgtccacgccgaggctcttcaggtagtccattttctcggtgacgccggcgatgtcgccgatgccgtcgccgttaacgtccttgaagctgcgcgggtagatctggtagacgacggcctgcttccaccagtcgtcattgaggttatttgcggtcatgccgattccctcctgttccgggtgcgttgtggttgggttgttccggtcgcgcccgaactgctgtgtgaaggcccaaccgttgtattaatgatgataacgatatcatgtgaatcacgcatgcaaaaatcgatttatcggcgttttgcggtggtaacgtggtcacgcctgcgcgggcgctgctgtcgcggcaggcggcgcggtggtttcgcgcagtattagcggagtgttcggccgtacgaatgccggttcgattgacttgccggcaatggcatccaataccatgtgcccggcagtcgcgcccattgcgaacgggtcctgatgcagcgtggtcagtcccacggcggcggacagggtggaatcgtcgaagccgatgatggaaatgtcctgaggtacccgccgcccgtattgacgcaggcgatacagcacgggcgcggccatttcatcatcctcaaaacagaaggcggtgatgctggggaaggcgttcagtacggcgttcaatgccgcgttgctttcgccaagaccgcgttgaatgctcaggggcgttagctcgatccccggatgggcggcagcggcatcaatgacgccctgcaaacgagcctcggcactgtagcgcatattggtttcggtcggtgcgctgccgacgaacgcgatatgccggtggccgagtgcaatcaggtgctcgatagccgaacgtgtggcggcgtaatcatcaatgctcacgcctgcgtcgaacccatcggtggaggggatgttgatgccgacaatcggcacgtgcatatgcttcagtcgctccacttcagccggttcgatgtcgaaggagctgacaatcaccgcatccgcattgcgccgcacgggcaaatccgcaaagaagtcgtggcgctcggcggcgttgcgcatggggtagggcacagtgtcgtagccggaggggcgcagcgccgagtcaagaccggcgaagatgttcgaattgaaccaactggcgatggtctcgctggcaagcaatgcgatacggaacgattggccggatttcagggcggcggccgagcgagagactgagtagtcgagcttttcggccgcggccatcactcggtctcgagtctcgggaagcaccagatccggcttggcgaaggttcgggacaccgtggatacggaaacgccggcctcgcgggccactgcctgaatgcttgccttggtcatatgccgtcgctccttcgccgtcgcgaacaatcattgtcatgacaacgataacatgcccataacaagtcgtcgtcttcggctatctcgattacgaggggctgatttagaccaatttcccattgccggaatcgatcaccgcttctctcggcgcatcacggcggctagggactgcacgcgtggcaggtcgaagacctcgtcggtatgtaccacgtggcctgagctgtccgccagcggcacgcgccagttcgaatactctctggaagtgcccggctgattctgggaacggcattcgcccacgccgtccaccaacgctgcctgcagcagcagcgacggcgtatcggtgagcatggcgtgcatcgcttccacgatttcctgcacatggccttccacatcatccgccacggtctgcgagatatagccgttctccaccagacggttcatcatggccgtgcgttcggccatcgccgaggcggcgaacgcctccaccggctcgctcaggagatgcagctcctcgcgtagcttgacgtgttcgaagttcaggtagccggcggtgggtggcagatcgtgcgtggtcaccgaggccaatgcctgcttgcggtagtcctcgggtgcgcggtacgggtcgccggcgttcggcgaatcgtccacgcggttgaaccattccacgtcagtgccgagtacgccgtgatctgccagaatgcggcgcacgtaatccggcacggtgcccagatcctcgccaaccaccatgcctccggcgcgcgtggcttcgatggccagtactcccagcatcgcttcgtggttgtacgttacgtatgcgccgttgagggcgccgagcccctgcggaatccaccacaggcggaacaggcccagcacatggtcgatgcgcaccgcgcccgcgtgctcgtacatcgaatgcaccatctcgcggtacacctggtagccggtggcctccagatagcgtgggctgaacggcggctggccccaatcctggccctgctggttatagaagtccggcgggcagccgaccgtgacgccgccggaggcgaagcgttccggattggcccaggcatccgcgccgagcccgtgcacgcccacggccatgtcttgcatcagacccagtgtcatgccgtggtccagcgcctcctgctgcgcggcgttcacctgctcggcggcaatccactgcagccagcggttgaactcgaacaggtcgtggtgctcctcgacgagctggcgcacggccgggtcgtcgatggtcttctcgaagaaccaacggttctcgccccacggcgcgccccatacctcgaagcacaggcaccaggtggcgaaggaatcgaggtctgggccggcggtggtcttgaaatgctcgaattcgagctcgcgcttgttgttgcggcccgcgtcgaagatcaggcgcagcgccgggcgtttggccgcccacgccgcgttgatgtccatcgggttcgattcgtcgttgcgtgcggccactgaatcatgcagcgcatccacctgcgctcggatatcggccggcagcgtgccgtattcggggatgtcctgcgggcggatgtacgtcacgttgaggaatcggcgcgattccggtagatacggcgatggctcaagcggcggaatcggcgcgccggcgtgaatcgggttgatgagcatgaagtcggctttggacttgtcggccgcgtccgccagcagcagcttcagatcgccgtaatcgccgatgccccacgattcgcgggaccgcacggaatacatctgcgtcatccagccccaccgctggtgctcggcgaccgcctccggcacgggaatgcgcgcgggggcggcgatgatggccgccttgccctcgcgcccgtccaccgtgacggtcagtgtgtggtagcccatcggcagatcgggggcgatggtcaagtccggcttgccggaattgaggttcggcagcagggcaaagtggccaaacgcggtgccgtcctccagctcgatggaggcggtgatgtccgcgtccgacgggcaattcagggtcaggcttgtcggcttgccggtggtggccacgatggtgggtggtagcaaacgtttgctgttttcggcctcaagttcggtcatggaacgttttatggcctcgtcgctggaggcgtccacatcgagggccttgagcacggcgaccaaggcctcgtcgctgatttcggtgtaggtgccgagctggtcgatgaacgaggtggaaagcccgcatgctttggccagcttgaccagcggacgggcgagtcgttccgtgctttccgcgcgctgcggggcaccggaagcggcgtcgttggtggtgtctgcgatggtgccggtgctggtcgctgcgtcgttgctgtacgcgtcggtcatgatgactccttgcttgcaaattgggtactgctagtcgtttgcattgctgttcgagggccgctctgcgttgaggttccggcaacctgacagaccaatgttcgagctgttctgcctctaccgtaactcatattgacaacgattgcaatacattcggtgagttggacgaggctagaggtgttggtgtttgtcgtgatggcccgttgactatccccagtcgactttgccgacagcctcgccggcggaggtgaggtcgaacgggtttaaccaaacacgacgaacgattgcggggagagcgtcagctgcccgccgctcacggccggttcaccaagactgagcagcacgtcggcgtcggaagagagctcgtccggcaggtattccgtgaggaatgaggcgattgaggcacctgaatcggcgttgaaataactggaatcgccttcgtgctccataggcgtgtcggtattgcgcagcaacaggttgtagccgttcgggtggccgtcccggcgccagtcgaggtagaggtccatgtcgaagccggcctgcatcgattcgttcggatggcctggacgccatcggcggaccgacctgggtggattccgataaggcggccgtatgggtgaccaactgggacaccgagcgcaacggctcctcgctcaccacccgtgacggcaccagctacctgctcgccaacgccttcatgctcgcctacgattacggccagccgcacatcttctccggctactactacgccggcgtcgacgacggcgctcccggcgccacccgcacctccgtgccggacatgacctgtccgaccgacggcatcgaaaccgccggcacctggcactgcgcgcaacgctggaccgccatccgcggcatgatcggcttccgcaacgccgtggccggcaccttcaccgccaccgtggccaagggctcggccgtcgccctatacgccggcgcgacgcccgcaaactgggccggcacccggaaatacgatccgtccgatcccgcctggttcaccggcgaaacaccgcataagggcgatgacaccgccgccaagtccgccgattccgcagcgtccgccaagtcaggcgacgccaagtccggaaaggcaacgtccgatgccatccgccgcgccgcaacgctcgccgccatcctcctgcccgtcatcgtcggcgtcacgttcatggcgatagctcgcaggaacggcaaagcccagtccgacaacagcggcccgaataacgactgattcggccccgctcagccgcgcacccgcggcgcggcggtggagtcgcgtaccagcagttgcacggggaagatctcgtgcggctggtccagggtgcgcccctcgataaggtccagggccttgcgcgcggcggcgacggccatgtcgtacggcttctggcgcacggtggtcagccccacctcgcccgagaacgtgctgttgtcgaatccggtgacggacaggtcggtcggaatcgccatgccgcattggcgcaggcggaagaacagcggaatcgccagcgaatcctgatggaagcacagggcagtcggggcgtcgtcgcgcgcgagcagcgcggtgagggcggcgtcgaccggatcgtcgccggcctgcatgtccatcgtctggccggtcacgccgtccagttcgctgcacgcctccaggaatccggtgacgcggttgtgcgagctgaagcccatcgtggcatcgaacgtctcgtacaaatacaacaggttgcggtggccgagcgtggtcagatggcgcacgatcagccggatgccggccttgtcgtcgatgcccacggaggcggtgaacccctgcgaggccgtgttgatgccgatgagcgggatccgcgtggtgttgagtcgcctgatttcggccggggtgatggcgaacgacgagacgatgaccgcgtccgcgttgccgcgcaccggcagttcgtcgaagaactcctcgcgcgcgcccgcgtcgccgatcggttggatgaccagatcgtagccggccgatcgcagcacttcgttgaggccttcgatgatgcgcgaggtgaaccagtcgagcttgctgctgcccaccagcagcgccacgcggtgggagcggcccgatttgaggatgccggccatgcgggataccgagaagtcgagttgttgggcggcctccatcaccttggcgcgcgttttggcggagaccatgtcagggcgggagaacgcgcgggagaccgtggcggtggagacgcctgcttgcctggcgacgtcctcgatgctggctttcatggcccctcccggtttttcaaagttgacggtgtgacaaacttctcttcattgtaaatcattgcagtacgttttacgacagtcatagtgcaatgggttgcgatattgcgacacgccgaaaatatagaccaatatggtctcaatagctttggaatgtaacaggttgcaaatgtaacggtttgcatggctgagaaagccgggttgccgaactagttcgacacccgtatgctgaaccgtgttcacttagagcttgcgaggaagtaagggagataatgaagatcaagaaatctctcgccgcgctgactgcaaccgtgagcattatggcacttgcaaccggttgcagttcgagcggttcgtcaggcgtcgtcgacacccaggccgacaagggcctggccgtcatgggcgacaccatcacctacgaccccaaccacttggtcaacgacggccagcccatcgaactgggctactggtcctggggcgacgaaagcactgacccggtgatctccatgctccacgagtacgagaagatccacccgaacgtcaccttcaagatctcgcaggtggcttggagcgactactgggtcaagaccccgctctcgctcaagggcaacaagaacgcccccgtgctgttcaacgtccacaactccgaggatgccctgctccgcccgcacgccgtccgcctcgacggcgccagcgactggcgcatcttccaccaggtggtgctgccgatgagccgcaattccatcgccgcgctcgccatcttcaccttcctgtggaactgggaggactacctctggccgttcctcatgatcaccgatgacgacaagcagctgttgtcggtgggcctcaagatgttctccggccagtacggcaccgattacggcggactgttcgccgccacctccgtgaccatcatcccggtggtcatcgtctacctggtgttccagaagcagttcatcgccggcatcgccaccggctctggcaagtaaacccggccggtttcggccgaatccgaaccgcgccgcagtctcccaccagtcccggggagccgcggccgcatcactcgtatcatcgtgaataaccgtacagaaggggtaaccatggcacagtcaccacaactcaagcagtcgtctccgacctcgcccgatccgcaggacttccgcctcgacgccacgccggccatgcgcgccgacaatgtggtgtccggcgagcactggcgcatcggactcatcaccgattcgctcgtgcgattcgaatggtccgattccggcgtattcgagaaccgcccgacccagaccgtcctgaaccgcgatttcggtagcccagtcgaacgccgcgtcaccgagcgtgacggccgcgtcatcatcgacaccgcggccctgaccatcgtctacgaccagcagccgttcagcaaggaaggcctgagcgtggtcgtcaaaggcgtggccgacacccagttcaacacctggcattacggcgacgcccagcgcggcaacctcaaaggcaccgcccgcacgctggacgaggcggacggcgccatcgagcttgacaacggcgtgatctcgcgcgacggctgggccgtcatcgacgattccgccgccaacatcatcatcgaaaccgacacggtgaacggcaaggcgaacccgttcggcacctgggtatccccgcgcgccaccgccgaaacggacttgtacttcttcggctatggccaccgctacatcgaggccgtacgcgacttctatcgcctgaccggccccacgccgctcctgccgcgcttcgccatgggcaactggtggagccgctactaccggtacacgcaggacggctatctggccctgatggaccgcttcaagcgcgagggcatcccgttcaccacctccgtgatcgacatggactggcatcgcgtggacgacgtggacccgaagtacggttccggctggaccggctactcgtggaaccgcgaactgttccccgacccgccggccttcctcgccgacctgcaccggcgcggcctgcgcaccacactgaacgtccacccgcgcgacggcgtgcgcgcgttcgaggacgcctaccccgaagtcgccaagcgcgtcggcatcgacccggccaccgaggagaacgtggaattcgacctcaccaacccggacttcgtggacgcctatttcgacatgcaccaccgcatggaggccgaaggcgtcgacttctggtggctggactggcagcagggcggcgtgacccgcgagaaaggtctcgacccgctgtggatgctcaaccacatgcactacctcgactcagggcgcggcggcaactggccgctcaccttctcccggtacgccggccccggctcccaccgctacccggtcggcttctccggagacacgatcgtgacctgggaatcgctcgccttccagccgcagttcaccgccaccgcttccaacatcgggtatggctggtggagccacgacatcggcggccacatgttcggctaccgcaacgaagagctggaggcccgctggtaccagctcggcgcgttcagcccgatcaaccgactgcattcgtccaactcgccgttctccggcaaggagccgtggaacttcaaccgtgacgtgagcgccgcgatggtggacgcgctgcgtctgcgccacgcgatgatgccgtacttgtacaccatgaactaccgtgccgccgaagccggccgtccgctggtcgagccgatgtactggcagaacccggatacgccggacgcctacgaggtgccggacgagttccgcttcggcaccgagctcgtggtcgcgccgatcgtctccccggacgatgccgccgcctgccgcggccgcgccgacgcctggctgccgcagggggagtggttcgacttcttcgacggccgccgatacgtctcatccgacgccgccggccgccgactggaggtctggcgctcgctcgaccgcacgccggtgttcgccaaggccggcgcgatcgtgccgttgcaggacgtcgcggaatccggcgaagcggtcaactctatcgccaacccgcaggccctgcgcgtgctggtgttccctggtgccgacggctcgttcgtcatgcgcgaggatcgcggcacgtggggcgccaccagcgccgacaccgcgatagcgttcacgtggggcggggccgatgcgtcgcccagcgccttcaccgtcgcgccggttaccggcgatacgtccgccgtacccgagtcgcgcgactggacggtcgtgttccgcggcgtcgcgccggtcgatgcggccagcggcgtgcgtgcatggtccggcgaggctccggtcgaggcaacggtggcgtacgacgaggcgaccatgagcctgaccgtgtccgtcaccggcatcagctcggctgccagtctgcgcatcgagattcccggcggtctgcgcatcgccgacaatccggtcgaatcggacgcgatggacctactgctgcacgcccagatgctctaccgcaccaaggagctcgcgctgcaggcggtccacaagctcggcatcggcgcgatcggcgccctgcgcaccatgaaccgtggtccgcgctacgccaacgatttctggatcaccgacatgcccgatgcggtggccggcgcgctcgaagaaattctgctgcgcagctgagcccggttgcagttttctgcaacatccgggtgcgccccggtatgcggcgataagttcggcatggttgccgaagggcgtggcataccgggtgcagtgcgtgggatggccttcgcgattgcactcatcgtgcggtcagtggaaaggaacttttcatgcacaaggtgaaacagcacaagggcgtcgcggtggccgccgcagtctgcgcggtcgcgatggcggcctcgctcgcgacccacgccggcgcggccggggaccggcgttattgactggctggcgttatcgagtgattggcggtatcaattagccggcgttattgatgagccggtgttgtcgattagccagcgttatcgaccggcactgaagcatgcagtacccactgcccgcgtttctcccgcacatcccaatccccgtgcgcatgcagcacacgctcccgatagtacgcaagcccggaatgccgcccctcaagcgtcgtgccaccttgacgtgggcggtccgtcacatcaatggtgacgtggtcctgagcggcggaaaccagcaccacgtaacgctgcgtcggatcggcatacctggcgatattgccgaacaattcccgcagaaaatcggcgacaaacactgtgtctgagttattcagcgcatcgatgcccccagcgacaataacgtcgccgacacaccccatgcgccgcaatcgcgcgccgccgctggcaagtctgatggcaaggctgatggcgcgccccagtcaccccttgcagttttctgtataagtggattttggctccaaacgcaccactccgtcatcgccgtcagtcactcccacaaaaaacttgagccaaacatactcaactttttgtgttgaaattgggaatagaacttgccaaatggaagttgagtgatgtaggctcaagtttggaaggtccaagagacgaccaatcggaacttgggcaaagaacgtaagaacaaacgagtaattaaggagcacacattatggcacgtgcagttggtatcgatctgggaaccacgaattcctgcatcgcaactcttgaaggtggcgagcccaccgttatcgtcaacgctgaaggcgcgcgcaccacgccgtctgtggtggccttctccaagtccggcgagatcctcgtcggcgaagtggccaagcgtcaggccgtgaccaacgttgaccgcactatttcttccgtcaagcgccacatgggctccgactggaccgtcgacatcgacggcaagaagtggaccccgcaggagatttccgcgcagatcctgatgaagctgaagagggatgctgaggcctacctcggcgagcccgtcaccgacgccgtcatcacctgcccggcatacttcaacgatgcccagcgtcaggccaccaaggacgccggcaagatcgccggcctgaacgtcctgcgtatcatcaacgagccgaccgcagccgctctggcctacggccttgagaagggcaaggaagacgagcgcatcctggtcttcgacctcggcggcggcaccttcgatgtctccctgctggagattggcaaggatgacgacggcttctccaccattcaggttcaggccaccaacggcgacaaccacctcggtggtgacgactgggatcagaagatcatcgattggctggtttccgaagtcaagaacaagtacggcgtcgacctgtccaaggacaagatcgcgctgcagcgtctgaaggaagccgctgagcaggcgaagaaggagctctcctcctccacctccaccagcatctccatgcagtacctggccatgacccctgacggcaccccggtgcacctggatgagactctgacccgtgcgcacttcgaggaaatgacctccgacctgctgggtcgctgccgcacgccgttcaacaacgtgctgcacgacgccggcatctccgtgagcgacatcgaccacgtggtgctcgtcggtggttccactcgtatgcccgccgtcaaggaactcgtcaaggagctcaccggtggtaaggaagcgaaccagtccgtgaacccggatgaggttgtggctgtcggtgccgccgtgcagtccggcgtcatcaagggcgaccgtaaggacgtcctgcttatcgacgtgaccccgctgtccctcggtatcgagaccaagggtggcatcatgaccaagctcatcgatcgcaacaccgccatcccgaccaagcgctccgaggtcttctccaccgctgaagacaaccagccgtccgtgctgattcaggtctaccagggtgagcgtgagttcgctcgcgacaacaagccgctgggcaccttcgagctgaccggcatcgctccggctccgcgtggcgtcccgcagatcgaggtcaccttcgacatcgacgccaacggcatcgtgcacgtgtccgctaaggacaagggcaccggcaaggagcagtccatgaccatcaccggtggttccggcctgccgaaggacgagatcgaccgcatggtcaaggaagccgaagctcatgaggctgaggacaagaagcgcaaggaagacgccgagacccgcaaccaggccgaggccttcgcctactccaccgagaagctcgtcaacgacaacaaggacaagctctccgacgacatcgtcaaggaagtcaccgacaaggtcaacgctctgaaggaagccctgaagggtgacgacaccgagaaggtcaagaccgctcagaccgagctgatgaccgccgcccagaagatcggccaggtcctctacgcccagcagggtgccgagggtgctgccgctggtgctgacggtgccggcgcttccgctggctccgcctccggttccgacgacgacaccgtcgaggccgaggtcgtggacgacgatgacgacaaggacaacaagtgatgtccgagttcaacaaggacgactacctgaacgacctgccggatccctcagatgctgaggctgccgctcaggcctcttcaggggctgacgcctccgccgagtccggctctgcgcaggattcggctgcccaggctccttccaatgaaggagccgacgcggctcctgccgcagctgagggagagaagactggcgaaggccagtccgattccgcagacaccctcaccccgctcggcaaggccaagaaggaagccgcagactacctcgaagccctgcaacgcgaacgtgcggagttcatcaactaccgcaatcgcacgcagaaggagcaggagcgcttccgccagcacggcatcatcgacgtgctgaccgcgctgctgcccgccctcgacgatatcgaccgcattcgcgaacacagcgagatggacgactcgttcaaggccgtcgccaccaagattgacaaggccttcgagaagttcggtgtcgagaagttcggcgaaaagggcgaggacttcgaccccaccaagcatgacgcgatcctgcacaagccggacgcggatgccgaaaaggaaacggttgacaccgtggtcgaggccggctaccgcatcggcgatcgcgtaatccgcgccgcccgagtagtagtagcctccccgcaaaactgacatccagctcgctgcaatgagttgatatttaccttggctcccctctctgaggggagccaatcataaagacttttctagaaaggagacatgaatggctgaaaacgaatggctcagcaaagacttctacaaagtccttggtgtctccaaggacgcttcggacgacgacatcaagaaggcgtaccgcaagctcgcccgcaaataccatcctgacgtcaacaagaccaaggaagccgaggagaagttcaaggacatctccgaagcctatgacgtgctgagcaagaaggaagatcgccagaagtacgacgcgattcgtcagttcggcatgggcggtgcccgcttcgccggcggttccggcggcttcgatgcttccggtttctccgacatctttggttccatgttcggccagggtgccggcggcaatggctcgcgcatccgcttctccacttcgggcggcggccccaacaacatcaacgacatcttctcgatgttcggcggtgctgcaggtcagggcggccagccgtatggcggctacggccaatcgccgtacggcaatgccggcggctatggctatgaggaggccccgcgccccgaaaacggcgaggaccgcaactccaagatcagcctgaccctgcgtcaggcggtcaagggcgctaccgtgtccctgtccgtggacggcaagaagttcaaggcccacgtgcctgcgggcgtcaaggacggacagaaaatcaagctggccggcaagggcaagctaggcatcaacggcggcaaggccggtgacctgtacctgcacgtcaccgtcaagcccgatgccacattctcgatgcgcggccatgatatcgtcatggacctgcccgtcaccgtgggccaggccgtggccggtggcaaggtcgaggccaaggatatcgacggcaatcccgttaccttcaaggtgccggcaggctccagctccggcgcggaagtcaagctcacgggacttggcgtccagcgcagcaaccagccgggcgatctgatcggccgtgtgcagatcatggtccccgccaagccgggtctggccgtcaagcacgccgccaaagaattcgacgaaaaagccggcgactatctcagcctgtaatcaggaggtgaacaatggcgcggttagccaaccagatgaagcagttatacgcgatgtgcgcaaccgcgctcgtgatgggcagggccgatctcgacggagccgatgacgtcggcttcgacatcgaactgcccatcttcaccgtcggccagaccgccgagttggccaacattcacccccagactctccgtcagtacgaccgcctcggtttggttcgtccgcagcgcaccgatggcggcgcacgccgctactgcctgcgcgacattgcccgcctgacccgagctcagcgcctgagccaggatgagggcatcaacctttccggtatcgcgcgcattttggtcctcgaagaagagaatcgccaactgcgccgcgaagtcaaacgcatgcaaaccggcgaccaggagagcgttttcgccgcaggccgtgacggcaatatcgtggagatacaacgctccaaccgcgcccgcctctggcgcaacgccatccgccgcgaaacccgcgaactgcccggccgcgatactgccgccgatatcgctgccggcgccaccggcgactccaactacactcccgccgactccaagtccatggtcctgtggggttggtgagtctggccgcattgcttcgattccttctccattcgtaaaactgtttgttatctcacatcgggcagctgccgaaaagcacgaatcttcttgacggagatgtcaaggtttgttacggtgacgtgcgaaaaccgattcgtaaggggtgctttaggctgagacggtatgtgccgaacccttcgaacctgtgagctaacactcgcgtagggaatgcgacggttgaactcctctgttcggctcggcatcccatatgcgcgttgagagagaggaagcgtatgtcaatacgcaaggagctgaccgcccagaacgtactgctgggtttccagcatgtgcttgtttccaacgtctggcttgatccggtgtttgtggccggagcaatcggcttacctattgccctgtcgtcgaacatgattaacgccatcttcatcgtctctggtctggttactttggttcaggccactcggctggttcgcctgccggtggtgcaggggccgtcagccgcgtttgacgcgttgatgatcgcggcaggtacggccggcatgctgggggcggcgagttcgtccattctcatcgcttcgcttgtgttcctgttgctgtgcctgaccggtgtgatagagcggatgcggttcctgttctctccgatgatttcgggcgtggtcatctttatggtcggtgtctcgctgtctggattcacgctgagcgagtttctaggcggggctcccggcgacaagacgttcgccgatccgcacatcctgaccgtgtcgattctgaccacggcgattgtgcttgtcctgtcgttgctcggcaagggcctgctcaagtcgttctcattcctcatcgcgctcgtcgtcggcaccgtggtcgccgcagcgtttggcatggtggacttctctcctgtggcatccaagggatggttgggcctgccgaccttcctgccctacggtccgttcacatttgactggaagatcttcatcccgttcttcattgcctacatggttgccgtcatggaagctctcggcgtctatcaggcggcttctgagattcagggcacgtccctcgaacgcaagcaggtgcgctacggtcttgccggcgaggcggccggttcagccatttcctcgctgattggtggattcaccaccaccgcctacccgcaaaatgtcggcctgctcaacctgaccggcgaaggcaagttgcgcacgcgcacgcctgtgatcatcgccgctgtgctgttgctgattctgggcttcgtgccaaaggcgggcgcgttgctgtccgtcattccctcggcagtcgtcggaggcattttcctgccggctgcggccagcctaatcgtgaccggcctgcgcgccctgcgcaaggtcgctgatgacgagcgccgtcaaacggtcatcggcatgtctctgttgctcggcatcgccctgcccaaggcgctctccggcctgaccggcggcgcaagcgtgttctttggcaacaacatcatggtcggtgtattcagcgccatcattctcaatgcgcttttcgtcgctcttccggatttggtggcgaagcatcgtgcgccggcgtccgtggatgttccagcagccgatccggcggatgggactggcgctgcggcgtacgatgaacgataatgctggttgatattggatattgacaggagcgatgcaatgactgatgtgatggatgacgcgcgtcgtatcaagcgcgggattctggattttatccatacctatggctgtgagcaggccccggaagaggcgtttggtgcgttggcgcgcgacgtgttcatctatcagtacacgtatgatctgccgtaccgtcgttactgcgcggctaaacgcgtcacccccgcaacgctcaaggattggcgggagattccgccgatgccggtggacgggttcaagcaccttgacctttcgaccataccgaccgagcagtgcgaagccgtattcatgacgagcggaaccacgcatggcggcaagatgcgtgggcgcaacttccatcccgatcttgaggtgtgggatgaatcaatgattgtgccgttccgtcatttcatcatgccggatcgagagcgtatccgcatcgccgtgatttcgccggcatgggacatgaaccagaactcctccctgtcgcgctaccttaccaaggccgtggagtgctgcggcagcgaaggcagcggtgtgttcttcgacgagcatggactcaagttcgatgaaatcatcgccttccttaaccgtgcggtgtctgacggtgaaccggtgatgctgatgggtgtctcgtcgtcctatctgtatctgttcgattacctgcatgagcatgatctgacgttcgcgctggcccccgatagccggttgttcgacactggcggcttcaagagcactaagcgcgacatcaccgaagaccagatgcttgatgagctggaacagacactgggggtgccgcgccaccactgcgtcaacatgtatggcatgaccgagttgagctcgcagatctatgaccaaaatattctgtcgtggtatacggatggcaccagcaactatctcaaggcgaaccccgcctgggtgcgcacggtcttcctcgatccggaaacgctgactcccgtcaaggatggtgagaccggtgtgatagcccattacgaccttgccaattggaattcatgcatcggtattctgaccgaggacctcggccatcggaccccggacggattcctgctgcagggcagggcgaagggagccgaggctcgtgggtgctcaatcgcggtagacgaggtcatcagtgccaaccgttgatgaatccgtgagtcaggccattgatgtcttccacctgccctcgggagtggatgtttcggattacgaaatctatgaggtcgccacatcggatggggtgaagcgtttgcgctatccgcgactggatggctcaaaggtgacttcccttgccaagcagcttgtcgatgttcgcaaccgcacgcttgccgcgatgagtgtcaacgatattctcgacatcgtggccgacgcggcccaactatgggccgatccggattttgagctgcggcgtcaggctgaactgctgattcccgcaatcaccggatatgagcctgacatggtgcggattgagctcaaacggtatatgcgccagttcaggcgtcgtgaactgctccggttccttgactccgaaatcggtcagccgtctatgctcgacgaattccggccgaacaaggcgggggatactctaaatatgtgggcccagcgctcacctatcaggtgttctccagcaatgtgccggggattcccgtgtggagcatggcgatgaccctgctggtcaaaggcgcgattcttggcaaatcttcattttccgagccggtgatgcctgcgttctttgctcgcagcattgcgatggtcaattccgacctcgctgatgccattgcggtggttccatggaagggcggctcgcagcagctcgaggattcagccatcgatgcggccgatgccgtgattgtttacggttcttcgcagactaccaaattgattgcgggcaaagtcgccgggtccaagccctgtctaggttacggagcaaaagtcgggttggcgttcattggccgagaggctttgcgtcctgatacctatgccgataccgtgcatcgtgtggctgttgacatcgccacatatgaccagcaaagctgcctggctccgcagaccgtgttcgtggagactgatggagccctcacccctcgtgaagtggctcagctgctcggtggcgagcttgagaatcagcagcgcaaatatccgcgctccgtattgagtgacgccgagaacgtggccattcagcgggcgcgcaccgacgctgagatgagagccttgatgggcgggaaggccgcggtgttcgccagtggccatagcacggcatggtcggtgctgtatcgagaacttgacggtagcggtgccgacgaggatgttgcttcgctgatgtcgccgttgaaccgcaccgtcaacgtggtggcggtgccagatttgttggacgctgccagaagactgacttcctgccgtggctggctgcagagctgcggtgtcgctgtggattcaaccagactgtttggtcttgcagatacattggccgaggtcggtgtgaatcgcatctgtccgctcggtgagatggatcgggcgaaatccggctggcatcatgatgggggcttcaacctcatcgatctgttgcgcgcggtggatgtcgaacgcggcagcgacgcgtacagcgattcgttcgatatggatatggaataggcctgtgctgttgcgggcagcagaggctggtagcagggcgaaaggcaagggtaatgacagagcaaagcgatatggcacggcgtccaatggtgaatctggatggcagaacagcgatcatcaccggttccggcaagggcataggagcggctgtggcgaaatgcctggcatcgcacggagccgctgtcgtcatcaattacgtacatgacgccgccagcgcgcagcgcaccgttgaagacatccactcgctgggaggcttggctatagctgtacaggcggatgtttgcgatgaatcgcaatcttccaagctagtgggtaccgctgtcgactcattcggcggcgtggacatcttagtgaataatgctttcggacgcttctcctttgacccgcgtcgccgttccacttttgctggaggcgattgggatgagtttagcgcacagatcgagggatgcctgcatggtgcatatctgatgtgctcacatgtggtgccgctgatgcgagcccagacctccgggcgtatcatcaacatctccagcaatctggtcgattcgcccatcgtgccctaccattcgtatatcactgccaaaggcggcttggtcggcatgacccgctctctggcccaggagctgggcggcttcggcattaccgttaatgccattgccgcaggtttgacggccggaaccgcatccagcgcagccaccaccgaggatgttcgtgaacgaatcattgccatgacgcctcttggccgccttgcccgtcccgatgacatcgccggaggggtcgcgttgttggcgtccgacatggccggcttcattaccggacaatgtctgcacgtcgatggtgggctgaccatgcgctgaggcgcaggggcggtgtgctgacgcgctatggttgtcgcatccgattggtgcaatggaatgcagcaagagtaaaggcgccaattggcgtgcgggcatgtggacggaggtaactatgctgctcaaagccgtgttctgggatttggacggtactctcatcgattctgagccgctctggcatgacggtgagattgagatcgcgcacaacaatggcggcgagtggaacgaggacctcggttgggagtgctccggcactccggtaccacacgtggcagaggtcatgattgcgcatggctgcacattgagcgttcccgaaatcgacaagcagctcaaggattatgtgttcaaggcggaggtcgaacgtctgccgtggattcctggtgtgcaagacgtgctgcattcgctcaaggaagccgacatcccatccatgctggtcactacttcgcctcgccgcatggccgagaacatcatgaagcaggctgatggattgcttgccggctacgtctgcggcgatgatccgtacgagcacaagccgagccctgccccatatctggccgcggctgagagactcggcatcgcgcctgaagacatggtcaagtgcgtggtaatggaagattcctcatccggtctgcgctccggcgccgcctcgggggccacactgattgcgcagactggctggattcgcaccgacacttccggccttggccagtttgcctccatcgactcgtatgagggcatcgatgcggccgcgctggacgcctttgtgcggcagcgtttgggggagtagaaatttcgtttgtattgcggagtttgtgtgggaaaccccagtcgacctgatgttataggccggctggtagggtatttgacggtttgcatataactgtctggttcattgggctggcagctcaatacaagatttaggactcataggaaacacatgggcttcgttaatttcatcatcgaactgctgaaggatccgcgtgccgcgattgccggttggattgccatgggcgtggcgccgaccctcggattcatcttcctcatcgtattcatcgaaacgggcgtggtgttcttcccgttcctgcccggtgattcgctgttgttcgcggccggcgtgttcgcagccccggatgctgcgaccggcaaggccgcgctgccgctgttctggttgctgccggtggtttggtgcgcgccgattatcggcgaccagtgcaactacttcatcggtcatttctttggccgccgtattatccaatccggcaaggtgaaggcgctgactcctgagcgactggccaaaaccgagggcatgattgaaaagtggggcccgctggctgtgttcctgggccgcttcttcccgttcattcgtacgttcatgccgttcatttccggtatttccggtatgcgttggagccgtttcacgccgttctcagtgctcggcggcctgtgctggtccacgttgttcacgctgctgggctacttcttcggcaacattccggccgtgcaggatcacttcgaactggtgatcgtgctgattctgctggtttcgctcgccccgaccatcatcggtctgctcaaggccaagttcggcaagaagaagccggccaaggtgaccgatgctcagttggacgtcatggaagacggcatcaagaacctcgataagtaagcaaggaatgtagattaccacataaggaatcgtcgtgaaaatgaaggccctgactgtgcatatgaggtcagggccttttctgcatgagatgggcgtgaaacaacagcgtggttatccacatttgtcgtggacgacatgccggggtgtggataactcagcaagctagaaccacaatggtcgattcgtgttgagcattgaactcggacacgtttcaatcggcttatgaatagcaacaccacaccccgcgtggcgcgtaggatcacctcgccagcggtagcacctccgggcattccgctgcccacggacgatgcgccgattccagcgcatcgctactacactccgccgcccaggccgttggcctcatgcgaacggcagagatcgggcgaggctccggcactcgccctaactacagacaccagcttccataacattgtgacgatgacgtcaggtcatggaggcgtggggttgagtgtcatggcttccatgcttgcatggacattggcgagacgtgaacacagctgcgctctcatagacgctgatttcgtggccggatgccttgacctgctgctgggtgtagaacgagagccgggtttacgattcagccaagtcgacgcacccctcggccgcatcgagggcgatgcgatgaaccatgagctgatgatgtgggagggtgtgcgagtacttccctatgacccttggagcgcgcgccagcctgactggtgggaagttcaagcggccattcgagccttggcggaaacgaacgacgttgtcatcgtagatgccggtcagggtggactcattgagaccgtacccgatctgcgcagtggcatgcaggtgattgccgcggaattgtcggtgatggggctggccagagccaagtcgcaccggtccagactggattcatggggctgtgaagcgccacatatcgtcggcgtggaaccacgtggcgctccacgtgggagaggccacgtgggtattggtgaggcgcaggactatttgactgccacggtattggggcctgtcaaaccaagtgtcaatctgtgtggagacgtactggaaggcctcggcatcagatcggtgaccaaaggcagccgcaaagccgtgagcttgcttgccgatcttgtcgagcaggccattcgcccggtttcgggagcttcttgcaaggaccggtgatgcggtatggctgccgtaatcactcgggctgatgagcccggcgcagtgcccagaactgtgttcttcggtctattgaatgatgtggcatccgacccgcaggttaccgatctggcggtgacctgtgatggccgcgtttgggcggaccgcggcaacggcatgcgagaaacagtattgcgtgtgccgtttcgctcgccgcaagtagttcgagaatacgccgtccaactgtgcgcgcagcttgggcgcagactggatgatgcctgcccgatagcggacgccgccagtccagacggcatccgcgtgcatgcggtgattgccccattggtgccacaaggtgccgcaatctccatacggttccctgacaggaccatggcatcgttgcgacatctgagccaattaggtgtattcccggctgcttggctgccgatgttcgtgggactggtgcgcagacatgccacagtgctgattaccggcggaacaggcgtgggcaagaccaccttgctcaaggcgctgctggcgcaatgcgatgtgaacgagcgcatcgtcaccgtagaggaagttcgtgaactgggggaactggggcgtggcgatcatgtgtcgttggtaacgcgcgaggcgaatgtggagggcgtcggagccataagtctgacggacttggtcaaagcgacgttgcgaatgcgccccgaccgcgtggtgctgggcgaatgccgtggcgcggaaatcgtcgacctattgcgcgcgttcaattctggtcatcacggtggcatgaccactgtgcatgcggacggcgtgaaccgagtaccgtccaggctgatttcgcttggattactcgccggagtcagtccacaggcgttggccatgctggcggcaggcgctttcgacgcggtggtgcatttggagcgagtgaacggacagcggcgtatcacgcagatcggcgaactgcgtgtagcacatggtgaactggcaggaacaccgctggcggtatggaatggctgccatcctcctcggtatgccgccgaatgggggcacttcattgaacgatggggcatcgttcccgggccgagtggtggtgggtgatgatgtggtgtgctgttctggtggcgctcgccgtgctgatatggccggggaacaagtccgggaggctgtatcggctggcttaccgcgggcgtgcggtcgattccgcagccataaacgaacctcgatatgccggctcacctcgcgtgggcgttgcgcaggtgattacgtccgccatcgcgcgattgcgaggtggcggcacattggttgaagcattcgaggaacaatccagcagacgcttcgccactcagcgcattactgtggaacggctcataacggtgttcgaacagcggcgtctgcccgacgaatcaccagcgcaggtacttgaagctgcacgcggggtcaccgccgcagcggttttgagcgatgagctcggttgccaagcagtgccatgtctggaagcggtattgactgcttaccggcagatgaggctgatgcagaacctgcgatcgcaagcatgtgccgttcctaaagccactgtggggctgctgagcgcgcttccggccgtcactgtggcattgggcgagcttctgggagctagaccattggcgttcttgcttggatcgccacgcggtgtggtctgcttggtattagggggatgttgttatgctgccggcttggcatggatgcgggcattgttgaaaggcagcggattatgagtacggtgtgggtacacgccgcggcaggctgtgcggcgatcgctagttggctgtataaggctccgtctcgtcatgacagccgcttgccgggcgaggaaccggtcgtagcgcatgattgcgggtcgtcatggaccatactcatattgcgtatgttgcaggtgtccttgcgtcagggctcctcgattccccgggcgcttgacatggtgggcaaagccgtcggcggcgactgcggcgctcgcatgagcgaggtcgggagctccctggccagaggggttccctgggctgatgcgtggcatgccgctatggctgttcagcatgagggtgcgccagctgatagttcatccggaaaacgtaccagcagaacgcaacgagatcttggcctgctgcaatcggctttggaatcgtcatggacgcatggcgatatgcctggcgtgcgcctcgaatccgccattgaacagctggaccgtgacgagcgtgccgccatcgaacggaatgccgcgaagctgtcggtaaagctactgatgcctacagggctatgttttctgccggcattcgtgctggtaggagtcattccggcgattgcgtccttcatgatgtgaatataggcgtgaactgagtgcgcttagggtgaatcttgttgtattgctcggtattgcacttggctgcgtttggttatccacattggtggtggacgacacgtcggggtgtggataactcggcaagctagaaccacataccccgttttccctggtgcatgaagcgttgatagtccacagtggtatgcaccccgcgtcaacccggcgcgggggccaaccactcacacacgcatggggaaggtgcgaagccactgcgcagcttcccctccttaccgaaaggaacgccaatgaatacccctatccccgtcatcgtcgacgggcaggccggcatctttgcgcacagcaaggctcgtgtggccacgctgaacgccaaggcgaaagaacggctatgcctcatggacgcacgcatccgcaccctcatggctgagcccgaagaaggcgcggccactgcggaatacgcagtcgtactcgttgcggctacaggctttgcggcggtgctggtcgccatcctgaagtcggatgccatcaagacgttgctgaccaacatcatcaaacaggctctgaaagtcgggtgacagccatgaagaccatgacatgccggtggcggctcgccagactgccgccagacctatgcacgggatcggccaccgccgaattcgcaatcgtattgcccagcattatcgccatcgccgggctgatattggcaataggacgtgtggtcatcgtttccatggactgtcaaagtgccgcggcagcggctgcacgcgagtttgtggttaccggtgacgaatcatccgcgcgcagcatagctgcggacgttgccggggagagccccacgtcagcattgcccacgacggccaatcgacgagtgtgacggtcgaatgttcggtattgcccggtccgctggatgtaactccaacgcgggttaccggcaacgctacggcgataagccaataacggtcggctggctgggcggccgcaacagaaaggaactgcggtgcagggaatgcgttatgaggagggatcgggcacgatggccggagccatgctggttatggtggtgggcattgcgctcgcggtggcggcaagtgtgggcaacctcatgatctgccagaaccgagcgcgttccctcgccgaccttatcgcctttgacgccgcgtatgcgctgtggcatgcggatatcggtgatccatgtgcgctcgccgccaacatggctgaagcgaatggtgtagttttgggctcctgctccgtgcgggatgaagacgtgttggtaaccatcaaggtggaaaccatggtcctggtggcatcatccgtggagcggatggctcgggccggaccggtgagttgtacggaaggagacaattatcacaataatggaccgtaaagcaccgatactctggcgggcttctgggcctttggctaaggtgagagcatgagcgagagtgaacgcaacgagcgccgtcgcgtggtggccatggtgggcaaccccacttccgataaaggccgtggcgctaaggtggacgcgcaggtattgggtctgctggaggaagccggccgtgcccataactttgatgtcatcgacatcaccggcacgagtttcgacgattccctgaatcaggcgcgtgaacgcgcgcacgagtacgactatctcgtagtggtcggtggcgacggcatgatcgcacttggagcgaacgccgtgggctgcagtggcaagccgttgggcatcgtggccacggggtcgggcaacgatttcgcacgaggactgaagctgccggtcaaccgtatcgaaaccgcagtggaaggtatcgtcggtgctatcgtgcgcggatcacacatcgatgtggacatgggacgcgtgacctctttggacggcggctatgccgtggatccctccactggcgaggagtacgagtaccaggagagcaagtccgccgagcatccgattgaccggtactatgcgggcatgctgtcctgtggtcttgacgcgagcatcaacgaccgtgcgaatcattcgcatctgccgaccggcaccatgcgctactttgcggcggtgctggtggagctgacgcatatgaagcgttatggttaccacatcaaagccacattggcggacgggaccacggatgaacgagacatcatcacaccattgctgacgattgcgaattcgaggcatatcggtggcggcattgaggtctcgccgtactcctgcttctccgatggattgttggacctggtgtggatggaccacgtgccgaacttcggcgaatgcgcggtggccatttcgaatgcctataacggcaagctacttgcttcaaaggtgttcggctggaaacgtatccgtgaaatcgaagtcacgcgggcaacggaaggagacgagccgccggtgctgatggcggacggcgaatatatcgggcatttgccatttagggtagtggccgaggactgcgcgttgcgcgtgctagtgccgccggccgtagccgcccgtgaggtggattcccgacaggaagtgctcaacgccattgcccgagatggtcgcgatcccgtgaccggccagttcgcgtgacccgattatattggctcccctcattaggctgagccgtaaagcaaacagcccagtgggctgtttgtaggcgagggttcgacgatagtcgaaccagaagaaagtcagccgtaggctgtccgcaattgcggacgagctggccgcgaagcggactgagaggagtgcgggagagcggtaccagagccaatggccgtcagacctcagacgacatagctttcgatatgcagcgtctgcgccatgacctctttgatggttcggtcgctgatgttcagatgcgagcgaatcagcgagataagccccacaatcagtgtgaagaacgtctcatggacgttggtgattggcaggccatgcatctgctcgaaatcacgtacggtggtctgggcaatgtagtcggcaatacggtccgccgcgcggtcaatgaacttgatatacagttcggcgttgccgtcttggatcatacggtttgagaaggggctctcgtcggcgatcagggagcggagcacatgcacgatgtcgtctaatgccttgttcacgttgcctgtttcgcgcgcttggttccactgcttcaacgtggtgaggatttcgtcgatgacgttatcgagtactgcgtcagctacggcttccttgtcttcgaagtagtggtagaacagcgaacgcgtcataccgacttcgcttgcgatgtcggaaacggtgattttggagaagcctttttccagacacaccttgcgcgcggcttgcacgatggcgtcgcgccgggcatcgccgcgggtggggcgtttctcgtcgagggtatcgctcatgggtgcctcctgaccacaaccgttattgacactatgttaatacaaagaaagcggttaataacaataaaaatgcggtaaccgttgtcaggtgaatgtcgttggaatataaagagttttccgattcggcaactatgagcccggtttatcttgactttttatcggttaattctgagggcaaaggtaggttagtagctatggcacttgcactgtatcgtcgctatcgtccggacaccttcgaaggggtcatcggccaggaccaagtcacggtcccgctgatgcgcgccttggacgagggcaagctcacacatgcctatctgttctcagggccgcgaggctgcggcaaaaccagctccgcgcgtatcctggcccgttgcgtcaactgtgccaaagggccgacttcccacccctgcggcgaatgcgaaagctgcaaggacctggccaccggcggtccgggttccatcgacgtggtcgaaatcgatgcggcctcgcacaacggtgtggatgatgctcgagaattgcgagaacgcgctggtttcgcccctgcgcgcgaccgctataagattttcattctcgatgaggcccacatggtcacgcagcagggcttcaatgcgctgcttaaaatcgttgaagagccgcctgaacatgtgatgttcatcttcgccaccaccgaaccagacaaggtgatcggcaccatccgttcgcgcacccaccactatccgttccgtctggtgccgcaggaagtcatgggtccctacctggagacgatctgcgacaaggaaggcatcaagcccgagcccggtgtgctgaaactggcgatgcgcgccggtggcggctccatgcgagataccctgtccgtgcttgaccagctgatggttggttcggtcgaaggcgttatcacccatgatgccgctgtagccctgctcggcttcacgccggaggcactgatcggtgaggccgtggatgcggtaatcgatcacaacggcgaagccctgtacggcgttatccagaaagtcgtggtcggcggattcgatccgagacgattcgtcgaagacctactggctcgtgtgcgtgatctgctggtgcttacgttggccggggaccgtgcggaatccgtgctgtccgacacggctgaggccgaggatatggacgatctgcaccgccaagccaaggcgctgggactgggcgcactgaccgcaatggcagacatcatcaacactacgttgggtgccatgaccggagccatttctccgcgtatgcgcttggaactgctggccgcgcgattgttggccggcagtgaatcaggctttgcaacagccgctcccgcgccagcttcttctggtatgccgcctgcggctgcttcttcgacttcgactacgccagccgcttccggtatgggtgccagtggttttgccggcgcatcgcgaggcgggtttgccggagcctcacatggcggattctccggtgctgcacgcaaccagcaagcagccgcgcctcagagcaccgcttcccatgaatctgttggaggcaatggccctgtcaacggcccggtcagcgaccgacccgcgggctctctgtctgtgcaacctgctgtagcaactgctgctgccggtgccgctcctgccgccaatgccgggtggggcgcgcccgccgcgtcgccggccgtcccggctcaaccggtgacctcgcctgcggcatcggataatcggtccatcgacgagaagtgggatgcagccgtcgccgctttgccggaaaccattcgtgaatatgtgtcacgagacaaggtgccgaccgtaaaattcggccccaaccgtaagggtctgccttgcttgtcgatgacgttcgacaagtcgctgagccagcacgctttcgccttggccgtggataacagcggtaagaaggcggcggccgtggtgatggatgccgtgcgcaacgagttcggcgccaatgcggttattgcaccttctgcggtcgcggcgaatggcgagcgagtcgaatccgtcaaacgtatgagcccggagcaattggccaaggtcaagcagcagattgccatggccaaggctggattggccgcgtcgagtttgggcgcgagcctgggcattcatatggggagcgagacgaaagctccgaagccgactgcaacaggccaagccgaggacgcagacgacagccatcgagccggacaatccagtgcatccacggcagcgaagaactggagtgacgatgacccttgggccaagccggccgtaagcaacgcttcgccgcaatctgcagacgggttcgcgcctaacgagcccgctgctacgcctgcgcccgaagagcatcacaagaagcatgttgcggttccggacatcagtgacggtgttgatccgtgggccgctccggctgctcctgttgcacccactgcgtccgttgcgtccgctggacccactggacagtccactgggcagccagccaccgcatcttccgttacggcagttgccggcgcgagcgacgatccatggaatcagacgcagtctcaggccgcggtctcaccggcgtcgcaaccggccgaagccgacccgtggaaccagccatatcagcagtctcctcacgatgatccgtggaatcaaccgcaggggaaccatgctcaggcggctccgcagccaggagacgacccgtggaatcagcctcagtcccagactccggcttcttcggttcctcagacagtgtcgggcaatatgtcgggcgatgacccgtggaaccagccccaatcggttccgcagccggctgccggcgatgacccgtggaatcaaccgcaggcagttccacaatcggctccgcaggccaccccgcacggtgacccgtggaatcaaccgcaacccgcacagccgaccccgaatgccgacccgtggaatagccagccccagccccagccgaaaccacaaccgcaagtcgcggccgaggatgacgaatactcgatgagcgaccagtcgctcggcgaggcgacggccatgaatctcgacgatctgaaaaagctattcgaggtcaaaaaagtcgagcaattcgcggcagatgatccgaagaaccccaagaacatccagcctgccaagaagcactcggatgaataatgaggacgaataacgaggaatacccatggcacttgcttatgacggcgcaatacaacgactgatcgacgctttcgggcggctgcccggcatcgggccgaagggcgcgcagcgtatcgccttctacatgctgtccgcgcccgaagatgaagcgcgcgatttggccgaggccatcgaagaggtcaaggccaagatccgcttctgtgatatttgcggcaacgtgtgcgaatccagcccctgcccggtatgcgccgacccgagacgcgaccgttcggtgatctgcgtggtcgaagagcccaaggatgtgatgagcatcgagcgcacgcgcgaataccacggcctataccatgtgctcggcggcgcaatcaacccaatggccaacgttggccctgccgacctgcgtattcccggtctgctcaaacgcttagaaggcgatgaggtcaaggaagtgattatggcgctcgacccgaatattgaaggcgaggccaccaccagctacttgacccagctattgcgacccgtaggtgtcaaggtcacccgacttgccagcggcctgccggtgggctccgacttggagtatgccgacgaaatcacgctgggcagggcactggccggtcggcgcgaggcctaagccagcgtatcattggcgctttcgcccttgcggcgcatccacggccagaatgcgccgtggcggatgatgcgcgcggccttgtggcgtcgtgccaaccagataatgaacagtcctgccgccagtatgcctagaccaacaccaagggcgatattgcgcgcgtcaagcacgtcattcggctcgggggccggcatcggaatcgccacgcggtgcccggagataagcagtcggtgcgtgttcacgccgtatggcgtacaggtcatcaaagtgacgcgatcctcacccggcacgatcttgagcttcgacgtgtcatccggcaaaatcaccgaaatgcggtccactttgtagcccaaagtttcgcccatgacttcgatgtagaagaagtcgccctctttcacctcgtccaaacgggtgaacatcagcgcttcaaccaacccgcggtgcccggtaatgaccgaatgggtggatttacctcccaccggcagcgacgtgccgtacaagtggccggcaccagaagccagtgcttcctcggaagtgccgtgataaaacggcagattgatggactgcttgggcaccttgattgtgcccatcacgccgttgccggtattaagcagtgactggtattccttgtctttctttgaggcggaatcctcgccgctggcttgggatcctccttgagcggcggcgaacggatcgacggcttcacccaagataggctggccggattcagcgagcttcttgttgtatgcgcgggccgccgtgagcttgtcttccgcctgcgggtaaggccagccagctacttctttggccgtggtggctgtggtggcggccaagttgcggtcggactcgaattgcaacgctagcgggaagcaggccacggcgattgcggcgatcagcagcacaatggtgatgatgcgcatcgcccacaggttgcgttgcaggcgtcggcgctcggccacgagatcgctgatatcgatgacttcgtcaaatggtgttggaacgaatgctgcgggctcgggccgcgctgaggaaacgttgtcatttgcagatgcgtcatccggcatggccgcgttgttttcccacattttctgtgaggcacgcttactcgtcgaacgtcgatgcagcaatgccatagtcgcctgttccttcgcttgatctgctcatgatttgcttatacaagacggccgggtccgtcttagtcgtgcatggcataggtgctgtcgcaaatggcaacaccgcacgcgccacactgcgaaacgttactccgcaccaagcctttcatgcaacatgccgacggggccatataggggcaatgtaggggcataagaagtctgaaaatgcgatacgaacaacgttgctacggctgtcagtgatgcggcttacttcggacaagccgttgagatgcaaggggatgcaaaggattgcaaagtatggcaacatgataagtcgcagcgtcggcgatatttggcagagctttcaaataggggggtatgaatgcataaagagggaatatgttacctcgataaaagaggcgctattgctgttttcgtggatgtcggttcgtcgtcgagccgttggtttcgtaggcgtgaggggcgttcccgcgtattctgttttccgaccaaagaaatgaatcacgaagaacgcctgagcaaaagctcattcgccggattgccgaacgtcaaaggcgcggttgcagaggatgcgcggatcgcggattcgccgctgcgttccgaattggctagtgtgatcagagaaaagatggcactgtctgggcatctctctttttaggtcaaggaaaagggtctggcgataggcggtgatgacgcccatcgtgttggtggcactgttgctgcaaaaaggaaaagtctagttcgtaatctagtgtccaacttccctaataggaatggtccaacttccacaacgaaaatagtccaacttccacaattagaatggtccaacttccgcaatagagtgatttataggttgatgtttcgacggtttgcgggagggcacatatggcagtggagagctcggagattcaacgtggcgagtaccttcctcgagtggctgatgggttgctgactcaggcattgcagtcttctggtgccgttcagattaaaggtccaaaatggtgtggcaagactgcaacggcagaaaggcagtcggcgagtcaggtcttcatgcaggacccggatcgcagtgctacgctgttggccttggctgatacaaagccttctctcatcctgcgaggtgaggagccgagactcattgatgaatggcagatggccccgcaattgtgggacgcggtgcgtttcgccatcgatcgagggcgcggtcgtggccgattcatcctaactggatcggcgactcctcaacaggaaccagctcattccggagtgggaagaattgcccgattaaccatgcgtaccatgtccttatttgaatcgcaggaatcgacgggcgttgtttcgttgggagagttgttcgatggcaaccatgatgtttcgggtttctccgatttcgatattgaaaacaccgcgtttgcgctatgccgcggtggctggcctgaagcagtagtcgaatctcgagtaaatgttgccttgcgcatggccgcggattatgtcgaagaactacttgattctgacatcaatcgtatggatggtataaagcgcaataaaacttggatgcgtctgattatgcgctcgtatgcgcgcaatatttcttctcaggcgtcgcaatccactatcgcggcggatatgcagggtgaaccgccttcggaaggtacactctccgattatttagatgcattgtcgcgagcttgcgtaactgaagatcttccagcttggaaccctcgtttacgttctaagactgcagtgagaacgagcccaaccagacacttcagcgacccgtcgatagcttgtgcggtactgcacgcgaccccggagaaactccttaatgatttcgagacctttggcttgctgtttgagtccatgtgtattcgcgatctgcgtgtgtatgctgatgcgcttggcggagatgtgttccattatcgggataagacgggattggaatctgatgcggtcattggcctgcatgatggacgatgggctctcattgaggtcaagctcggagaaaagcaggttgatattgcggcggcccatttgaaaaagttggctgacagaattgatcaagatcacgaaggccgtccgtcattcttgatggtgctgaccgctacggctgccgcttatcgccgggatgatggggtattggtagtgccgttggccacgcttgctccgtgagctcgtatcgtgcgtttgacccatcgttcccaacacaaaaggaaaaggcccgggctgcgggaccgggccttgaaaaggagagaggaagaagaaggtattcagttatggggtctgcggaaacctcgccggtttgctttcgtttgccggtaattgatagttaaccgctcgaatctcaaaggatggatgcggctgcctcaaagaaccaccggtgaaaacttgaatatttgctgaacaacgtaggccatgcccgtgtccacatgtcggcgcggggtcgcggggtgaacgcggcaacctttataatcgttgcgtttgcgtagaatattgagcaaactccccctaagagaagaacaaaggacagcagtggctctcatcgtgcagaagtacggcggttcgtcggtcgccgataccgaatcgatcaaacgtgtggccaagcgcgttgttgagacggaaaagaagggcaacaaggtggccgtggtggtctccgccatgggcgacaccaccgatgaccttatcgatcaggcgctgagcatcgactccaacccgcccgagcgcgagatggacatgctgatgaccgcaggcgagcgaatttccatgagcctgctggccatggccattcacgccgaaggcagccgtgcccactccttcaccggtcagcaggccggcttcttcaccgacgcccgttacggcgcggcccacatcaaggccgtgagaccggaccgcgtgaagaacgcgctctcattgggagacatcgccatcgttgccggcttccagggcatcaacgccaagggtgacgccaccacgctcggccgcggtggttcggatacctccgcagtggcgcttgccgtggcgctcggtgccgatatctgcgagatctacactgacgtggacggcatcttcaccgccgacccgcgtatcgtgccttccgcccgccgcattccgtccatcgattacgagtccattctggagatggcgtcctgcggctccaaggtgctggcactgcgctgtgtggaatacgctcagcgtttcaacatgccgctgcacgtgcgttcctcgttctcccgtcgccccggcacattggtggtgcccgacggcattgacccgcgtacgctgccgaacctcgactgagcgcggctacagcgaacgataatcgtaagtaatttcaagcaagacaaggcaagacatgactgaagaagaagcgaaatccatgggcgacctgttccctgacctgggccccgaggcaccggtgatttccggcattgcccacgatcgttccgaggcgctggccaccgtgcgtggcgtgccgaacgagccgggtatggccgccaaggtgttcaccgagctggccaccgccggcgtgaacgtggacatgatcgtgcaggccggcgcatccgtcggcactgcggacatctccttcaccgtgcccgaatcggccgtcaagcaggttcagaacacactgctcgacaagcaggaagtgctgggctaccactccttcgatgtggacaccaacgtaggcaaggtggccgtggtgggcgttggcatgaagacccatgccggtctggccgccaagttcttccaggccctgagcgatgagggcatcaacgtgctgatgatttctacctccgagattcgtatcgccgcgctcgtgccgctcgatcagctcaacgacgccgtcaaggcgctgcacaccgcatacggtctcgatgccgatcaaatcgaagccgtggtgtacggcggtactggccgctgagccactgagccgcgtttttgcggtatatacgacgaaagccctccttgcggagggctttctcagtttcggactcagttttaactacttcttggtgatgtagccgagagccttgagcatttcggcgcattcaagggcaccgccggctgcaccacgcagggtgttgtgggccagacccacgaacttccaatcgaagatggaatcctcacgcagacggccgatggaaacgcccatgccaccctcgtagtccacgtcgagcttgacctgcgggcggtcatcctcggtgaggtactggatgaagtgcttcggtgcgtgcggcagctccagctcggaagccttggacgtgtagttcaccagacggtcgatgagctcttccttggtggccttcttgccgaagttcaggaacacggtggcggtgtggccgttgagcacgggcacgcggatgcactgggaagtgatcttgaggtcgccgtcgaacggcacgatctcgcccttggcggcgtccacatggccgaacaccttgagcggttccttctcagactttgcttcctcaccggagatgaacgggatgatgttgcccaccatctcgggccagtccttgaaggtcttgcccgcgccggaaatcgcctggtaggtgctcacaaccacctcgcgcggctcgaattccttccacgcggccagcgccggcgtgtaggcctgaatcgagcagttcggcttgacggcgataaaaccacgagtggtgcccaggcgcttgcgctggtgctcgatcacctcgaagtgctccgggttgatctccggcaccaccatcggcacgtccggggtccagcggtgggcgctgttgttggagaccaccggggtctcggtcttggcataacgctcttcaatggcgcgaatctggtccttcggcatgtttaccgcagagaacatgaaatcaacaccagaggccacggactcggcatcgtcgccatcgacgaccaccatgttcttgacatattcgggcatcggggtttccatcttccaacggtcgccgacagcctcggcatacgtcttgccggcgctgtgcgcggaagcggcaagcgtgaccacctcgaaccacgggtgattctcaagcagcgtgataaaacgctgaccgaccataccggtggcaccaaggatgccgaccttcaatttttcggacatgatgacctctatgacctctgggtttcgatggattacttacgtcggacggccgtcatgcgggtggccgtaaaacaatgcaattgtacgaaacacgcggaacaacggcagtggtcttcccagatggtggctgcccaatgaagcgaaggcgatgttctacactggtagccatgtctatcgcatcagtagaggcccaaaaacagctcgaccgtatcgtggctctcggctacccggatgtggcggatatttccgccgccgcattccgctcgctggcccgacctctgatcggggcgctcgagcattccgatttgggatcgaacatcctgctggtgcccacgcgtgaactggtttcgcctgagtcgctgattgcacgaacctccatcaatcgcatggcaggcttcaccaccatgccgccgcgtgacatcgccagcttcctgcctcaagacggcttcatgccgccggaaggcccgttctatctggtcgtcaatccgcacaccggcacgtgctatgtcaatcgcgagccggatgtggcccgcaaacttattgactccgatgagcgcctgccgctcaccctcgaggaaggcttggccatcgccacccagcacccggagtggctgctggaaaagaacggcttcaatctgctcggctcacgctccgcagacggacgcgtgccgagcatctggatgagccagaacgcaccgcgactgggagccgtctggcccaattcccgccatacttggctgggcaacgcgtattgcacggcccgtcgcggggtgagtctgttccgttaaagcgattctcctcaaaagacaaggtcggcaaggtggatggcgaccgcccgttgtcggcgcatggggaaccgtaatgaaagtcaataaggatggcaccttctccggctcctaccacgactcggatatgggagccacgggagacggctatctcataggaaacgacgtcgatacgctgaacggcaaagcattgctcaacgtgacgagcggagcggataagggatacacgttctacgatttctcgtagtgattcagctgccgtgcggagcggcggggaacgtgaaggaccggcgcgtatgctgtgcgaaacagcattacgtccctagactggtgaggcatgacgaacctgcgattccgcgaagacggcagcttccgcgtgctgcagatggccgacatccaagacggccccaacgtactccccgataccatccgccttatccgtgaggccattcgcaaagccgacccggatctggtggtgttcaccggcgaccagattcgcggttacgatcctgcctacatcgacactttcctgcgccgccgtggcgaggaaccgggcgctcgcgtgcgtgcggtcaccgaagtcgaggccaagctgcgcggaatcaagcggcgggccagaaaccgcgtgaacaatcgtctgctggccatgaagtctgacggcagcaatcccgacgtccaacaaaccgcgtccaccgcgtccaccacgtccacgctggtctactccacaacatccgatccacaggatgtgccgacgactttggacgagctcatggacgagacccgtgacaaagtccgccgcacgtttgccggcttccttggcccggtcatcgaagcggaagtgccgttcgccgccacctacggcaatcacgatttccagtgcggcatcctggccgacgagcaggacggcatctaccgcgaattccccggctgcctgaacccggtcgacagcctcgagccaggcacttttgccctgcccattgaggcttccgacggatccgggcgcgtagctatgtccgtcatgatggtgaattccggcgattacgccggcaagcctgaagagaacgacgcccaatacccggcctatgtggtcaatccgcgcggtcttgatttggctgattccgatgggtatggcacgccaagccccgaggcgatcgattggctgggagccgtacagtccgaacttggcgaacgcaacggcgacggtaagccggtgcctgccatcgccttccagcacattccgccgcaggaattctacgattgcctcaaagaggttcccgcatggacgccgaacgcggtggaaggcgcacgtacccacgccggccattgctacgtgctcaaccatgagatttgccggccgggatcgcggctgggtgaggcgattggctgtgcggacgagaacgtcggtgaagtggacgccttgcgtgaggcaggcggctacttcgcgctgttctgcggtcacgatcacaagaacgccttcgtgggccacgcgcatggcattgatttgggctacgcgcctacctgcggattcgaatgctatggtcccaagtcgcgctatcgcggcatccgcctgttcgaattccatgaaagcaacccggccggctacgtgacccgcatgctcacctggggtgatctggtgggccgatactccagcaacgaggtgcgcgtctggttcgaggaccactgcgtgaccggtgccatcagcatgcgtaacgaattgcgccgcccgcaggtattcgcagtgctgtccggtgccatgagcctcggttttatggccgtcatccgctcgttggtgaagaagcggtgacgaccataaaaccggtcaatacatcaattctgctgatacggcctgaatgcggaataggtggcatcctcgtcgtatagcaggttatcgggctcttccgattttggcgtgtaggggcatgtgtcagaggtgggtttggatggcgtgtctgaagccgccggcgtgcagcaggcttctggtgatgtagttgtcgaggtttgcggaatcccagggctatgcccctgagggtctcgagccttccgttgatggcctcggtgggcccgttcgcgctgtgctcccagtcgaagaacgcgaggacgtcgcccatgcgcccccacgcatagctgtaagtagtagtgctgcgtcggaacgctaagtgtgctggcgtattgtgagatgaacgggatgttggaatgggccgtcgctaggatagaggaagttatgcatgttaccaatgcgtaaacgaatatccaataagcgattgtatgaatggttcacacagtaaaggaggaacaatgggtcaggatcaatcatccgtttttgatctcgcagcggtagccgcagcgtccaatgggggaacaacgacccgctgctgcctccggcgcgattcattggcgatccgcagaagccgagtcgtatgccgtacaacaagtacgccgcctacgacaagcagatcccgtttgattacccggagcgtacgtggccgggcaagcgactgcagcgcgcgccgcgctggtgctccgtcgatcttcgcgacggcaatcaggccctcgtcaacccgatggattccgagcgcaagctgcgtttctggaacctgctcgtctccatgggattcaaggagatcgaggtgggcttcccgtccgcttccgagaccgatttcgacttcatccgtatgctcatcgagcgtgagctgattccggacgacgtgaccatcgtggtactcacccagtgccgcgagcacctcatccgccgcacttacgaggcgctcaagggtgccaagcgcgccatcgtgcacttctacaactccgtgtctgtgttgcagcgcgaggtcgtgttccgcaagaacaaggaggagatcaagaagctcgccaccgacgccgccgaactgtgcaaggacctcgagaacgaggccaagggcatcgacctgtactacgagtactcgccggaatccttcaccggcaccgagccggagtacgccgtcgaggtgtgcaacgccgtgatcggtgttatcaagccgactcccgagcacccgatggtcatcaacctgcccgccaccgtggaaatgaccacgccgaacgtgttcgccgacgaagtggagtacgtctccacccacctcgacgaccgtgactccgtggtgctctccctccacccgcacaacgacgaaggcatgggcgtggccgccaccgagctggccgtgctggccggcgccgaccgcgtggaaggctgcctgctgggcaacggcgagcgtaccggcaacgtcgacttggtcacgctgggcctcaactggctcacccaaggcatcgacccgcagcttgacctgtccaacgtgcccgagattcgcaagacggttgagtactgcaaccagatcaagatttccgagcgtcacccgtacgccggcaacttcgtgttcactgcgttctccggctcgcatcaggacgccatcaagaagggtctcgaggctcgtcaggtggccgccgagcgtgctggcgccgatctcgacagcttcgtgtggcttgtgccgtacctgccgatcgacccgaaggacatcggccgtacgtacgaagccatcattcgcgtcaactcgcagtccggcaagggcggcatggcctacctgctcaagaccaaccacaatcttgacctgcccaagcgtctgcagatcgaattcgacaagatcgtgcagaactacgctgacacgaccaagaaggaagtcaaggacgaggatatctggcgtctgttcaaggacgagtacctgccggtcgaacagtccggcatgaccgccgccggtgtggttgtgggcgatactcatgacgcctcgctcgtgccgtggggccgcttgaagctgctcaaggtggccgtcagctccggtgaggatggctccgacaccgtgctcaaggctcgtctgctcgaccgcggcgtgaacgtcggggtcgatgcgcccgtggagcgcgaggtctccggcatcggcaacggtccgatcgccgctttcctcaacgccatttccaactttggcgttgacgcctcgattatggattacgtggagcacaccatgtccgtcggcaccgacgccatggccgcctcgtacgtggaatgccaggtcggcgaggccgatgacgcgcagatcgtgtggggcgtcggcatcgattcgtcgattaccactagcgccctgaagtcgattatctccgccatcaaccgtttccagcgcaagcgctgagcgctagcagagcaaaaacaaggctccctctgattgcatcagagggagccttgttgtctgtgttttacttactactgggtgacgccgttggtgccggtgttcccgccggtgcctccggaattaccattatcgttgccggtattgttcccgttgtcaccgccggtattgttgccggcgttgccatctccgccggtagtggtgccgggataattcgggcactcggtggaatagctcggattggcgaggcactgctgggcgaactcctgagcctgctgttgcttcttggcttcctcttcggccgccttctgctgtgcgtcctgctcagcctgcttctgcgcgtcttcggtggactgcttgttggtgttgttggacaggccgctgctctgtcccttgcccaagccccaagtgccgtcggagccgccgatcttgccgttgtctttagcggtcgggaactgctccgcctcggtgccttgcaaggcctgagccatgaactcctggaacaggtgggcggggtatccagtggaagagacgccgtatccggagaaggctggcaccacttgcggattgcccttatcgtccggattccagatagcccacacattcatcatgctgggggtgtatcccacgaacgacgaagccatttcgtcgttggcggtaccggacttgccggcgacgggccggcccaacatgctggatgtgccggccgccgtaccgtacgtggtggtgccctgcatggccttctgtaccaaagcgcagtcgttggcatcgaacaccttggtgccgttgctgggcgcgttgtacatgtccttattgttggaatcaagcactttggacaccatgtgcaaggtgttcttcacgccattgttggcgatggtcgaatggccttgcgccaaatcccacacggtcagggcgttgatgcccagcacgttgtacatggagttttcatcgatatcgccctgaatgcccgcttcatgggcgattgcggccgtgcgcttcggcgtcagatgctcattgacgttcatgaacaccgtgttcaccgagttggcggtggcctgatacagattgatgttgccccagttgttctccagagcgttgttcacctcttgatccaagccggtgaagtgctggtgggaattgccgttgaacaatgtatcgaagctgacgccggattgcgcggcccccagcaaagcgaacggcttcatagtcgaacccggttcgaatacggcctgatcggcattgttgagctgcttggacagataatctgaaccggcgtatacggacaatacttcaccggtcttcgggtccagcgctatgccgccgatttgcagggattcaggcatgtcgtccagacgggtgtcgccgatggactgcataagatcctgcttgctcttgtcgatggtggtgatgatcttgtatccgccagtatccaaatcctctttggtaaaggccttggactgcaccagctcgcggcgcaccatatccagcagataaccgttcggccccgcgtattcgttctgctgcgccaccgcggcggtctgcgggaacttggcatcagtgtgctgcttggcagtgatgtaaccatcctcctgcatgatgttcagcacacgcttgaagcgcgatttggccatatcggcgttatcggccggatcccacgtggacggtgacggaataatgccggcgatcatcgccgcctcagacagcgtcagatccttggcgtccttattgaagtatgccttggccgctgcctggataccgtaggagttgcggcccagatagatggtgttcatgtaattgcacagcacctcgtccttggattcggtctgcgcgattttgatggccatgatggcctcgcgcgccttgcccacataggatgtggtttcgcccatgtaataccgctcggcatactgctgagtgatggtggaaccaccttggcgcgtgcccttggtcacattattaatgaatgcgcgggcgatgcccttcagatcaaggcctttatccgtgtagaacgtacggttttcggacgccacaatcgcgttgccgatgtagtccggcagcccctcgcaagagatgatttcacgattctgctccgcgtaggagccgatcgcggtggtgccgtccgcgtaatacacggtggttttctcggccaacgcgaacttctcgggttgcgggacctcagtggtggtgtacaggtatgcgaatactgcgataccggccagcaagcccagtccaatcagggagaagaagatgcccagcacccatttcagtacacggtgcttgccttttcctgtgttctttttcttcctgttcggggctcgatggctattggaagccttgtggcttgcgtggcgggaacggctctcctggggcgtataggggccctcctgtgcggagtggccggctctgctttgcgcggtgcgcggttgcctcagagcggggccattgcctcccgaatgtgcacgacgagtataagaagccatggtgtccaccgtaactgttggccttgaacaatcgtttgacgtgagcgtagccacacgcgtttatgccggtatttttccggaattcttacaattgggcacgcttcttgatgctgcatgaatattgcctgaatgcgctggttggcctgtcgtgcgacccggcgcgcacgtttcgtgtcgctgcgctggtccatacgtctccatagacttatccccagcctccacgcggcgctatgtcacccaactcccccagggcaggaatgcagcaagggtaagtggcctctgacgggtgcgtggaggttttctttatgtgcggatttggctgtgagctggcactagcgtggtcccctgtccggggcgcggccgtacagtcgaacgtatgaatgacgcacagacccctagaattcgcgacccgcatgcggcggtcaatctggtcggctcaggcgcagcacagcctgactcgtcgtcgaacgttgttgacccattggctgcgctcggcccggtctccggttcagatgcatcggcatccacatcaggctccttacgggatttcaggccgctggacatggacgatgcggatggggcatctgatatcgaccgcggcttggcccggcttgacccgcttaccgtgcgcccgcgaatctccagccgcgtactgtgcgtggtattcggtctgctcctgatcgctatcggcttcggcgtgtggtgggggtgcgtgtttaccgaaaacggacaatcgtacgacgaactggtctggaaaaacctgcacaacgatgtaccgtcctgggccaccggcgtgatgaacgccgtcgcacaatcctggctggttatcgctgtcagctgcacaattgccgcaatcggcattattacggcgctgattcgacgccgctggtggttggccgggcaaatcgccgtgttcgccgtggtctgcttggccgtcacccgtatcaagggtctgttgccgcgtccgttcatcatcaacactgaatcgcctgccgctaattccgcgccttccggtcacacgatgctggccgcagcctgtgcggtgattctgctgcttaccgtgcctcgtgcggttcgagctttggcgggcgtcatcggcgtggtttgggcggtgaccgtcggtgtctccgtgatatacggacaatggcatcgcccttcggatgtggcgatgtccatcctgctggtggcgggattggccctgctcgctctggcagttacgcgcaagtccggcatggacgagccgggtcgccgcgtctcctcagtgagcgtgcaaatcgtcggcagcgtgctgattaccgggggcctgctgttgctcgcctacagcggttatgtgatctggcaggtggtgccggggctcaatgtcagcgccagctgggcggttcagggggcgaatgtcagcgctgttgtgggcattgcgggtgtggccatgctcgcattcggactgttgctggccctgcgtcagatcactgcagcgcccttaagccggctgggtctgatcggcgctccgccggcaccgcccaaacggtaaaacatggggtgcgaacggccgaatttgcccggcacaacggcggaatttggcagttggacatgattcatgagtattatgacgccagaaacgtcgtgtgtttcgcgcaatacataaggagtgggtatggctaccaaactggtgattgtggagtctccgaccaaggcccacaagatcggtgactacctgggcaaggggtacaccgtcatggcgtcggtcggccatatccgagacctcgcgcagcccagccaggtgcccgcggcagacaaggccaagttcggcaagttcggcgtggacgtcaacgacgggttcaagccgtattacattgtcgacggcgacaagaagcgtacggtcagcgaactcaaatcggccctgaagaacgccgatgaactctatctggcgactgatgaggatcgcgagggcgaggccatcgcgtggcacttggtgcagaccttgaaacccgaggtgccggtcaagcgcatggtgttccacgagatcaccaagaacgccatcaacgcctccctgaacaacacgcgcgatgtggatggcaatatggtcgacgcacaggagacccgccgcatcctcgaccgtctgtacggctatgagctgtcgccggtgctgtggcgcaaggtgggcccaggcctgtccgccggccgcgtgcagtccgtggccacccgcctgatcgtggaacgcgagcgcgaacgcatggcgttcaagcgcgcaccgtactgggatatcgtcgccacgctgtccgcgcctgacgcgctgggggagcgtgccgaattctccgcccgcatgatcgcgctcggcggcaagcgactcgccggctccaaggatttcggtgccgacggccagctgaccccggacgggttcgcggcgaacgttcgccagcttgatgaggctggtgccactgccgtggctgaagcgctgaggaccgccgatttcactgtgatgtcgatggaaaccaagccgtaccgccgccgcccgcagccgccgttcaccacctcgaccctgcagcagaccgccggcaatcgcctcggcatgggtgctcgcgccgtgatgcgcgcggcccaaagcctgtacgagaacggctacatcacctatatgcgaaccgattcggtgacgctgtcgcaggagggcatcaccgccgcccgcaacgccgtctcctaccatttcggcgacaagttcctctccgccgagcccaagcagtacgccaccaaaaccgctggcgcgcaggaagcccacgagtgtattcgcccggcgggctcgcgcttccacgacccggacgagctggcttccaaacttcccggcgaccagctgcgcctatacacgctgatctggcagcgcacgcttgcctgccagatggctgacgccaccggttccaccgccaccgtgcgcctgtctgcgccggccggccccaccgagggcgaggccgtgttccaggcgtccggcaccgtcatcgaattccccggctttatgaaggccacgggggaggggcgcaagcccaaggccgccgctcccggcgctggggctggctcggaccaggctgctgccgccggcaagacggacgccaaggccgtcaggggtgacgcctccgaatccaacacctccctgccgccgatgagcgtcggccagcaggtcgaggcaagcgacatcgaaccggacggccatgaaacccagccgccggcccgctacaccgaggccacgctggtcaagacgctggaagccaaggagatcggtcgcccgtccacttacgcgagcattatctccacaatcatggatcgcggttacgtatacgagcgtggccgtgcgctgatccccagctggctcgccttctccgtgaccaagttgctcgagacgaacttccccaagctggtcgactaccagttcaccgccgagatggaaaacggccttgaccgcatcgcccacggcgaggaatccggccgcgactggctcacccacttctacttcggttccggcgagggcgccgcccgcaacgccgacgaggcgcacgaaggcctgcaacagcaggtcgcgcagctcggcgagatcgacgcgcgcgccatcaacaccatcgacatcggcgacggcctgcacgtgcgcgtcggccgttacggcccgtatctggaagacatggagcatctggacgccgaaggcaacccgaagcgcgcgtctctgccggacaccatcgcgccggatgagctgacggtggccgtggcccgcgatttgatcgacaaccactccggtggaccgcgcgagctgggcgttgatccggtatccggcggtaccgtcgaggtgcgcaatgggcgtttcggcccgtatgtggcgttggtgccgccggctgaggcttcggctggcgctgctggcgatactgctggtgcttctgcggccaagaagggttcgaagaaggccgcggccgccgccgcgtcgcgcccgaagatggcctcgttgttcaagacgatgagccctgaatcgctgtcgctggaagacgcgctaaagctgctgagcctgccgcgcgaagtgggcacatacgaggaaaccaacgccgaaaccggcgaggtatccgaatgcacggtggccgccaacaacggtcgctacggcccctacctgaccaagacgggtgccgacggcaagtcggagacccgctcgctggcctcggaagacgagatcttcacggtcgatatcgacaaggccaaagaactgttctcgcagcccaagtacggccgcgggcgtggccgtggtgccgccaagccgccgctgcgtgatttgggcaaggacccgaacaccggcaagaacgtgaccatcaaggacggccgtttcggcgcgtacatcaccgatggcgagaccaaccgcacggtgccgcgtcagtacacgcctgaatccatcacccctgatgacgccttccgactgctcgccgaaaagcgtgcggctggtccctccacccgtggccgtcgcggtgctgggcgtgctggtggcgccaaggccgttgccggcaagggcaagaagggcggtacctcggctgcggtttcggcgcaggaggccaagcgcgccgaacgccgtgccgaagtcaagaagttggcgaacaagggctggtccaaccagcgcatcgccgaaaaactcggttccacccccgccactgtgaaaaaggacgtcgactggctgaccgccaacgagggctacgagcgccccgccgtaattcccaagcgtggctgagcggaattattgctctacttgcgtttcaaggggctgatttctcgttttgagaatatctacttgcgtttcaaggggctggtcatctgctgaaccacgagtatgaacggctccgcgccaacgtcattccgccgttttggaacgttgtctacttgggcaacagcccctcgaaacggaagtagaccttcagaaaagaccaaatcagccccttgaaacggaggtagagctggtttaactgcctgttgggcgcaactctgcgcctaacgctaaggtcaatagcatgagcggtctgtttgtttcgtttgaaggtgtcgatggcgtgggcaagaccacgcaagtcgagcggctgcatgcgtatcttgaggctcaggggcgtaccgtggtcgttacccgtgagccgggaggcactgcgttaggcaaggccattcgccaactgctgttgcacggtgtggatggggcgcagtcgacatcgcaccgcgcgccgaggcgctgctattcgctgcagaccgagcccagcacgttgccgaaaccatccgcccggcattggagcgcggtgaagtggtgatcaccgaccgctatttagactcttccttggcctatcaggccggtggccgcgaactcacgccagaagagattcgatccttaagcatgtgggccaccaacaacctgctgcccgaccgcacgtatttgctggatatggacccagccctgtcccaccatcgcctcgaacacgcggaagaccgtatggaatcggccggtgatgacttccagtcccgcacccgccaggccttcttggacttggccgccgccgagccgaatcgtttccgcgttatcgatgcgagccagagcattgaagcggtatgggctgccatcgaatccgacatcaaggagctcgcatgagcgtatgggattcactagtcggccaaaagccggtaatcgacatgctcagtcgtatcgcgcagggcgacccgagccagatcacccagtcgtggctgatctgtggacctcccggatcgggccgttccaacatggcccgagcattcgcggcggcgctggaaagcccggatcacggcatgagcgctgagcccacgcgcgtcacccagcaggtgcttgccggcacgcatccggatgtcacggtgctgaccacgaacaaggtgactattggtatcgatcaggtgcgtgagatcatcactacctccgagcagatgcccgccaccgcaccgtggcgcatcatcatcatcgaagacgtggatcgcatgcttgagcgcaccaccaacgtgctcttgaaagagattgaggagccggccgagcattgcatctggctactgtgcgcgcccagcgcccaggacgtgctgcccaccatccgctcgcgcacacgcatcgtgaacctcgccgtgccctccacccaggcggtggccggattcctgacctccaccaccaatgtcgagccaaaagtggcgcagcgtgcggcccgactcgccgaaggccatatcggcatcgccaagttgtacgccaccgacgaacgggttatgtccgaccgcgatgaacttgtggtcggtgtgctgaatctggcccgtgcctcggatgcagtgttgttggccggcaatcttatcgacaatgccaaggcccaggccgaggcagacgcgaaccgcatcaccgccggtcaggaagcggaattccgccgcatcaacggactggcaccgagcgaccgcatcccgccgaaactgcgtggcgcattcaaccagattgccaagaaagacgatgtgaagcgtttggtcacccgccgtacgcgcgacgtattggatcgtgcgctgaactccatcgcctccatctaccgagatgtggcggtgctgcagaacaatgcggaggattcggtgggcctcatcaacctggagaaccgctcgtcgatcaccgaattgtcggtgcggttgaaccgggccggtgccgtgacccgtctggacgaagtggcccacgcccgcaagcgcctagccggcaacggcaacccgctactggtattcgagtccctcttctgcgccctgatcccataacccgacgcaactagcccccctctgatgagtgggggctgtcgagcgtagcgagactggggagagaccccgtaacgcacagcccccagtacgtcacacatatgagcgatactgggacgtatgaagatttccgccgatttcaccgtcatcccggacgatttcgccaaggctgcggcccctgaatatttcaatggtggcgtgcctgtggtctccttcccgttctacatcgatgatgtggatcccgaggcccgctacctgcactgggagttcgtggacccggattcgattccggtctgcggcttcgagtggattcactggtccgtggccaatctgccgattgatgcgctgatgtacgacttcaatgattcgcatgcgttggccatcccgccggacttctcccgtcagctgccggccatgattcccgagaccgtgcaggggtgcaactcctcggcctccaagttcttgggccgcagcactgacccggcggtgatcatgcggtacaacggtccgcagccgccggacaaggatcatgagtactacctgcaggtgtgggccaccaagaagccgttgcccggcttgaatcagggcttctggctcaacgagctgttgcacgcgctgcgcaacagcggtgaagtgcccgacaccgacggcatcttcctgaccggcaaggcgtgagccacatgagcccccgcaggcgggggctgtcagcatcactgactgggggtgggtcagtacaaaaccaccttcagtccgacttcgtcgtccagctcccgccagtgggagcgtgaccacaacaaagaaaggacaccatcacactatggcctgcaccacgattctggtaggtaaagacgcgagctatgacggctcgaccatcatcgcccgcaacgaggattccgcgaacggcgagttcaacccgaagcgcttcatcgtcgtgaagccggaggaacagccgcgcgaatacaagtcggtgatctcccacctaaccatcaccctgccggacgacccgctgcagtacaccgccgtgccgaacgcggacctcaaggaaggtatttggggcgaggccggcgtcaacgaggcgaacgtggcgatgagcgccaccgaaaccctgaccaccaacgagcgcgtgctcggcgccgacccgttcgtggaatacacgccggccaagggcgatgagcccgaggtgcccggcggcatcggcgaagaggacttcctgaccatcgtgctgccgtatgtcaagaccgcacgcgagggcgtccagcgcctcggcgcgctgcttgaggaattcggcacctacgagatgaatggcgtcgccttctccgactccaacgaaatctggtggctggaaactgtgggcggccatcactggattgccaagcgcgtgccggacgaggcctacgtgaccatgccgaaccagctcggtatcgacgaattcgaccttgaggacgctctgggtgaccaggaagcgcacatgtgttccgaagaccttgccgaattcatcgaaaccaaccatttggacctcgcggtggagaacactaccccgttcaacccgcgcgatgccttcggctcccactccgactccgaccacgtgtacaacaccccgcgcgcctggtacatgcagcgcttcctcaacccgtacgacgaggtgtgggacggcccggacgccgaccacaagcccacctccgacgacatcccgtgggcccgtcagcctgagcgcaaggtgaccatcgaggatatcaagtacgtgctgagctcccactaccagggcaccccgttcgatccgtacggccagctgggcgatgagcgcacccgccacatgtaccgcacgatcggcatcaaccgccagagccagctcgcggtgatgcagatccgcccgtaccgcccgcaggcctcccgcgccatccagtggatggcatacggctccaacccgttcaacacgctggtaccgttcttcccgaacgtggacaccacgcccgcctaccttgaggacaccactacccgcgtgacgtccgagaacttctactgggccaaccgcatcatcgccgccctgtgcgatggcgccttccgctccacgtccaacgccgttgagcgctaccaggagaagaccggtgcgatgggccaccgcttggtcgccgccaccgacgagcagatcgcccgtctgggcttgacggccgccgaggaagccgcgcagtccgccgctgaagaggaatttgaggccgacaacgtggatggcgatgtgcagccgatgaccccggacgagaccatcgccgcgctgcgtaaccccgaggtgcgcgagattctcgccgccgccaaccagaccatggccgaccagctcaaggaggaaaccgaaaagctgcttgactccgtgctgtacactcgcagcatggaaatgaagaacggcttccacatgtccgacttttagtccgtattgagctcccctccctgaggggctgagccgttaagaaaacagcccagtgggctgtttttaggcgaagaggcggcgactgccgccccaccaccccgccccatcacacaaacacagaaaggctttatatgaccaccatcgaagacttcaccagccagtacggtctggtccagaagatcgacgcattcggctacatgaagtacctggccgagaaccctgacgccccgcgcaagcacggcaaggtggtgctcgtcaccgccgatacgccgctcaaggcatcgcgcggagaaggcaagaccaccacgaccatcgccctgatcgacgctctgaacaagcgcggcattgatgcgaccgccgtgctgcgtcagccgagcatgggcatcaccgcagccggttccaagggcggtgcctccggcggcggcaaggcttccctgacccaccccgagctcatcgactggggtctgtgcggcgaaatgggcgccatcgaggcggcccagaacctgctcgtctccttcgccgagaaggccatcgatgacggcaagctcgacacgattctcgtgccgcgtgtctccgaggttccgagtcgctccctgcgctccaccgctgtggactacggcaagggcaacgtgccggagaaggtcgtgctcacgccgacctgcgagctcatgcagattgtggtgctctcccgctcgatggacgagatttccgagcgcgtgtccaagatgatcgccggcaccaaggacggcaaggccgtgaccttcggcgaattcgtggacctgtggcgtatcactggcattttggccgacgcggtcaagccggccaagaccgaaaccgtgaacggatcaccggtctacgtgcacggtggcccgttcgccaacgtgtccatcggcattccgacgttggtctccgtggaaatggcctgcgccctgcatgacgtggtcatcgtcgaggccggctacggcaccgacgccggcgcccagaagtggctggacatcgcctgccgcgaatacggcgcgcagtggccgtccgccgccatcgtggtgacccgtgcctccacctggcgcgacgatcccgagctggcctggcgctacccgttccacgtgcagcgcctggagaacctggacattccgaccttcccgctcatcaacctgtgggaaggcgaggacgatcaggttccgtccctgaaggccaccgccgacgagctgggcttccgcacgccgatcatcggcaacctgttccgcgacggcggcgaggcgctggccccgcagcttgacggtttcgtcgacgcgttgcagaacggctccatgccggccgaaccgtactcgcacaagggcatggccctgaccgagaacgccaagtgggtggccgagaacgcctacggcgtaccggccgagcgcgtgatttacaaaccgggcttcaccgagtccgtgtccgaggccatggaactgtgccagagcgcaggcatctcgctggacgatctggcgttcgtggcggtcaagtccccggcgaccatgaccgacaacgaccgtgccccgaagaagagcgcaccgtgaccctgaagaaggtcgaggtgcatgccggtgccggtctggtccacgtcaacctgaccaccagcctcaccaccccatgcccaagatcgtgtgatgacaggcacaaggtgaggtaactcgctttcgaggggcggatttccggttttccggaggtctatctgcgtttcgaggggctcttcgattgcgaaacccggagtatgaccattgaaattgcaatgtttatactccgggtttcttgttttaaaagccccttgaaacgctagtagagcttctgaatgttggaaatcagccccttgaaacgtagaaagcccgccgccggcgggctttctacatctgagcttccctctttgaggggagctgccagcgaagctgactgaggggagccagaatacgcaaactagaagttgctaccattccagccccagtcggtggtggcggtgtaacggatgtaggtgcggtcctcgggaatgccgagcgtggagttcagcgcggccataatgctctcggtcagcttttcccaagcagagcccggcacagagcggccgaacacgttgacttccacataggcggcgggctggtcatcgctaccaccgaagtaaatcggcatattgtcctcgaacgggcacattagccagccctcggacttgcccggcacggcggtaatcgccttgccataggcagccttcaacgcctcgcgctgctcaggggtggtgggcacggacacatgagtgtgaataacgggcataattcctccttgattcggttcgcttccagtctagcctcagcggttgctgttgaacatggcatgcggatgtaggaagctgcttgcagaacggaccggggcaaggccaatttggggagattattggcctttccagccaatatatgttccgcagtcagcccaatagtgttgaatacccttgtgagaaaactgattgaacaactgatgaagttcggcattgtgggcgtcatcgcctttgttatcgactggggtattctcaacctattggttggcatattccacatgcacaacgtgctggctgccaccgtctctttcatcatctcgctgattttcaactatctggcgagcatgaaattcgtattcaagcatcgtgatgacatggcgcgctggatggagattcttatcttcgtggcgggcgctgtagtcggtctgttcatgaatgacgcgattatctggatttccacttatggcatgaaccatgatgcctatgtatcgcagcatgccgaatatctgttgcgcaccaatatcggcaagttggtggccactgccgtggtaatgatctggaacttcttgattcgcaagtggctgctcgacgatacgcacaccaatgcgatgaaccgtctgaagtccgctgaaaatcgactgaatgccgaggagcttgaagccaagtggcagaacagcttctcccacaagctcggcatctggtccctggaacacacgcccaaaggctggccgaagtagcgttttgacgtataagccccctcgtcagagggggcttagcttttgtctcacacactcacttcagtcaaggtcggctgctcggtggagcccttgatctgcttgaagccaatcagcgcaatcaccagcgagaccagtgccaaagtggtcaccaccatgaagccgccatgcgagcccatgcggtcgatgaactggccggcaatcgccgaaccggcggaggagccgatagaattcatcgcacccatccacgccatgccttcggtcaggcgggaaggcggcaccaagtgcagcatgagctggttgccgttaatccacgtcggagcctggcacacgccgatgatcaggtagatgatcataatcacccacagatgcttggcgaacaggaacgtgctgatgccgatgttcaccacggccaggcagaagtagaagcgcttccacagggcaatcgaccagttcttcgcgccgtacaccaaggcgcccatcaacgagctgatggagaagcaggcgaatacaaagcccgtgtactgcttcatattcgactcggtggcgaatgcgatgatcgagatgcctgtagccgactggaacgcgcccaagccgaaccaggtgacgcataccgcaatcagacccggtccccagatggacgccttcttgccggaacgcgcatcggcgaccgcctgctcaatggcggcgttaatcgtggcctcatcggtcacgccttcgcgctcaagacggcggcgagtctcctcggctgcggtctccaccttcaacgcttcggctcgagccgcctcgcgctcacggtattccttgcgggaaatgccctcagcgcgggccagctgagtctgtgacggtggctcagtggtcagctcggtcaagaacatcagcgcgcccaccaccacgcacatgccggtgaacgagaatgccagcagaccggagatcacggccagtgtggaagccagtggattgccgattacccacatgcattcgtccagcacgccgcacagggagagcgcacggttggtacgctcctgatcgcccttcaggattttggtccagcgcgcgcggctcatcgcgccccacggcggaatagctgccaggaacggcgtcaaacagtacagcacccattccggcgcacgattggtgatggatgtggtcagcgcgacggcggcgacaatccacaccagaatcgttggaatcgaaacctgccgctggccgaacttgtcggtcagcttgccgagcagcggcgtggccacggccagtgcaatcgcctgaatggcggtgagcatacctgccagcgagtagttgccgtagtaatgctgcacggaaatggtgatggtcatgcccaccatcgggaacggcatgcaggcaatcaccgaaccgatggaataacgagcggtatgaggtatgcgcagcaactccgcatacccaccaaaaactttgtgacccacttccttgatgccagccataatggtgttcgagttggacaggttgttggacataacagcactacgctcctttccgctcccgattggatgttccccgctgacgtggcgttgccggcgaagccctcatcgaatgatgtgttgtccatggtcgcgcaaagtttgcgttggatttccctattcgcatatttgcgtcacggatactctaatcgttggttagggcgcgacacgcggtagattggagatattaagacaacgttctcatgttcttcggcgaacatcgcaagatgcccgtaggaataaaaagaaaggcggctcatgagcgcaaccaccatccacttcgttcgccacggcaaggtctacaaccctgaccatctgctctatgagcggctgcccgacttccatctctccgatcttggccggcgtatggcacaggccaccgccgcctatctggccaatagccctcagaccaatacgatttccgcggtgtattcgtctcccctggaccgcacgcgcgagaccgccgacgcgattcttgacgcgttgaatcccgtgcgcgaggcccgaggcgaagccccgctcatgctcaccgccgatgagcgagtgattgaggccggcaacgagttccgcggcaagcgtatcggccatggcgaaggcgcgttgtggaagaacggcaattggaaactggtcaccaacctgtacaagccgagttggggcgaatcctatcagcacattgcgcagcgcatggatgatttcgcacgcgagaaggtcgcccaacaccccggcgaacagattgtggtggtcagccacgaatcgccgattttcagttatcgccattatctggagaccggccaccccgagcactggatgttcctgcggcacacggcgctcgcctccgtgacctcggtgacgtacgacaacgaaaccggccgtgtgatgtcaatcacgtatgtcgacccagcagccaacgtcaagtaacggcacactggtgaatagctgagctacaatctgggctcccctcagagggagccaatgggacgcactacaatcaagtggtgaacgcagaggagcatgaatgaccattgaactcaatcgtgaggcaatcgcacggatcgcggcattgccgggggtagctgaggccgctgaagccggctcggcgctaattagcctgtggccgctgaccgaagccatgcagatggacaatgacgccaagtatgcggagaacctgcaggtgcgtgtcacgcacgcgttcgcacgcattctcaccggtcaggatgttacgatgcctgacgccgaattcgtctacgagggggccgatgagattcctggccgtccgcaaagcatcgtagacacgctgcttgctgccaatgacgcctacgatacgatggccggttactcggaatccggcgatgtgcagctgattttcgatgccgccgaagctttaggtgttgactgggattcgcatgtcgaggccgcagtccgtgagacggttgtctccgtggaggctcaggttgaggccgatgccgaggctggcggacgtttggcggcttccggcgagccggctgatgtggccgtccgtttcgccaccgcgctcgccgtatgcgatgcgctgctgaacgtggtgagcgggcatgccgagacggttggcttggttggtccggctgttgctgatgccgctgatgttgctgacgaggcccgggccaccgccatcgtaacgttgccgattctgctgtacgtcaacgaattacgtgagcagtgctcgattccgcgcatctgcctgaccgaccagcagattcttgatctgattgatacgcgtgccaatgccggtgacaccctgaccgccaccgccgaatacattgccccgctggccggtgccgaatggaccaagcaccgcgacgatgtgctctggaacccggacgaagccaagaagaaggccaaggaagaagacgaaaagcgcaacaaggaggccttggccgccaagtttgcgcacattaaagatgaccctggcaaagaaaccgtggagttgtgagaatcaaggcagcttagcccgcctgatcggttctcttacccctgctcgcgattcctccgtgccaaggaaatcgtctatgtggtgaagaacatcgcttacgcaacggaagaagaaacacttatgggcaatggcgtcaatctgcgcacgctcaccaatgacggcggtagcgcggtaatcagcgattacggggcgcatctgctgcgctgggccccggcggggcagccggatgtaatctggacgccccgcacatggcatttcgaagctggtcagccggttggcgggggagtgccggtgtgcttcccctggttcgggccggggtttgtgcatggcgggcagactgcgaagcgaccgattcatgggttcgcacgattgcgccagtgggcgctggacgaaggggcgtttaccggtgcccgtgtgcggtatgtgctggattccgaacgactgacgactggcgaagtgccatggatcgaggatgaacccaacgtgcgtttccatgccgcatacgaggtgtgtgccagcgatacgctgacgatgacgctgaccgttaccaacacgggaggtgagccgatgtcgtatgaggcggcgctgcactcgtatctgcatgtcggcgatgtgctcggcgcgcggctggtcggtttgcggggtgcaacatatctggatgccacggaagccggattcccgccaaaactacaagaacagccatcggtgatgttcggcgatcagccggtggaccgtgtgtattattccgatgctgcactggaattgcaggaccatgtgctgggtcgtgtgattcgcatcggcaagaccggctcgccgcagacggtggtgtggaatcccggagagcagggcggcaacgccattgcccatgccaagacgggtgaatggcgtggctttgtggccgtggaggcagcggcgtgccgagaccgtatcgttgcccttagtccgggtgaatcgtatatgctttcgcagtccattgccgtgatgccgttggggtagttggctgaatacagtgccgataatacagtgccgagaatgatgaagccctactcgcgttgagtagggcttcatcattggttgcggggaacttcttcaacggaagttcaccgatatcggttactggccttgccagggtttctgggcattgtcgccggcgggagccgtgtgctcagaaggtgttgcggattcgtcgccggcgttttgaggcatcggcggaacctggccgtactgtggggccggggcctccggttggccgtactgcggggccggcacctgaccgtaatcaggtgcgggtgcagccggctggccatagtcgggggtcggcatgggcggctggccgtaagccggggccggctggttgaagccgggtgcgggcgcgttcggagcggcgaaattcgggggtacaggcgtgctgtatggtgcgccgtaagcaccctgaggcatgggggttgccgccgcgccatcgtcaaaacgtgcgccctccggcttgctgggaagagccatgaacacgatatagacaacgcagccggccagcgtaatcaacgcaccaatgaccgccgcgccaagaccgccggcggccatgctgccataaccatagtcataactgccaaggctcctgaacccgccgtacagtgccgcaccaccgccgataatcatgatgataaggccgataaccatcgcgatatagaaaatggcaacccaccagccaggcttgttcgtgtcatgcagacggcggacggaaagtgccagggtggggattagggtcgccagaccccaaatggtggcgaggaagccaagcttttcatctgtggcggtgttgaggatgtccagcacgatattgatgccgaaagcggccagcacccaccaccagaattcactgcgggacgcgcggcccctgaacaccacgtacttcttccagaagcgcaggaaggcttcttggaaggagcatccgtagtaaggcttatccagcggcacagtggcagtgggcgcggcgtattggccgtaagacggcggaaccgggccgtaaggattgccatcgggggccggtgtgccgtacgccggtgcggattgaccgtaggtgttggcgtcgggtgcgggctgaccgtaggttggtacggcctggccataagagttcgcggtcggagcaggctgaccgtatgccggctgtccgtaagcgggctgcgccggctgtgagggctgcgccggggccggtgcgccatactgcggtacgggattaggtgtgggcgtaccgttggcctcaggctgctgaggcaaaggcacattgttgggatcagacattgattcccctttcataagacctatgtgtcacatcatattcttccattgcatgagtggaaaactcaacaattgcgccaaataatgtccaaagttgtggtgaatgcactggaaagaatcgatggttatcaaatcgatatcagttgagggtgaacgttgtcgatcggttgtgtaacctgttacatgaatattgcgcacagttgcgggggtggaactggaaagcagacgaagcttttggcgctacgcataaagcaacatacagagatgtagggaatgccatgaaccacgaatacacggatgccgccgttgagcagcgcgaatcgcacgaagacgaatctcaagactgggatctgctgttcgtgggcctggcctgctgattctcgtttgctgttttcttttcttttgattttaaaagcaaaagaaaagaaaatggcaggcaaaagagatttcgttggaaaatggccgttttgggatggtgttggcccgaaacgtcaataacgaagcaaaagagcgaggagcgctgctctccgcgtccggcgcgcgcggcacaataggggactatgactgatgctgaaaacaccaaacccgaactgcccaagaacgttcgtgttcgcttctgcccgtcgccgaccggaaccccgcatgtcggcatgattcgtaccgccctgttcaactgggcggaagctcgcgccaccggcggcacgctgatcttccgtatcgaagacaccgacgccgtgcgcgactccgaagaaagctacaaccagatcctcgaatccctgcgttggctgggtatcgactgggacgagggcatcgatgtgggtggccctcacggcccgtaccgccagtccgagcgtaccgccatctacaaggatgttgccgccaagctgctcgaagccggctacgcctacgagtccttctccactcctgaggaaatcaaggagcgcaaccttgccgccggccgtccggccgagttcggctacgatggctacgaccgcaacctgaccgatgaacagaaggccgccttccgcgccgagggccgcaagcctgcgctacgtatcaagatgcctgatgaagacatcgcctttgacgatctgattcgtggcaccatcgagttcaaggccggctccgtgccggactacgtgatcgtgcgcccgaacggcgacccactgtacacgctgaccaacccggtcgacgacgcgatgatggaagtcaacgtcgtgctgcgcggcgaggacctcctgagctccaccccgcgccagatcgtgctttaccgttaccttatggaactcggcatcgccaaggagatgccgctgttcggccacatgccgtacgtgatgggccagggcaacaagaagctctccaagcgcgacccagagtccaacctgttcaaccaccgcgacaatggcttcatccgcgagggcctgctcaactacctggccctgctcggctggtccattgcaccggaccgcgacgtgttctccatggacgagatgaccgagaagttcgacgtgcgcgacgtcaaggccaacccggcccgcttcgacatcgacaaggccatctccatcaacgccgagcacatccgtatgcttgagcccgaggacttcctgcgccgctcggtgccgtacctgcaccgcgacggtgtggtttccgccgacaactgggatgccctgaccgaccgtgagcgtgaggtgctgaccgccgccgctccgctggttcagccgcgcgtgcgcctgctgggtgaggttgccggcatggtcggctccctgctctccaccgagggctacttggagccggctgacgacgccaagaagcagctgaaggattctgccggcgaggtgctggacaaggccatcgccgcactcgaggctgtggatgaggctgactggaagaccgacaacctgcatgagaccctgaacaaggctctggttgaggagggcggctacaagccgcgcctcgctttcggtccggtgcgtgtggccatgtctggtcgtcgcgtgagcccgccgctgttcgagtccatggagatcgtcggcaagccggtttccctcgctcgcctgaagggcctgcgcgagcacctgtgagctaaggttccttccgtgctcggctgagctgtaaggacactcaaggtgggcgtctgcatgtgcagatgcccaccttttcttgtattcagtgatgagctggaacagctggaaagtcttaccgctgcgccgcatgccagtgagaatatgtacgaggttgaacatggctggtttgtgcagtgaggtcacgaaacgtgccttgtaggtggtttcgccttcatgcgtccatgaaacggttgataggtaaccgggcggcggtctttgacgtgacattgcattacaagcatcgcgacgcgctcgctgtcgcaagggaacataagcgcctcatttggttcttgaaggctgatttgccggctatgaatgtgcaaggcaaagatcattgcctcatctgcaatttcatcagtgcattagatggtaattcatcagtagtgcttactgataatccgtcagtagagttcatgcaaattcatcagtagtggcagcgtagcacttgaaatcgttgaaattccgcgcgacacgccgtaagttgcgtaagggtgaatacttgcgtatatttatcactcgttgcgcggttcaccgagcagccggttgaaaaactgaatatgcccccatcgtctagcggtctaggactacgccctctcacggcgccaacaccggttcaaatccggttgggggtacgacgaacaactccttggagttgctacgccaagccaaattgggatgtggtgtaattggcaacacagctgattctggttcagccattcttggttcgagtccaggcatcccagccaatgaccctcgcggaatgcgagggttttttgttttcagggaagtagccgcttgaaaagcgacttccctgcatatgagtgcgcataagagcgctaagagcgcatacgtgtgtatgaaagtacgagaacgaaggagatcgaagtatgtccgctgggcagcaggctgtaccggcaaacaacgccaacaatgcaagcaatgaaggcgctcagaagaagcacatgtctaaggcggccgtcgccattatcgccgtggtggtcgtggccattatcgtcgtggccggtgtgttcggcttccgcgcctactccgatgctcagtacaacaatgcagtcgccgcttgcgccgccgcttccgaaaatgtgcgcaacgccactaatgactacaacaacttggtcaatggcgatgcttccgaagctgctgcgctcaccaagaaggatgtaaaggatgcctccacgctggacgccctcaacaaggaactgagcgtggaactgccggtatacgaaggctgcgtagctgacgacactgccggcttcaagtccgctactgcgaagctcaacgagcaggctgattggtacaaggcttatactcaatcgctgcagaaggctgtggatgccgtgaacgcttccaagaagtaagcgagcacagcctcaccattgtcgtcaaagccgtcttgcggttgcgcaaggcggcttttgctattttgctcaatcggcttgctgctgtaatgctgctgcattgattgcgtcgaatgcaggtaaattcgtcttactttttttgcgcagtttttccctgcgcgtgtcgcgatgatgcgaatatagatgtgaaggttaacaacgtagtcgtttattgggttttgtgatttcactcacgttgtaattcaatgtcaaatatgtggcgattctccgtatttgctgagattgctattaagaatagcttcttgtaaagtgtcttatcgtaattgcgaatgcgtattcttcaatgaagaaggcatctgcttcacctcgaagaagagattaaggaaaatatagttaatgaaaaagaagaagactatatcggctgcgctggcaacagcgttagccttaacctgcatgggcagcgggggaggtactgcgttcgcagtgcccctgtctgatgctgacttgcagactttggcaagtcagattcagcaaatcaacgatacttctgattctgcaactgcttccgagactccttccgcacaagccgatgcggttgaaggctggactattgattccaacatcgctcagggcggcgaaatcctggagatggcaaacggttggctgcacctcaagtccactgcctctaacggtaatgcggcagcgaaccccagctccagcaacaactggccggcagtagccgtatggggcacagattacgacttctccaaggccggctccttccacgccaccatcaaatccccgcaggaaggctccgccaaccgcttcggcttctacctgggctacaacgacccgggcagcggcctgttcatcggctacgattcgggcggctggttctggcagacctacaccggtggcggtagcggcagctggtacagcggtgctcgtatcgctgctccgagcgccaacgaagagcacgacattcgggtctcctggaccgacgccaaggtcgccacactgaccgtggatggccagaaggcattcgatgtcgattactccgcaatgacgaacctctccaacaagcttgccatcaaggccggctcctggaaggagctgaacgaggtcaccgacgtgtacatcaaggacttcccggaggttgtcgaagccgccaagcacgcggtttccggcaaggttgtggacgctggaggcgctgccattgaaggcgcaacagtgcgtttggataagaccaaggtgaagaccggtgcagatggcaccttctccttcgccgacattgaagaaggcgaacacacgctttcgattgccaaggaaggctatgaggacgtctcccagcaggtgacggtctccggcgcggatcttgccatcgatcccatcaccctgaacaaaaccgttcaggtcgcctccgaaacgctgaagaccaagaagatggaagttcagattaagaagaacttcccctctgtgctgcagtacacgatgaccgacggcaaggtgatgtacggccagtccaaggatgtgcgcaccgttgaaatcaacggcaccaacatcgaactgggcgatgacgacgtgaccttcaagaaggtttccgacaccgaggccacctacacgctgaaggtcaaggatgaggccaagaagattgacgcggtgatcaccgttcagatcacggtcaaggccaaccagctgcacctcaacgtcaccaagatcaagaacaacctgtccgaaggcattcctgagggcaacggtgtggaggagaacgccatccagacgctgtccttcccgaaccagagtctcgtttccgtgcgttccagccaggaaaatgcccaattcactggtgctcgtatgtcttccaacacgcagaagcctggcgataccaacttcgcagtgaccgaagatactaacgtcaccgatagcgactacacctacggcttcatctccggtgctggcctgagtgccggcctgtggagcaactccgagcacgatggcacctatgtggcggctcctgtgcgcggcggcagccagaacacgcgtgtctacgccaccacccagcagactggtgacgccacctccctgggcctggccagcgctccgtggtactaccaccgcacggtcaccgattccaagggcaagaagtacaccgtggccgaaaccgctctgccgcagatggccgtggccatcgccggcgacgagaacgaagacggtgccgtcaactggcaggatggcgcaatcgcctaccgcgacatcatgaacaacccgtacaagtccgaggaagttcccgaactggtggcatggcgtatcgccatgaacttcggctcccaggcgcagaacccgttcctcaccacgcttgacaacgtcaagaaggtggccttgaacaccgacggcctcggccagtccgtgctgctcaagggctacggcaatgaaggccacgactccggccacccggactacggcgatatcggccagcgtctcggcggcgccgacgacatgaacaccatgatggaagagggctccaagtatggcgctcgcttcggtgtgcacgtcaacgcctccgaaatgtatccggaagccaaggccttcagcgaggacatggtgcgccgcaactctgcaggcggcctgagctacggctggaactggcttgatcagggtgtcggcatcgacggcatctacgatctggcatccggttctcgtgtaagccgtttcgctgacctcagcaaggaagtcggcgacaacatggacttcatctacctcgatgtgtggggcaacctgacttcttccggttcggaagattcttgggaaacccgcaagatgagcaagatgatcaacgacaacggctggcgtatgaccaccgaatggggttccggcaacgagtacgactccaccttccagcactgggcagctgatctgacctacggcggctacacctccaagggcgagaactccgaagtgatgcgcttcctgcgcaaccaccagaaggacagctgggttggcgactacccgcaatacggcggcgctgccaacgccccgctgctcggcggctacaacatgaaggacttcgaaggctggcagggccgcaacgactatgccgcctacatcaagaacctgtacacccatgatgtgtccactaagttcatccagcacttcaaggtgacccgctgggtcaacaacccgctgctgaccgccgacaatggcaatgccgctgccgtgtccgacccgaacacgaacaacggcaacgagcagattaccctgaaggattccaacggcaacgttgtagtagtctcccgtggttccaacgacacctctagcgcagcctaccgccagcgcaccatcaccttcaacggcgtgaaggtcgcatccggtgtggtctccgcaggcgatggcagcgccactggcgacgagtcctacctgctgccgtggatgtgggattccttcaccggcaagctggtcaaggattccgagcagaagctctaccactggaacaccaagggcggcaccaccacctggacgctgccggacagctggaagaacctctccagcgtaaaggtgtaccagctcaccgatcagggcaagaccaacgagcagaccgttgccgtctccggcggcaaggtgacgcttaccgctgatgccgaaaccccgtacgtggtgtacaagggcgaagccaagcagatccaggtcaactggagcgaaggcatgcatgtggtagacgccggcttcaacggcggctccaacaccctcaccgacaactggaccgtcagcggctccggcaaggccgaagttgaaggcgacaacaacgccatgctgcgcctgaccggcaaggtcgatgtctcccagcgtctgaccgatctcaaggctggccagaagtacgcgctgtatgttggcgtcgacaaccgctccaccggcgatgcatccgtcaccgtaaccagcggcggcaaggtgctggccaccaactccaccggcaagtccatcgccaagaactacatcaaggcatacggccacaacacgaacagcaatacggaaaatggctccagctacttccagaacatgtacgtgttcttcaccgcgcctgagaacggcgatgccacggtaaccctgtctcacaagagcaccgacggagcacacacctacttcgacgatgtgcgcatcgtggagaaccagtactccggcatcacctatgagaaggacggcacgctgaagtccctcaccaacggattcgaaaacaacgcccagggcatctggccgttcgtggtctccggttccgaaggcgttgaggacaaccgcatccacctctccgagctgcatgctccgttcacgcaggccggttgggatgtcaagaagatggacgatgtgctcgatggcacttggtctgtgaaggttaacggcctgacccagaagggcacgctggtctaccagacgatcccgcagaacgtgaagttcgaggcgggtgccaagtacaaggtgagcttcgactaccagtccggttccgatgacatctacgccatcgctgtgggccagggtgaatactctgccggcagcgtgaagctgaccaacctgaagaaggctctgggtgagaccggcaaggccgagttcgagctgaccggtggcgtcaacggcgattcctggttcggtatttactcgaccgcaaccgcacctgatctgcagggttccaccggcaatgcacaggacttcggcggatacaaggacttcgtgctcgacaacctgaagatcgagcgcatcgagtcccagacccgcaccaaggccgaagcgcaggacaaggtcaaggaaatccgcggcaagtacgattccaagcgtgctgagctctccgatgccgcatggcagcagtatcaggacaccttggtcaaggctcgcgtgctcatcaacaagaatggcgcaaccgctgaggacttcaccaaggcatacgacattctcgtggccctcgacgagtacatgaagaccgctcccggcaacgagagcagcgacaagtacgacgtggcagctgacggctccgatgagctgggtggctacaccgtggccacgggcagcgaagagcctaccgcaggcctgccgagcgaaggcccggccgatctggcacaggatggcaacgacagcacccactggcacaccagctggagcgagaacgcagtcggcaacggcaccgcatggtatcagttcaacctcaacgaaccgaccaccatcaacggcctgcgctacctgccgcgctccggaggtatgaacgccaacggcaagatcaagggctacaagatcacgctcactctggcggatggcaccaccaaggatgtcgtcaccgatgctgagttctccaccaccaccatgtggcagaaggccagcttcgacgccgtcgagaatgtgaccgccgtacgcttgaccgtcctgtcttccgcaggccagagcgactcccaggccaacaagttcgcatccgctgccgaactgcgtttgaccacggaccgcgaggttgaggaagagactgtcgctccggacaagaccgacctcaacgacaccatcgccaaggctaacggtcttaaggaatccgactacacggctgaaagctggactgctctggtcaaggcccgcgaagctgcacaggccgtggcggataacgataaggccaccgcttacgatgtggctctggcgctgacgaacctcgaatccgctatcgctggtctcgagaagaccggtgaggagcctggcccaggcccggttgaggtgaacaagaccgacctgcagactgcagtgaacaaggcaagcaagctcgagaaggccgattacacgaccaactcgtgggaagctttcgccgaggcactgaaggctgcacagcaggtgctcgacaacaagaacgccacccagcaggatgtggataccgcactgagcgctcttcaggacgccatctccaagctggaagctgccaccgagccgaagccgaatccggaaccgggcgtggtggacaaggctgctctgaacgcgaccatcaacaaggccgccgccatcaacctgggtctctacaccgacgactccgccaacgctctgcgcgccgcgctgaagaaggcccgtgaggtctccgacaacagcaacgccacgcagaagcaggtcgacgcagctcgtgaagccctggagaaggcaattgccgctctggtgaagcgtcccgctgccaagggtgatggcaacgttgtttccaacacgggctccgatgtcgccacgatcgctctggctggactgctgctggcaggtgctggcgccgccatcgcctaccgtcgcaatcgcgagcaactgtgaaagcgaggttatagcctaagcagtaataaataaggaataatccttatcctctcggccggcgccgggcagcaatgcctagcgccggccgctttcgtatgtatcagtgttctccagtcacccggcagacatcggaatacgcacgcgatgtcgctgctaggcgatgaatcgcaaatatgtgcggtcatcgaatgattcgtaattcgcagtgaatcctttggtggattggtactcgctgacgagttccggatcgtcgcgcttgagtcgctgcagttcagcctcactggccgcaagcatagggcgcaacagttcgccatgaattcaccctcggttcgttgggtgagcatgccccggttacatgctgacgttatatctgactgtaataccgatgaggctaggaaaaggaacgattatgcagtctgacaacaaccatcatgaatcgcatcacaacgatatgagctacagcaacgactaccaatacgatgtttatatgtatgccgagtatggcatcgagtggtgattgcaggcaaacacgaataaagagagccccgagtgagaattggtgaaccgcaccccgattgttggactgaagtaattcagattcgatgatcggaggtgcggtttctcatgtgtagggatcgcaggcgtcattacgatgacggtttcatgcgggtcgtcgccgacctgatccggggcggggccgggaggcgttctctcgcccgccggcttggcgcgcccgtcagtaccgcgggaaaatgggtgttgtcataccggtttggcggggaggcggcgctcatgggagaacgcgaaggcaacaggagatacgactacgagacgaagctcgcggcggtgcgcgaccatgtggagcatgggctgacgaaggccgaagtcatggagaagtacaggatcgcgggtcccgccccgttggagcgctggtgccgcgagtaccggtccggcggcccggacgcgctgcgtccgaaaccgaagggcaggcccaggggcgcgaaatccaagccgaggccggctcccacaagggaacagctccttgaggaggagaacgcgtacctcaaggcgagggtcgcgtacctggaaaaagtcgacgccctgctggcgtggagatcggcaaccgggacagaacggtgatcgtctccatgctggcggggccgggacatcggctccggcacctgctcagggcggccggactggcgaaaagcacgtattaccatcttctgtcgcatccggccgccgtgacccggccggacatcgagccgatggtcgccgagatattcgcgcgcacgcccaacgggtgcggccaccggcagatacgcatgtgcctcgtgcacgagttcggggtgcgggtgagccacaagagcgtgctgaaggtcatgaggcgcatgggcctggaatgccggatacgcaggccgaacccgtaccggaaatacagctcgtaccgggacgagacgggcgcgagggtggagaacctgctgaaccgcgacttcacggccgaccggccgtgggtgaagctgggcacggacgtcaccgagttcagggtcgccgacggcaaggcgtatccggctcccgtatgcgacatgggatccaaggagatcgtggcctgggacgtcagccggcatcccgacatggcccagcagtggcgcctgctcgccatgctcgaggagaagctgcccgaagacgccgacccgatcccgcactccgacatgggctgacagtaccggcaccggtggtggcgcgaccggctcgcgggactgaacatccgccagtccatgagcaggaaggacaactgcatcgacaacgccgcgaccgagcaggtgttcggccacctcaaggacgagttccacgccggacgcgagttcgcctcatacgaacagttcaagaacgaactggacgcgtacatcatccactggaacaccaaacgccgccagatacgactggagggacacaccccggaggaattccggaacatgtcccccacagcctaatcaggtacccttaataaaccacgtccaacaatcggggcgcagttcagaattggactcacgacctcttccttaccaaggaagtgctctaccactgagctatcggggcatgctgcgttatggcaatctgaatatcatggcatggctttgcgtatcgcgcaagtccgactcgcctttgcgattctcgcgcgcaagtatgtgaggcgaagcgtaactcatcgttgtgcgccgtttcgaggtgacggcacagactccttgttgtctcgattgatgtcggcgatgacggagcggagttcggtaagaaatgcgtcggctgccggagttggcggctggctcttcttccaagcgatggccagatgggtttgcatgggcgggtcgagcggctggaacacaagccccgactcccacgacgtatccacgagaccttgcaggcagatcgcacaaccgtagccttcctgcacgaagcagctggcgttatacaacaggttcatcgtgccgacaatattgagttctttgttgcctgatttgtaccagccggaaagatcacggcgattgagcacgccttggggacgatgaccggcacatccgcgagatccttgggatgaatggattcgcgcgtggcgagcgggtggtcgtacctcatgagcaggcccatcggatctcctgttggcagtggcaggaaatcataacggctcatgtcggtgggttgcacaagcacaccgaagtcggccaggccattgtcaagccgttcaatgatattctgcccatagtcgtcgtgcagccgcacgcggacttgcggatgcttgtgccgcagtcgtgtcatggctcgtgccacgatgcgcatcgctgcgctttgtgccgccgcgatatgtacatcgccggcgatgtcttcgtcggcggtcatctctttttgcgtgcgatcggcgagctcgacgatctcctgcgctcggcggtacatcaagcggcccttctcagtaagttcgagcgagtgggaccggttgccgcgaacgaacaatgttgcgccgacctcgtcttccaaatctttgatttgccgggagagcgctggctgactgatgcgcagcgcatctgccgcagcgctcacgccttcctcctcgaccacggcaatgaagttacgtaggattcgtagttccatgtgtgcctccccgcttattttatatccgatattgcatgtattcatgttctacttttgcatttgtaatactgtttggctgactttactgttgaggcaacagatgcgggcgcgacggtgaatgaagaatcacagggtggctttgagtagctttcgcccgctgctatccaatgatttcagcgaaagaacaacgataatgctcagcaataacgcggtagtggtgtacttctctcgtactggagagaattactcagtcggtgagatcgaagtcggtaatacagccaaagtcgcgcaggtgattgcctcgcgaattggggcgccgaccgtcgagattgtgccagtcgaaccctatccgaatgtgtatgacgaagccgtggcgcaggctacgcaagagcgttctgcgggagctcggccggcgttcacgctggtcgccggcgatggggcggataatcctgcggcgatgcttgactcggctgagactatttacctcggctacccaatttggtggtcggatatgccgatgcccgtttacacattcctggaaagccgcgattggagcggtaaaaccattgctccattctgcacgcatgagggcagtggtctggccgataccgtggcgtcgattcgtcgggttgtagtcggcgcaactgttctcgatggcatggaattgcgcggtgccgtcgcgcagaacgatgttgatgccaccgtgcgagccgtcgatggatggctcggatagcgatggcgaggtttgttgtcaatccggtgacgcattcaagcgtcattgcggtctcagtagtgggacgcaactgcaatgcggcttgatttgcatttgcgtcccacgttgttgcgtcccgcaagcgcaaaatcgacctttttgcagttgcgggacagtgtggattgttggaattccgccattcttgtgatgaggtgctgggagggctgtgggacgcaactgcaaattgagccatatcgcagttgcgtcccactcttatgcggggttctcgattgcgcttaaccgcattgagcggcgtatcaagcggcgagcttggccttgtagtcttcgccccagttccatagagcgtcgatgacggttttgaggctatggccagtgtcggtcagagagtattcgacgcgcggcggcacttcggggtaaacctcgcgatgcacaagtccgtcggcttccatctgtcgcaggttcgaggtgagcaccttctgcgagatgtgcccgattgagcgacgtagttcactgaagcgcttggtaccggtcagcaggtcgcgcacgatgagaattttccatttgtcggaaatcagtgtgagcgtcgtctccacgggacacgccgggagcgtgttgacatcgatcatagcatcacctcgtgtaatcgttggaatcatgcaatagttccttttaggtgactatagcactttaaagtaccttcttcccaaaaagtaagtactccaatatcgtactgtttcaacggcggaagcaccaggttccgccgttgaaatcaattaggcacagcgtgtaacaagcgcaatggattactacataggagcccatcatgacccagaacatcgcagttatcgcagccaacggcaagtccggccagctcattgtcagggaggccgttgatcgcggacttgacgtgaccgctgttgtgcgcggggagaacaaaaccgtcgcccagcacgccatcatcaaggatctgttcgacctgaccgcagcagatctcgccggattcgatgtggtcgtcgacgcattcggcgcatggacgccggaaaccttcccgcagcactccacgtcgttgaagcatctcgcggacgtcctctccagtgctgacgcgcgactgatcgtggttggaggtgccggtagcctgtacgtcaacccggagcataccgtgcagctgagccaaaccgatggcttcccggaggcgttcctcccgctcgccaccgcgatggggattctctcgccgagctgcgcgaacgtagcgacgtgcgttggacctatgtctctccggccgccgacttccaggccgacgggccgcgcaccggcaagtatgtgctggccggtgaggagttcaccgcgaacgaggccggtgaaagcgccattagctacgccgattatgcgattgcgatcgtggacgaagcgacggcggcaccggagaatgcgcacgtcaacgagcgtatttccgtgcgttggtaagcgcgtatatgcgggaagatatgtggaaagcgctcgccgaataagcagcaccccgaaatcaaaacgatttcggggtgcttgtgcgtgtgggcaagatcccaaccttcatggcgactcaggcctgctgccgcttgggttttcggactatcgcgcgctcgccgtgtcgtctcggttgccgcgtccgcggcgtgtcgtgatggggcttcgcgtcattcatgggatagctgcggtggggtggggattcgccatgtgccgcgccggtccgagccggtgcgttcgatcagtttggcttcctgcatcgcccggaacgtgcgccatacggtggtgtaggacacgtccagcgcgaccgccgcctgacggtacgtgatcgccggatacggggaaccggaacgctaaaggaaccagaggggaaaacaagagggtacaaaaagccggaagccctagaaaaaataagggttccggcgagggcggaggatacgagattcgaactcgtgaggctgttacaccaacacgctttccaagcgtgcgccatagaccactaggcgaatcctccatgcactgcagtgcttgctagaagtaagctccgtaggcaactcgaataagctaccacagctttcggataaatgcacattcagtgccggctgcggcgtgtcgctttgtggacaaggaccaccaatgagtgcctgcgctgatgtgcaggtcgttcgtacggcgtgtgcaacaggtgatctcaccgggggatgaaccagtgcaaatcaaagcgactcaaggcaagtcagcaaacccgaggcaaaccagaatgaacatgcgcatgccatcgcgtgaattattgccagcctcttgccgtgatgcaacatagtgattttaggctatgaaccttggtgaaacagttggtcatgcaatatgagggatggggagtggccagtcgcggggagttcataattcgggaagtctcccatctgtgagcgggacaatatcgaatattgagacaatctgcggtaataattgatcgaaaaacagtgcctaatacctcttaaatcctaaaaaatcaagactgttcctcaaaaaagtttttctttatattgagtagttggtttttgattacttagccgcgcagagagagggataggcatggttcgtcgcgcccaggctgctcttcggtccgttgaacacaccagcgtgaggcagctgcgagtcctggctgcgattgtatttctgttcgccatggtcatcgccactgtggctcctgcagtcacggctccgatggccttcgccgacagcagcaccagctcgtccagcgttgactacgccacctgggccgaagtctccaaggcgatggacaagcagctgaacagcggtcttgagacgtacaaggatggcaacaccgctggcgccacctccgatttcatgggcgcgtacaacaagatttacgtggcctccaacttcaccgcggtcgtgcacgacaccattggcgcggacaagcagctcgcccaacagcaggcattccaaagcgttcagaatctttcctacacgcctagcaacgacgatcaactggctcagcagattgatgcgttgaccgccgatcttgacgccacggcccagcagctcgacgccaacgccgatctcgccaagccgaaggcgtacgccgaagcgctgcaggcgcagctggccaaagagcgcaaggagctcgacgccaagaaaaagaagaacccgggcaagggcaatcgttcatggaccgacgtggccaacgaaatgaccccgattctcgacaatgcatacaaagcttacgaaaagggtgatggtgccaagggcgccacgctcgtgaacaacgcgtactaccagtattacgagaagctcggcttcgaaaagaacgtgatgaacgccatcagcggcaaccgcgtctcgcaggtggaataccagttcaagatgtgccgcaagtccatgaacgccggcgcatccctgaaagacaccaagaagctgatcgacgacctcaaggccatgctgatcaaggacgccggcattcttgacggtggtgccgccgataaggaagacggtttcaccaagctggtcaccagctcctccggccaggcgttcctcgtgcttatccgtgagggtcttgaagctctgctggtggttgcagccatcgtcgcctacttggtcaagtccgataacaagcgcttcgtcaagtggatttacttgggtgtgctcgtcggtctgctcggcgccggcttggtggctgtgatcttcgtgttcgccttcggcggctccggcccgattcaggagatcatggaaggcacctgcgcactgatcgccatgggcatgctgctgtggacgagtaactggatgctgaacaagtccagcgtggaagcgtggaaccgttacattcgcaagaagaccgaggctgctgtggctgatgccgaagccgccgcaagtgccgacaacgtgacgttgaaaaccgtggtctcgctggctatgctgagcttcctcgccgtgttccgtgaaggcgctgaaaccgtgatcttctacgagtccatctacacgatgagccgcgatactcgcggtatgtggatcggtggtctgaccgccgcggtggtgcttgtcggcatcttcctgctcttccgcttcacctccgtgaagattccgattggtccgttcttcctggtcacttcgattctgatgtctgtgctggtggtggtgttcgccggcggcggcgtccactcgctgattgagggcgacttgctgcccgccttctacctgaacggtgtgccgacgaacgattggcttggcctctacccgtacgtcgaatgcctagtggcgcaggccatcgcagccgttgcggttatcgcgctgttcgtggtcggcttcatcaagcagcgcaagctgaaggcgcaggctactgccgaggtcccggccgtgaaggcgtagcccgtctagctcgtccgtttcctcccataactgcagacaactgacagacttgcggcacggcctcggatcgatgccaattcctccagcccacgccgcacttatctcataactgaataattgcaattatctaagcgtgaatcctaattcaccagagatagagaaaaggaataacaatgatgaagaacaagaaactggccgctctgctcggcctgctgctcgccggttccatgaccgtgtccatggctgcctgcggttccaccaactccgcatccgacactaaggctgactcctcctcccagtcttccgactcctcttcctccgattcttcctccgattccggcgccggtttcgaagaggttccggttggcccgtccggtactgctgaagagcaggatcaggacgccggcccgctgaccgtgggcgctgtgtacttccagccgatcgatatggagccgtcttccatgggcctgaaggctgctgacgcttccttccacctcgaggccgacatccatgccaaccagaagggcaccgagctcggctacggcaagggcgacttcgtgccggatctgaccgtgaactacaccatcatcgataagtccaccggcaaggaagtcgagggcggcaccgccacctccggtaccttcatgcagatgaacgcttccgatggcccgcactacggcgccaacgtcaagctcgacaaggctggcacctaccagctgaagctctccatcgaatccccggcctccaagggttggatgctgcacgttgacccggagaccggcgtcaagggccacttctggaccgagccgatcgaggtcaccttcgacaactgggattacactcctcgccagtggtgattgactaagcagaaagccccctcgtcagaggggctttacgccgctttagggagataattcttaggacggtctaaaactcccctcagtccgcttcgcggacagctcccctcagagaggggagcctaaggtgaacagagaaaggacgcgaatgcttgaacaattcgtggcagtgatgccgggcactttggcccccgcattgctggtgatgagcctgagcgtgatgctcacggtcggcgaggggcgagataagccgataagctcgcattggcgtctcatcggcctgatcgtcggtctgatcgccgccatcgtattcgccggcctgcgcgcctcggccgtgatcaatcagcgcacgttcgtcaactacccggtgttgtggtgcgcgatcattgccgacatcctgaccatcgtcgtggtggtgttcgcacgccgcatcaccaccaattggcagcagcacaaggtgttcatgcacatcgctaacgccgtggccgccatcgacatcgcactcaccctgttctacgcgctgccggacgtgattctgcagctcaccatctgggtggaaccaggggagaccgcattcacttcggccatgctgctgcgcgctcttggtttcctgcttggcgtggccatgtccattattgtggccgccatcttccgcacgatgcgcaccactgccgtgcgctgggcgttcaccgtggccgtcgcggccatgatggtgattctgctgattcaacacttcactggtcttgcccagattctgcaggcgcgaggcttcccgatgaaccatacgatgttcgtggcgctggcttggtccatcaaccagaactccacgatgattatggcgcaggcgctggtgttcctgattcccgccgtggcctccatcgtggccggtttccgtatgaaaacccatgatgtgccgggagccaacgaggccacgttgcgccggcataaggtattccgccgccacgccatcgccgctgccgtgtggagccttatcgcagccatcggcgtcacagcaaccctgaccgtgggcgttgccgcgacccatcagaccatcaccctttcgccgccggaagcctactcgctcaaggacggcgtggccaccatccccttcagccaggtcgaggacggccacctgcaccgcttcgaatacaaggccaaggacggcaccgtcatgcgcttcatcatcatccgaaagaacggtggcgcgtacggcatcggcctggacgcctgcgagaactgcggcgacgctggctactacgagaaggacggcaagatcatctgcaagaagtgcgaggtggccatcaacctggcgaccatcggcttcaagggtggctgcaacccgataccattcccgtacaagaccggccacggcaagatcaccattcaaactacggatctggacgcgctgagcgcccacttccggtgagtcaggcaggagacaagaatcatgttctttctgcgcatgattactcgctcgttcacccgacagctgcgccggcgcctgcttatcgcgctgaccgtatgcctgtcggcgaccgtgtccgtatcgatgctgggcgtcgtgttcgacgtgggcgacaagctcaacgccgagctgtccacctacggttcgaacatcaccgtgcagcccaaggcggatgcggtcgtttccgacctgtacaacaccgagtcgggcggcgcgacgtccaccagcgacccgaccgcttttctgaaggagtcggacgcggccaagatcaagacgatcttctggtcgttcaacatcaccagcttcgcgccgcagctcaacatccacgccacggtgaacggtaccaacgtgccggtcgtcggcacgtggttcaacaagaacctcaagatctccaccggcgagactaccgtcgtgggcgtggaaggcatgcgctcgtggtggcagctggacggcaagtggcccaaagacgattccgaccagggcgtgatcggcaagacgctggcctccgaactcggcgtgaccaccggcgacaccatcaccctcaacaaaaccaccgcctcaggcaagaagaacgagcagaaaatcaagctcaccggtgtctacgattccggcgacgaggacaacggctcgctctacatcgcctcctccacggcccaggtactcgccgacctgcccgattcggtcgacaaaatcgaggtcaaggccctgaccacgccggagaacgacctggcccgtaaggccgccgcgaacccggccgcgctgagccaggaggaatgggagacctggtactgcaccgcctacccgagctcgatcgcctatcagatcgaagaggtgattccgggcgcggtggccaagcaggtgcgtcaggtggccgcgttgcagggcaatgtgctgcaaaagacgcaggccgtgatgattctgatgaccgtgctgagcctgatcgccgcagccgtggccgtggccaacctgatggtcgcctcgatcggcgaacggtcgggcgagctggcgttgctcaaggcgctcggtgccaccgatgccgcggtatcccgcctgatgctggccgaaacggcggcaatctcgctgctgggcgcgattgtgggcgcgctgctcggttccggcgtggcccagctgataggccgggtggtgttcggttccggcattacgatgcggccgatggtgttcgtgctggtgttcgtgctgctggctgtcaccgtgctgctggcgtccgcctcatcgattcgttcgattctgaatctcaagcccgcggaggtgctccatggtcgctgagtttatctacgtaggtgtggaaggagggaaccgatgaccaacaccggtatgttcttcagaatgctgttcagcgccgtgttccgtcggcgttcgcgcgcggtgatggctgtggtggcgtcgctggtcggcgcagccacactgttctgtctggcgatgatctgcctcgccgtgccgcagcagatgaacgaggagatgcgtgcgtacggcgcgaacctgattgtcacgcccaccgaatcgaccaatgctgacggcaaggccggcatcgacaaggcgatggtgcagcacaccactgaaatggtcaaggccaagggttccgcgaaatacgccacctaccgctacgagaacgtgcgcgtcaacgcctcgccgtacgttatggccggcgtgaatgcggcgcaggtcaagaacctcaaccatcactgggtggtcgacggctcgtggccgaccgacggcaaggtgctggtcggacgcgacatcgccgacgccatcggcctgagaatcggctccgccatcaccatcggctaccgtgcatccgataacgccagcaccaacggcacttcgtcgaactcctcgatcgaccagcaaaccaaagacggccgtgtctccagtgacatcatggacacctccggtaccgaattccgcgtggccggcatcgtggacaccggcggcagcgaagactcgatcatctacgccaccaacgccgacgtcaacaagctcaccggcatcacgcgcggcgtggacgtcatcgagtattcggccggcgccagcgacctcgcaggcctggtgtccagcatcaacgacatgacctccatgcacgtcaaggcacagcagatcaccaagatcaccgcctccgacacccgcatcatcaccatgctgcagacgctgttctggatcgtctcgctggtggtgctggtgctgacgctcgtcggcgtcggcaccacaatcagctcgatcgtctcgcagcgacgcaacgagattggcctgcgcaaggccctcggtgctagctcgcgtgccatcggcaccgagttctacatcgaatcgtcgctctacggcctgattggcggcctcatcggcaccgcaatcggctacggactcgccagttggctgtgcgtggcggtgttcgaacgctccatcgtattcaactggtggctggccctgatttccgtgctgttcagcgcgctggtcgccatcgtcgcctccatcccgcccgtccaccgcgccacccgcatcgaccccgccgtcgtgcttcgcgaagaataaagaaagagaaacgtcatgctacttgaactcgaccacatctcgaagatctacggcgacctgcgtgccgtggacgacctcaatctgaccgtgccggaaggcgaatggctcgccatcgtcggctcctccggctcaggcaagaccacgctgatgaacatgattggctgcatggacacgccctccaagggctccgtgaagctggaaggccgcaagctggaggacctgaacgccacgcagctggccgacgtgcgcaagaacctcatcggactggtgttccagaagttctatctggtgccgcacctgaccgccgtggaaaacgtgatggtggcccagtactaccattcggtggtcgatgagaagcaggccatggaggcgctggaaaaggtcggcctgaaggaccgcgcccaccacctgcccggccagctctccggcggcgagcagcagcgcgtgtgcgtggcccgcgcgctgatcaacgacccgaagctgattctggccgatgagcccaccggcaacctcgacgagaagaacgagaaaatcgtgctcgacctgttccgcaagctgcacgagcagggcaccacgattatcgtggtcacccacgatgcgctggtcgccagctgcgcgcagcgcgagatcatgctcaaccatggcgtgctcgtcggtgagaagtggaatgacgaggatgcgcgcaaggcctacgaggcggccggcggcaagcccgcctccacgggtgcacaggtcgagggcgcgcagaacggcgagaccgccattggtttcactgaccccaccaaggccgcgaaaaccggcggcgaggagtagggccgtcaggggcatcgagcagtatgtgaggaatacatggcaagctgatggtctctcccccagtcagcttcgctgacagcccccctcgtcagagggggcttaaggagcgtgaatatgaccgaaaagagtacgttgaagaaatccgcgacattggcggcggccggactggtcgtggctggcgcgctgctggccggatgcggcgaatccaaggccgcgccgatggacgatgcgtacgccggcaactcgggcgagaccgagaagtcgcaggaagagcagtcgcaatcccagtcgaacggctccgatagctccgacggctccgattccagctcgtcgcacaacgacccgtccaccaccacgtccgacaagaaggacaccggcaactacaaggacggcaactactcgatcaacggccagtacggcccggtaggcgaggattccatcgacgtccatctgaccatcaaggacggcaacgtcgagaccgtcaatatcattgggcacccgttcaccacgatttccaagaaccatcaggacgacttcgccaaagccattaacggcgtggtggacggcaaacctctgaagggtctcaaagtggacaaggtcgccggcgccagctggacctccgacgccttcaacaaagccctcgaagtcgcccgccaggaggcttcgattcaggagtaagaccgctacttcagcaatgctggccacagcagatcggccatgcgcgaggcccaggcggtgtcgtcgtccattgctttgccctcgatggcctcatacgccaccaaagatccgataatcgtggacaacagcaacttctcgtcaacgtcctcgcgaaacacgccctgcgcgactccctgcttgaggaacgcccccacacgctccagccacggggtcaccacttggtcgacgatgtgctggaagaactcggcctcgctggacaatacaatgcccacgcgcttgacgtcgatgtcgttgtcgcgcacccaatcgaccaatcgctgcaatagttgcgtgaaatgctcacgcgtggggctgggcactgggtcggaatccgggatggccagatacatcgcgctgatctcgtgcagcagctcgtcggcattatgatatcggcggtaaatcgtggttttggccacaccggagcgccgggccacctcctcgatggtcacgccgctgatgccgcggtccaccgcaatctgcagcgtggctcgcatgagcttgcgatccgtcgcctcgcgcgtgcgctcaccgcgcggtgtcgccgtcgtgtctgtcatctccgtcatctcttctcttcgaaatatgctcccgtacgctcccgctggcgagagctggctggcaaagccagactgagggtggtaagtccatgccgtttgtaggcaactcccggataatacctactagctcagcactttagtgctctcgacttgggctacataccactggttgaaccgcaccagtggcttcctgagcaacagcccaagcaacagtagcggcggcacgaatgccagcagcattccggcggcccgccagtaatccatgtcgtagatgccggcgatggccgcacgcatcatcgtcaccgcatgggtgagcggcaagagcggactgactttggcgatgaagtcgggcaacatctgcaccgggtaggcagcgttcgcacccgaaatctgcacgatgagcataagcacgccgattgccttacccacattgccgaaactcaccaccatcgtataggtgaagaacgagaacaccagcgaggccagccatccagacaacataaacagcagcggatgcacggcctgcacgcgcaggaacagcaaatcgccaccgagcgacaccgtggattgcagcagcgcaatcagcgcgaacaccccgtaatgcccaaggaagagccgatgcggccgcggatcgcccaatgctttgcgcgtccggcgagacacggtggttttcagcgtcaccaccatcagcagcgcgcccacccacagcggcagcagcgtgtagaacggtgccatcgacgaaccgaaattcgccaccgggaatacggccttgcgcctgagctgcaccggtgcggccaacgtactggccagcgtttcgggatcattgcccagcacctctttgaccatgcccatatcgccactgtttagtgcgtcgctcagtgtgctgttgaacgaagccagttcggcgccggcggaacgcagtttgccggacaccttgtccaaggtagtgcgagcgtcgctgagcatatcgctggcgtcgtcggaagtccctttcaggtcgccgagcgtggagtccaactgggtggcgccggaactcagtatgccggaggcgtcagcgacggtggacgacagggagtcgatttgcggtttcaccgtggccgagaaatctgacttgatattggcaatactgttctgcgcttgatcagccagattcttgacctgcgcatgctgatcctgcgcgtcctgattgccttggcgaatatcggtcgccgccgtattcagcgcttgccgcagcctgttttgtcgtgcgattgaacggtcaatcgccgtgatgatggatgagtcgttgcccagtatgccggccaacgtgttgcgaatttcagtgtatttctccgtctgcttgccaatggccgtggcttgacggtccaattcgtcggcgaccgtggtggcaccatcattcgcgtcggaatacagcttgtctatggaatcggacaccgcgccgaaactggaggcgctcgcgtccagtgcgctgctcatcgcgtcagcggtggtgcccagggctccggccacgtcggtgacttcctgtttggcgctggcaagatccttgccgccttgtttggcggcagaggaaacctgagtgattagtgagttcgaggtgtcgagcaaggcgccggccgtatcggtcaatgcgctgtatgtgccaagcagatccgcagtatcgtcaagctgtgtggcgaaattggcgatgttggcgttgaaggtattcagttgctctttggcctcgggcttggacagctgatcggccagcgaagacgcgatttccagcccggccgaagtgatggtcttagcgaacgtggtgttgatttccgccgcaacctcatccgtgccctcgttgagcagattcggtgccagcgcgttcttcttctcgttgcggtaataggtcagttcggcatgctgcacgtcgtcggagaagaaggtcatcatgtctttgctgaacgacttcggaattacgatggccgcgtagtatttgccggatcgtgcgccctcgacggcatcggctttggacgtgatcgtccaatcgagctgactgttggcgcgcagcgcgttcaccacctgatcgccgaccgtgactttcaccgggatcaggtcggaacgatacccctcatccacattcgccaccgcgaatttcaggttcttcatattcgagaacgggtcccagcatgcggccacgttgaaccaggtgaacaggccgggaatcatcaccaagccgatcacgatgatgatggagaccacgttgctggtcaggcgtttgatgtcgccggtaaacagtttccacatggtgttcatcgtgcgtgcctgccttccttggtcggcggaatagtggggatgattgcggtaacagcggcgctcgggtccgcttcttcgtggcgttcggcggaggtgtcgcgacgcttggccttatgcccgtacagcatggcgcggatcgactcgtcggagaggctgccgagctcggtttggcggcggatggaatcgcgcatgaattccacgaccatcaggaagcccatgatgatgagcacccatgccagccatgtgcccatgactacgattttctcgctggtggtcagcgcaaacacgataatgagcgcggccggcaccacgaatccggcaataagcgcacccagcagcagccggggataacggtaggcgaatttggcggcccgacgttcgatggcatgacggtattcgtcgtggtcggccagtgctgcaatggcctgagtgacacggtattcgctgccgggcagatgcaccggctcgccgataatcatgtcgctttccttgatttcccgcgcgaacaggcggttgagattggccagtttcggccgggcgccgaggccaagcgcaaaggccagaaccacgaaaaccagcaatttgccgatataggcgaaccagaggccgtcgtagaagccgccgatggtttcacgcatcgcgtcaatcgaataggtgaacggcagcagcgggtagatggcgcggaagaacgcgggcatcatttcaatcgggtacaggccggaggcgcccggcacctgcagaatgaccagcgccacgcatacgcctttgcccacgtgcatgaacgtggtggagagggcgaaaatcaccgacatatacaccagtgaggtgatgacgcaggtgagcagaaacactggggcgctcgcgcattgaatgccgatgacaagatcgccgatggccgtgaccaggccttggacggcagccagcgtggccagtagcaggaagcgaccgagatagccttgggttggtgtgagatcgtcgatgccctcatcatcggtttcgagtttgggaatgaccacgagcacgaacgcgcccacccacaaagacagggtggtgaacagcggtgccatgccggaaccataggaggcgaccggatagacggcctgttcgctgataacagtgggggagagcatgaagtcggcgattgtggcggcatccagtttgccgtcggtgccgatcagggaactgagtgaactggagatgctcagggctttgatgtcggtgaccagcgtatcgagcttggtttgtacgccggccagcgccttatcggtgtcgcgcagcgcggtcaccgtggtggaggctgctttgtcgagttggtcgagggtatgcttcgactgatcgatgagtgagccttgcgacgtgatgccggtcgacagagtgctggcggtcgagctgagggcgttgagaccggtgttgagctgaggaatggcgccggaggtgatggtgccgcgagcggtattggcctcgcgcaccgtggtttgggtggcggtattgagatgctgcgccaatccggcggtgtctgtggaggcattgccgatagtggtgttcaggctatcgaggttgcccagtgcgccggcaagctcgctattgcggctttccagtgtggcaatggcggattgcagcggttctcgattggcgttcggcagccctttgagttggtcgatgatgtcggcgttcgcttggttgatgtcttccgccgtattgatcagtccgcctacctgctgattggcggcgctgatggttccggttaccgtgcccacgctttggttggcctgtgctgcggcttggctcagcaggcttgagccttggtcaagcgcttcggacgtggaggtgacgaagccgttcagactggtctgggtagtgccgatcagggtggagacgccggccagaccttctgcagtgtcgatgccaagtgtgcgcgcgtcgtccagcgcctgacgtgcggtgcgtgtctgctctggggtgtcggtgagtttggtggtgagcttggcgatggtgctgcgtgtgtgctgcacatcgtcggaggccttggcaagggccgtgagggccttggctttggtggtgtcttcggtactgatggctttgccgtcaaccgtattgatgacttcggtaagtacttcggatacggtggagacgaatgtggaattgaccgtgcggtccacagtggacgcgccgacgtcggtgactttgggggcgatggcgctggctttttcgttgacgtaatactccagagtgggccgactcttgccgccggtcaccacgccggcgagatcgtcggaaaagtctttgggaatgatgatggctgcgtatgccttgccggattccacttggtccatggcctcggcttcggtgacgaaggtccagccgagctggtcgttgcttctcatctgcttgacgatttgatcgccgaggttctgcttgccgatgagcgcgttgtcggtgccgtcgtcattgttggcgatggcgacggtgatgcctttggtattgccgtacgggtcccagaagccgacgatgttgtaccacgaatacagtggcgggatgaacaccatgccgaacaggatcacccatgcggccggcaccttgaacaggcgcaggaagtcgcgtctgaggaccttgaagatattgcccactgatacctccggagcttggtgttgcttggttgctacgttttccgtagcgatacgttaatcgtagcgctacgtttgtagtagcgtaatacggctgccggagattaatggggtgattgatgatgtttttggcggaataacgctgctgcccagcggcttatcgtgtgtcgctgggcagagcgaaaggcgttctggaacttattgacaagatttctggatggtttttggacgtttcctgaacgcgatggataggctcggtgctcggcaatgtagacagacatgtaccgaccgcccatcaagttcagcaaaaccgcaatcgggtgatagggtgaggggacgctatgtggggaggaaaccatggttgaattcaaggacgatggcacggccactacccccggcaagccgcgggagaaccgtgacgccgagtccgcagtcgtggccgatctggtggccgtcgaactggacgacgccggcttgaacctgaacgccaagcgattaccgattctggcgcgcatctatggcgcggtcgtgctgctggacggactcgccacattgccgattatggtgatttccatcctctatgccgtgcgcgagattctggatggtcatgtgcacgtcgatgcgatgagcctgaccttcatcctgtccgcgattcatgcggtggtgctggtagtcagtgccgcatgcctgattgtgctcggcgtgatgctgctgcgcaatcatcgccggtatgccgcgcgctggacctacgtgctgatgccgttgacgttggccgacggcatgctgtcgctggccctgaccggccttggcttcaacctgctgctgccgctgattcagatgattattctcgtcgtgatttcggtgaccgccgatccctccctgagcgaggaacgccgtctgcagcgcgcgctcaggcgtatggacgatcgcgatgattatgaatcggctgtggcggccggcatgctaggccgcgaccagtccggcaagggctatattgcgctggactttttcaatatcttctggctgtttaccatcgcttcggtgggtggcctgattgtggagacgatctaccatatggcgctgtataacggtgaacttcaggaccgcgctggtttgctgtggggcccgttctcgccgatttacggctgtggtgcggtattggtaaccgtgtgcctgaatcgtctgtggaaggcgaatccgttcttgattttctgcgcttcggcggtgatcggcggcgcgttcgaatattgcaccagctggttcatggaagcggcgtttggtattaccgcgtgggattacaccggccgttggctgtccatcgacggacgtacttcgggccaattcatgttcttctggggactgattggtgtggtgtggatcaagtggctgttaccgcgactgctggctctgattaatcgcattccatggaaagtgcggtattcgctgactgcggtatgcacggtgctgatggtgatcgacattgccttcacgctgatggccttggattgctggtatgggcgcatggccggccagccgcaggattcaccggtcgcgatgtggttcagcgaacgctacagcgacgcttacatggccaatcgcttccagaccatgcatatcgacccttccaaggccgggcgtatgtgaatggccggcaagtaattacgcttcgcgggcagaaggtgcgtagaacctaagacagccctcgcgtgtgggtggtaagcgggatacactttcaagcgttgaaggaatgattccctccgctgatgcgctgttttgtgacgcgcgtgatgacgatgggacaatcaaacgaaaggcaaggcacatggccgaagctacagcaaacattggtgtgattggactggccacgatgggctccaatctggcgcgtaatctggcgcaccatggcaacacggtggcgttgttcaaccgccactactcgcgtaccgagaagctcatgaacgagcatggcaccgaaggcaacttcgtgccggccgaaacgctcgaggaattcgccgcgtccctgaagcgtccgcgtaccgccatcatcatggtcaaggccggtgctccgaccgacgcgaccatcgcgcagctggaagaggtgttcgaaccgggcgacatcatcgtcgacggtggcaactccttcttcaaggacaccatcaagcgtgagaaggaagtacgtgccaagggcttccacttcgtgggttgcggcgtgtccggtggtgaggaaggcgcgctcaacggcccgtctctgatgcccggtggcactgcggaatcctggaagaccttgggcccgattcttcagtccatcgccgccaaggtgaacggcgaaccgtgcgtgacccacatcggcaccgatggtgccggccactttgtcaagatggtgcacaacggcatcgagtatgccgatatgcaggtgattggtgaggcgtatgacattctgcgccgtggactcggcatggatgccgaggagattggcgacgtgttcgctgaatggaacaagggcgaccttgactcctacctgatcgagatcaccgctgagattctgcaccacaaggatgccgagaccggcaagccgttcgtggacgtggtcgtggatcatgccggcatgaagggtactggtacgtggaccgtgcagactggtctggaatgtggttctcctgtggctgccatcggtgaagccgtgttcgctcgtgcactgtcttcgcacggtgagctgcgtgaagacgctcagaaggaaggtctggctggaccgaacaagaccatcgatctggccggagaagacaaggccgcgttcgtcgaggacgtgcgcaaggctctgttcgcttccaaggtcgtggcctatgctcagggcctgaacgagattcaggacggtgccaaggaatacggctgggatatcaacctgtccgaagtggcccgcatttggcgtggcggctgcattattcgcgcccagttcctgctcgaccgcatcaccgaggctttcaggggcgataacccgccggcttccctgctgttcgatccgtacttcgagaagatcatcggcgaatcgcaggatgcatggcgtcgcgtgatcgttcgcgcggtggaggccggcatcccgaccccggtgttctccagctccctggcgtactacgatggtctgcgctccaagcgcctgcccaccgctctgacccagtcccagcgtgacttcttcggtgcccacacctacggccgcgtagacaagcccggcgtgttccacacgctgtgggctgaagaaggcaagcctgaaatcgaggcgtagcctcgtgatttcaggtttaggacagccctgtgggctgtccggccttcttcaggctcggcgatagccgagctgagaaaacagcaagcccgagatcgaggcgtagcctcgcgatctcgggcttaggggagcccggtgggctccccggccctcttcggagcgaggcggctatgccgccgagccaacactgagcctcgccgcaggcgagtccctaattgcaggggccggcggcgaagagggcaagtccgagattgaggcgtagccatagacgaattaagccccctcatcagagggggcttaattcactcacaactcggtgacggtttcttcggtggagaaccagatgaactcgtccactccgttggcgtaggaggacgggtaatccggtttgttgggctgctcgaagacatgggccagcgattcggctttgccggcaccggcggcgaagaaccacgtatggcgtgaacgcgcgatgagcggcgcggtcaatgaaacacgcagcggcggcatcttgggggagtggttcacacccacggtgagcctatcagtaaccttgacctcatcatgaccagggaacagcgacgcatagtgaccgtccggtcccatgccgagaatcatcagatcgattaccggttccggccccaattcattcaccaactcgcgctcatagtcgctcgcgacatcgtccagcaacgcatcattcgcggcatcggcggcggcgcgaacggaagcatcatcgctgtcggcctgatccatcacatcggcgatgtcatcggctgaacgggtatcggccgccatctcatgaatattcgactcaggcagcttgccatctgccaccagctggtcaagcagcaggcgacgggcctccaaagcattgcgatcggtgtcgtaagccggcacaaaacgttcgtcgctccaccagaaatgcacgcgcgaccaatcaatcgcgtcagccagcggatcgttcagcaccaagcccagcggctgcgcggccgaaccgccagacagcgccacatccacacgcgtgcgatgcgtgccatcaggcaatcgttcggcgagcaaatcgagtagcgccaagacaaaacgttgcgcgccagcctgaatcatcagatctttattcggatacacaatgagttttcgagttgccatgtatggtccttgtatggggtatgtgtcgtactttgcaatgtggattgtgttgtcagttgacaacacaatccacattgtgcgacatcgcatatgtcactttattactccgcgggcatgagcttcggcatcgcatgaggtaggaaacgatgagcaacggcgttggcatggctcggccacaattgccgaactcattccaacgccgctgtggcaacgggttctaccgacttcagtgacgaatcagatcccagccttcgttgatgacctcggcgtagatctcatcgggatcgatgcgacgcagttcctcggtcaggcagtcctcgatggtgcgcatcggcacggacacttcctgcggagtctggccgggcagcgagatcagcgcttggtcctcatacgggcgttccagcgagatcacaccgtcctcacgggtcaggtacacgccggtcacggcctgcgcgtcgggcacgaactcagtttcgactggtacgccaagtttcagacgcagccatgcgcacagcatttctataggcaggaagtcggccttgccggtcaccttcgcggcggtgatgggcaggtgcggcggctgatcgagcatcgaggcgagcattgcgcgccagacggtcagtcgtgtccaggacaagtcgatatcttccggtgtccaattgcggcgcaaacgctcaatcgtggcctccggattattggagtgcaacgcgtcggtgatgcgactgcgggccatcgcacccatcagatccttggccgggttcgacggcggtgtggtcggccaccacgccactacaggcgcatccggcacaagcagcgggataaccagcgtatccgggtggttgataaggccaccgcgcggacgcaagatgatgatctcaccggcaccggcgtccgcgccgaatcgcacttgggcgttcaggttggaatcgttcggatcgttcgggccgtcggtcaaatcgacggccggattatcgcgactcgcgctcacctcggcggccacttcggccgcgttcggttcgccttcgccggactgatcggcaggattggtatccggtactacggcaatcacgcggcacgggtgctcacggctggccgagttcgcgatttccagcgcatgctctaggtccgcgtcctcggtggcgatgagcagcgtcagcacgcggccggtcgccgattcgccgcgctcctcgtgcagctgttcgattttgtgcgcaatctcgcgggtgcgggtgttcggcatatcgatgatcatggcatcctccagtggcggccgtcgcgcgccagcatttcgtcggcctgtgccggaccccacgtaccggcgcggtaggcctgcggctggccaagcgtggaccagaattgttcaatcggatcgaggatctcccagctgaggttcacctcttcggtggtcgggaacaacggcggatcaccgagcagcacgtccagaatcagtcgctcataggcttccggcgagttctcggtgaaggagcggccgtagctgaagtccatgttcacgtcacggacctccatggtggagccgcccggcaccttggctccgaagcgcatggtgacgccctcgtcgggctgcacgcgaatcacgatggcgttcttgccgagttcgcgcacggcggtctgctcgaacggcagatgcggggcgcgcttgaacaccacggcgatttcggttacacgcttgccgaggcgcttgccgcaacgcaggtagaacggcacgccagcccagcggcgggtgtcgatatcgaggcggatggcggcgtacgtttcagtggtgctcttggggtcgatgcctttttcctccaagtagccgaccacttcgtgcgagccctgccagcccttggcgtactggccgcgcgcggtgttggcggcgaggtccttgggcaggcgcacggcggaaagcaccttggtcttttcggcggtcaggtccttggcggtgaagctcaccggctcctccatggcggtcagagccatgagctgaagcaggtggttctggatgacgtcgcgtgcggcgccgatgccgtcgtaatagccggcgcggccgccgatgccgatgtcctcggccatcgtgatctgcacgtggtccacatagttggcgttccagatcggctcgtacatggcgttggcgaaacgcagggccagcaggttctgcacggtttccttgccgaggtagtggtcgatgcggaacacggagctcgggtcgaacacttcggataccacgctgtcgagttccttggcgctggccagatcatggccgaacggcttctcgatgatcacgcggcgccatgcgccctcggacgagcgcgacaggccggaggcggccagctgcttggcgacctgtgggaatgcgcgcggcggcaccgacatgtagaaggcatggttaccctgcgtgccgcggtcgcggtcaagctcctgcacggtggcgctcagacgctcgaaggcctccgggtcgtcgaacgtaccctgcacgaagcggatgccggcggccagattgcgccaagtcgactccttgaacggcgtacggcaatgcgcctggacggcggccttgacgaattcgatgaaccgttcctgtgtccagtcgcggcgggcgaaaccggtcagaccgaagctcggcggcagtaggccacggttcgccaggtcgtagacggctggcagtagtttcttttgtgccagatcgcccgtgacaccgaaaatgacgaggctgcatgggccggcgatacggggcagtctgaggtcgcacgagtcgcgcaggggattgctccaattgggggattcactcataatgtacaagggtagtcgccggcggctatctatcgctagaggcgatatgcgatttgggctgcgatttgggccacattgcgtgtgctgtgccgtgcgttgggccaatcgcgtacgcaaacgtgtacgcaacgccgtagttgaaatatcccaaaacggtgtgtattttagaagagttgcccctttagctcaacggttagagcagcgtccttttaagtcgtgggttgtgggttcgaatcccacagggggcacaacaaatcctcggaatcgcaatggttccaaggatttttttgtttcgaccagcctggctcctagagtggtgtcccatgtcatgcaccacgattcttgtcggcaaaaatgccagttacgacggttccaccatcatcgcccgcgatgacgattcgggctcgggccgttacgatcccaagcgcttcgtcgctgtcgcccccgacgaccagccgcgccactaccgcagcgtgctgagccatgtcgaaatcgaactaccggacaatccttgccggtacaccatcgcaccgaacgtgctgaataatcgtggcattctggccgaagccggtgccaacgaacacaacgtggcgatgagcgccaccgaaaccatcgctgtcaacgagcgcgtgctcggtgcggacccgatggtcgagttgcggccggctgtcggcgaaccggacagcaccgattatcaggccgagcagcccggcggtatcggtgaggaagacatcatcacccttgtgctgccgtatgtcaccaccgcgcgcgagggcgtcgcgcggttgggcgaactgctcgaaacctacggcacctacgaatcgaacggcgtgattatttcggatgtggacgagatctggtacgtcgagaccatcggcggccaccattggatcgcccgccgagtgcccgatgactgctatgccacgatccccaaccagctcggcatcgacgacttcgacctcgccgatgcgttcggcgagcagcgcgaatacctatgcagcgccgacctgcgcgagttcatggccacgcatcacctcgaccgcacaatgggaacgccggtctcttccaacggccgtcacgcgcatagcgccggattcggaacaaccgttgcccttcccacccgtttcaacccgcgcaaggccttcggcaccgcgacgccgaaggaccatatctacaacacgccgcgtgcctggtacatgcaacgccgcctcaaccccagcgaggactgggattcgccggccgcccgctacacgcccgaatccgacgacatcccgtggtgccgcgtgccggaagacaaggtgagcctcgaagacgttgatttcctgctgtcctcgcacttcgaaggcacgccgtacgacccgtacggcacgaccggcacggcggaatcgcgccaccgttaccgtccgatcggcgtgaaccgcaccggccatatggtggcgattcaggtccgtccgtatgtgccggcggccaatcgcacggtgatgtgggtatcgttcggctctggtccgttcaccgccgccgcgccgttctacgcgaacgtcaacgacacgcctgcctacctgcgcgacaccacgcccgaagtctccaccggcaacctgtattggacgaaccgcctgatcgccgtcgtggccgacgcacactggtatgagacgaaccggttcatcgaagggtatgccgagggcgtgcgcgcgttcggacaccggctcatcgagcgcacggatgagcagttgcttgctcgaagcgatgccgaatcgacggatacgaatgcatggccgctcgatggcggccacggcgatgagaaggatgtgcagggcgtggcggatgtgctcgaagcggccaacgacgagatggccgactacctgcgcgagcacacaaccaagctgctgaacgacgtgctatacacctccagcaacctgatgcacaacagcttcgcgatgtccgaccgttgggccgagtagcaaaacctcgactggggaggtaatagggatgccctgctgataacgcgtcagcagggcaaaaccacaatccgaatcagttaaagccgacgatgcgtttggcgatgagatagccgttgcgcacgatccagcggccggttttgccgggcagattgagcgcgcgggacatcagctgcgagcgcacatccttgccgatggccggcgaataggcgtcaatcgcatcccacagctcggttttcttaacgtagttggccggatcgcgcgagagaatcaggaacgtcgaggtaacgcacgattcgatcgccaggaagtgaatcatgtaccggtacagcccctccggcaccgtaccgcgttcgggcgtggcctcggtcatcagccgattgacgagccgcaactggtccacacgcttaatcatcacgtcggtctgcacgctctgaccctcgcgcccgatgaagtagtggtagaacggcacatcgaggtactggatgcgcttcacccacgggaacggctggtacgagtaatagaaatcgacgtagaacgtgtgctccggcagcttcagcccggaatcgcgcaccacctgcgtgcggaaggtgagcgcatgcatgatgatgtactgcgccagaccgaacttgcccaggtcatcccagccgagcacgcggccggcctccattacacggcggaagttcactacggtcttgtgacgcttggccaccttgtcatacacgtaattggtcaccagcatgtcaatcggttcgtcggtgtcatgctgtgcacgcaacgtggccagaaccgtgtcgatggcctgcgggtcgacccaatcatccgcatccaccactttgacgtacatgccggtcgccgccgcgataccggtgttcaccgcgccgccgtggcccttgttctcctgatgaatcgcgcgcacggcgcccggattggtgcgttccagcttgcgcgcgtactccagcgtgccgtctttcgaaccgtcgtccacaatcagcacctcgaggtcgctgatgtcgcttgccgaaagcagcgagttcacgcaacggtcaaggtaggactccatattgtatgcggggatcacaaaggtgagcgtctttgccgtgctggccatgaaagtcttacgtcctcacatatttagtcgttatgttcagtttcctgttcaaaccgtagcacttcgcctcccgactcggcagagtgttgcgtaacctgtgcccctgaacgcatgttctgcaaccctgaatcttccccggtggcgtgctcgggatccgattgggcagaactcgtctggtctgaatccgggctgccggaatcggactcgcgcttggctcggcgctcggcctccttccgcgccttggcgccctcaaagaacaactggggcttggagtcaagccggctcaggccatgccaggccaaatccacaatgtatgcagccagctgctccttgctcacctttggccggtcggcccagtactgcccggtgaatacggtcatgcccaccagcatctgcgcgtagtacggcacgcccttggcagacagcttctgccgtttgaatgtttcggaaagaatgtcttcaacgcgtacggcgatgtctcccatcagcgagctgaatgagccggacgggtcggtgctcggcgagtcgcgtaccagtacctggaacccctcggcattctcttcgatataggtgaggagcgcaagcgccgtgcgttccacaatctggcgcgggtgcacggtcggatcgtcgagcgcggcggtcagcgtaccggtcagcgcgcgcatctcacgatccacaatgacggcatacaggccctctttgccgccgaaatgctcatacacaatcggcttggagactttggcgtgcgcggcgatttcctccacgcttaccgcttcgaagcctttggcggcgaatagcgagcgtccgacttcaatcagctgctcgcggcgctgcagcgacgtcatacgtgaagaatgtgccatgcggttcagcttaagtcgccgggtggaattgtcggcctgagactgccgaattcgtaggggattccatctgcgggctagacttgacaggtatggatatgaatactgtgctcgccgttcttggcgtgattgtggcggcggttatcgtaatcgccctgagcatctggttgggcaagtcccgcaagcgcgatttggatcgtgcgatgggcaaggttgcccccgacaacaagaagacccgcgacgccaaggccgccgccgacgctcggctggccgccgaagccgaggaagctaaggctgcgactgccgccgagccggccaagtcagccgaatcggccaaagccgagcctgcgccagccgcgcaggccgaacccgaaccggcagctgcgcccaagcccgagtcccaacctgcctccaagcccactcccgccaaacctgaaacccccgaatcggtcggctctcgactgacccgactcaaggcaaaacttgccaagtccggcaacccgttcggcaaggccctgttcgacatcctcgccaaagacaatctctccgaggccgattgggaagacgtcgaagacacactgctgcttgccgacgtcggtgcggatgcttccgcccaactggtcgatgacctgagaaccgacgcccgcatcactggtaaagccgacccagccgaagtacgcgccacgctcaaggagaagctgctcgatctggtcggtcgagatacggaccgccgcctcaatgccgaaaagccgggtgccgccaagcccagcgtcatcatcatggtcggcgtcaacggcaccggcaagaccaccactgccggcaaactggctcgactgttcgtggccgaaaacaagcaggtcatgatgggcgcggccgacaccttccgcgcggccgccgccgaccagctcgaaacctggggcgcacgcgtcaatgtgcccgtcgtccgctccgacaaggacggtgccgacccggcatccgtcgcctttgaggcatccgccaaggccaaggaagcgaacgcggacgtgctcatcatcgatactgccggccgactgcagaacaagtcgaacctgatggacgagctcggcaagattcgccgtgttaccgaaaagaacctgccggtggatgaagtgctgcttgtgctcgacgccaccaccggccaaaacggcatggcccaggccaaggtgttcgccgaagccatcggcattaccggtgtggtgctctccaagcttgacggttccgccaagggcggcatcgtggtcagcgtgcagaaggagctcggcgtgccggtcaagctcgtcggtcttggtgaaggtccggacgatttggcacctttcgatcccgaaggtttcgtggacggcattctcgcgtagacggtcgagttcttctcagtctcgctttgctcgacagctcccctcagcgaggggagccctgcgtccgtccacgttgtgggcgcgggaaacgcccgcaacgcaccaaacctagccccgaagcatattcgaaacatgattcggggctttcccatatccgttggaatcatgccggaatcagcccatccgatgccaacctaattgtcaggtgcgcttaacaatcgcgtaacttgccgtaacgaaaccaaaacgagaccggcttttactgacgaactgttagcccccacaagggggacggcattgtagagacaaagtcgacgccggccgcgcaaagcccccggtgccctgaacgaaagagagggaggtagacatgggagcgattgattccggtaacaccgcatggatcctgacatccgcgtccttggttttcctcatgacgcctggtgtggcgttcttctacggcggtatggttcgtgccaaggccgtcctgaacatgctgatgcttgaggcggccgccctgtcggtcaccatgattatctggaccctgtggggttggtcgattgcttacgccggttccgacatcggaggcatcttcggcgacccggccagcggcttcctgctgaaggactccatggtcgcccaggacggcgtgttcaccgccaccggtctgaacggcaacaactacccggtttccgtggacgtcgccttccaggtcgctttcgcgatgattaccgtcggcctgatctgcggcgccattgccgagcgtgtgaagtacagcacctggatgattttcgtggcgctgtgggtcaccttcgactacgctcctatggcccacatggtctggaacggtggtctgctgtctgctgacggcgccatctccaaggccatcggcgcggccgcccacgatttcgcaggtggtactgtcgtccacatcaacgccgcagtcgccgccctgatcatcgtgctcatcatcggcaagcgtaagggcttcggcacgcagccgttccgcccgcacaacgtgccgttcgtgatgctcggcgccttcctgctgtggttcggctggttcggcttcaacgctggttccgccttcgccgccaacggtactgctggttacgcttgggtttccacctccgccgccaccgcagccgcaatgctctcttggggcttcaccgagaagattcgctccggtcactacaccgccatgggtgccgcctcgggtatggtcgccggcctggtcgccatcaccccggccgccgatgtggtttccccgctgtgggccatcgtgatgggtgccatcgctggtgtcctgacctgcctggcctgcggtctcaagttcaagttcggctacgatgactccctcgacgtcgtcggcgtgcatggcgttggtggtttcaccggcaccatcctcatcggcttcttcggtgaaggcaccggtctgctggctggtggcgactggaagcagctcgtcgttcagctggtcatcgctctcgtcgccatcctctactccgcagtgatcaccgcgatcatcgccttcgctctggagaagaccatcggttggcgcgtcaccgaagcccaggaagtcggcggcatcgatcttgccgaccagggcgaacgtgcttacgattttgctggtactgccagctccgttctcaaggaggtgaagtgaaatgaagctgatcaccgctatcattcagccccataagctcgacgatgtcaaggaggccctcgcggccgccggcgtgcacggtctgaccgtgtccgaggccaacggctacggccgccagcgcggccacaccgaggtctaccgtggcgctgaatacactgtggacctgattccgaagattcgcgttgaagtgctgtccgatgacgcggatgccgaaacgctggtcggtgtgatcatcaagtccgccggcaccggcaccatcggtgacggcaaggtgtgggtcgctccgctggactccgtggcccgcgtgcgtaccggtgagaccggttccgccgcgatctgataacacagacgtccatgcttagaaggggatggactgcataggaaaggtccccgcacgccgcgaattgacgccgtgcggggactttttttggcaatgaaagatgaagcaatgacttcagcagtagatggcttgaaacaacgattcatggatatgagccagccggatgacgacggcgtctaccggaatggtgcgaccaagcgcaaagcccgcacggaactggccatgcaatgcctcactgagctgtggaatgcggcctgcaaggatgtctctttccccgtgcccgactccggcatcggcttcgccgcggtaggctcgctggcacgtggccaactgggccccagctccgacctcgacctggtcatcatctacgagcctcgcacgttgaacgaccagcagctcaacgagttggccaacaaactctggtacccgctatgggacagcggtctggacctcgaccactccatccgcacgcgcgcccaatgcgaggaagtcaccgaccatgaccttcccgccgccatgggctggctggacgtgaagcccatcgccggcgacaccgctctgatcaccaccaccgccacgtccatcctcgaacgctggcgcaaggccgcccgcaagcgcctgcccgaactgctcgactccgccaaagcccgactcgacgaattcggccggctccaatacgtcaatcagcccgacatcaaagaggcccgtgggggttgcgcgattcggtgctcgtctccgcgctcgccgcctcatggctggccgaccgcccgcacggcatttacgacgaagctgtggaacgtctgctcgacgtacgcgactgcatccatctggtggccggcaaggataccaacctgatgctgacgccctatcaggccaaagtggctgccatgcttggccttgccgatccgacttggcccgaaaacgagcgtgccgcctactcgatcgacgatctgcagacactgcttgcccgtatcggtcggcgcatctccttctcgcttgattccaccgcttcccgcgccgaacattcgctgacccacgaaaagccgcgattcgcgttcttccagatgttctctcagcgctctggtggcaagcgcgaagccccgcaattcgacgtggtggctcccggcgtggccaagcacgaaggcgaattggtgttggcgcccggtgccgagcctgccaaggatgccaagctggcgttgcgtatggccgtggcggccggcgaattcggtcttcccatcaacccgtctaccttggttaatctgaagcgctgcccgattcacgacaaccagtgggatgacgaatcgcgcgagctgtttatccgtctgcttgcgtgcggatcgaatcttatggaagtgtgggagagcatcgatttcgtggacattccgggtcgatggatgccggaatggctcggcgtccgcaaccgtccgtccgcctcggccgcccaccggtacaccatcgatcggcatatggtggaggtcacgtcgcgtctgggtcgtgagacaccgtccggtggacggtacgatgacgatcatttcaaggcattgctgttggccggtatcacccacgacatcggcaagcgcgcgttcgtggccgatcacgccgccgagggtgcccgccatgtgccggtgattctcaagcgtatgggctacgcgccggacatcgtcgactgggctaccgtgctggtgcgtgagcatttgacgctatccgaatttgccacgggtaaggacccctatgatccggccgtggcggaggagttggccgaccgcttgcaccacgacaagatgctgctggatatgctgttcgacctgacccgggccgacggctcctcgctcggtgccaccgccggtgagaccatcaccaagcaatacggctggtccaagtggcgcgaacaaatcgtccgcggcatgtattccgccgcccgcgccgctatgtaaacggaatcgcccagcgcttcgcgcggccgatacctacctcatccatgcgtccgagcgcacgcgtagtccgttggacagaccgcgcccacccatgagcaccacgttgaacgcggcccagagtacggcggtacgcatcaggtcgctcgtcagcgccggcgtcaccatattggccagtatgagtatgagcgtcacatacaccacggcggtcagcgtgcatgtgacggccagatagcggtagtcgcgcgcgccgataagaatgccgtcgattgccatcatccagccttgcagtgggaagaagatgcccatcgtcaccatgcccacggcgatcagcgtctgaatatgtggcgtaggggagaagaagtgcccggcgaacaggccgactaccgcaaaagccgtgccgattaccgcgccggtgaccagtcccgcacgcccggtcgcccgcgtcagccgccgcgcctgctgcacgctgccagcgcccagcgctgtggccaccagcgtctggccggcgatgcccacggaatccagcatgttcatcgcaaaattccaagaggagttcacggcctgaaacccggccaacacggcagtacccatgcgcgcggcacaggcgaccgtagtcaccatggccgcacgaatcgccaatgtgcgaatgaacaatggcagtccgtcgcccccggctgccgcaataccggccaaacgaggccgcagactcgcaccatccgcccgggaccacagaatggcggggattaccaggaacagccccatgaaccactgagctaccagcgtcgccactccggagccggcaatgccccaattcagcacaataacgaacaacacatcaagcaccgtgttcaccaccgcgccgcccaccgcagcgatcagcgtgatacgaaccttctgcaatcctcggaaaatgccgttcgccgcatataccatcagcatgcctggcgcacccagcacgattgcgcgcgtataggtcacggcttgttccaatacttcgccctgaccgcccagtgcccggcataatggctcggcagccgcgaacaatcccaatcccagtacggtgccgatgctcaaggccagccacaggccatcaatgcctgcctgcagtccctcgcgacgacgacccgctcccagcagatgtgccacctgcgcagtggtcgagtaggccaggaatatgcatagtccgactgccgtgaggatgatggtggagccgattgacaggccggccaacgccgcatccccgatatggccgacgatggctgtgtcgataaggatgaaggtcggttcggcgatgagctggccgaaggtcggcagggccagcgccatgatccggcggttggtggagcgggcgtcggtcgggccgttgctgacgtttgtgtttgcgccggcatgcggggtgccgaagccatcgcggcgtgtagtatcgccggaactggtggctttggcgtcggaagagtctatgggcacgctcacacgcatatcacgcctgactgcgttgcgcaagcacctgttgtgggcgcggaatgttatccccagactatccaccaagttatccccagtatgtggataacttagtggattatccccagaattatccccaaaatgtggataacttatttttctatccacattttgctttctgcgtgtcgtggcgctgactcataggtgaataaggaatgaaccgatgcgggcaaccgtttcgtttccatacgatatcgttcacctgccacgccacatcctatacttggaggctatgccagaaggaagtgaacactcgtatcagaatgggttcggcggtggcctggatcgtggcgatcgtggcgaccgcgcgggccggggcggcacgcagacgtcggcggcggccggcgacccgattttcgaccgcgtgcccccgcatgatgacgacgcggaaatggccgtgctcggcggcatgctgatgagtaaggatgccatcggcgaggtctcgcagaccattgacgtcaccgatttctaccagcccaagcatcagacgatctataacgcgatcatcgatctgttttccgccagtcagccggtggacgtggtgctcgtggccaaccagctgttggcggatggcaacctcgacaaggtcggcggcgcggactatctgcacagccttgtcgcatccgtaccgaccgccgctaatgccatgtactacgcggagatcgtccatcagcgggccattttgcgcaatgtgatcgccgccggcaccaaaatcgcccagctcggttattccgccgagggatcgcaggctgaggatgtggttaacctcgcccagtccgagatctacgagatgtcgatgggcaaggtgcgtcaggactatgccgccatcggcccggtggtccacgacgcgctcgaccagctggacaaactgcagcaaggcctcgtcaacaagggcgtgccgaccggcttccgcgacatcgacgacgtgacccagggcctgcagcccggacagatggtcgtcgtcgcaggacgtccggccatgggtaagtccacgctcggcatcgacttcgcccgcgccgccgcgttgcaccacaacatgacttccgtggtcttcagcttggagatgagcaaggtggagctcgctcagcgtattatctccgccgaaaccaatattccgatggccgccctgcgccgcgccgacgacatcacccccgaacgctggaacaccctgaaccagttctggaccaagatgcagaacgcgccactgttcattgacgacagcccgaacatgagcctcatggagatccgtgcgaaatgccgtcgtctgaagcagaccaacgatctgaaactcgtagtcatcgactacctgcagctgatgacctcgggcaaggccgtggaatcccgccagcaagaggtgtccgaattctcccgtgccctgaagctcttggccaaggaactcgaagtgccggtcgtggccctttcccagctgaaccgtggcccggaaatgcgtaacgacaagaagccgcagctctccgacctgcgtgaatccggctcaatcgaacaggacgccgacgtggtgttcctggtccaccgccctgacttctacgacaaggaagaccgccctggcgaggccgatatcatcatggccaagcaccgtaacggcccgaccgaaaccttccacctcgccttcctcggtgccacgtccaaattcaaagacatgccgcaggactacaacgccaatcagggggtgtgatgatggcaagcaacgtttcacgcgatgtttcgcaagaccaatcgtccgtggtgcagacctgcaaaccgtggtatgcgttcgccaccgtggccgcaggccgcttcgtgcggtttgcatcccgcgtcaccaaacatggcggttcggctttgcccggcaaagtcgtagaaaagattgaccccggcttcctgacccgtacgctcgggcagttgccgcttggcgtggtattggtgtccggcacgaacggcaagaccaccaccacccgcatggtcgcctcgatgctctccgatctggggctgaaggtgttcaccaatccgaccggctcgaacttcgtgcgcggcgtggtctccgcactgcttaccgaagtcacgctcggcggcaaattggacgcggacatcgccgtgctcgagctcgatgaggcgtacgccgtccacttcgtcaagcaggtcaagccccgttatgcattgctgctgaacgtgatgcgcgatcagcttgaccgattcggtgaaatcgacaccacggccaaactgctcagccatgtggctgcggcgactaccggcactgtggtactgaaccgcgaggacccgcgtatcgccgcgctcgccgcgaaggccccggctggcaccaccgtgcgatacttcggcctcgccgacgatttgcgccactatttcccgtccgatgacgacatggccacgaccgtgtcggtggaaggtgtggccgggccgctcccctcagccagaactcctctcagtccgcgaagcgaactgagaggagcttccacaggcacggcagaacttcccgccgacgtgacacttaccgccgtgggcgaccacaaggccaccttccagatggacggtcagggctacgccaccgacgtcaagcttgaaggcgtctacaacctgtacaacgcggccgccgcgctcgctgtggtacgtgcggtgatgcaagacaatgccgccgcatccaaggccaccgccgcagccaacgcctgcgccgtgtccgccgacgagcttatcgccgccgtttcccgcgtcacgccggctttcggccgtggcgaggtcatcgacgtcaacggttccccggtcgaactgctgctggtcaagaacccgatgggcttccgcctctcgctcgccagcttcgacccggccaacgcggacaccatgatcgccatcaacgacgaatatgccgacggccgcgacatgagctggctgtgggacgtggacttcacttccctgcgcgcgtccggtgtcgccatggtctccggcgtgcgtgcctgggacatggcattgcgcctggggtatgaccaagtgccagtcgccgatacgaacaccgacctcgaacaggccgtcaccgcattcgtcaacgccaatcccggcacacgcaagcacatctactgcacctacaccgccatgctcaaaacccgcgccgtactgggccgcatcaccgaagtacgggacgcgggcgtgggcaagtaaccacccttcggcgctcgcgcgccacctcccgccagcggaaggggcatggtgagggaataagacgcttcccggcagcgggagaacatcgacaaggagaacgtgacatggccagaacaattgatgtggtgtccctgtatcccaaagacatgaacatctacggcgattccggcaacgtgctgactatccgccgccggctggaactgtacggttacgaaccggtcgttcaccagtacaatcaaggcgacgattggcccgaccaggtggaccttattctgggaggcggcggccaagacaccggccagaagaaaatcatcgacgacttctaccatcgcgccgacctgttgcgttcgcttgccgcagacggtacgccgatgctgatgatctgcggcctgtaccagctgttcggcgagtactttgaaaccgtggacggcacccgtctggacggcatcggcgttatcggtgcttataccgtgggccagaacgtgcgtatgatcggcaatcttgttgagcattccgaccagttcggcgatgtgattggctacgagaaccactccggccagaccttcctgcgcgaaggcgttcagccactcggcaccgtcgatcaggatggccgaggcaacaatggcgaagaccataccgagggcgcgcgcgtgcacaacgtgatcggcacctacatgcacggctcgttgctgcctaaaaaccccgccatcagcgatttccttatcgaaactgccgtgactcgtcgttacggtacgttcgatacgtccgatcagacccccgaacaagccaaggagcttgcccggctcgatcaagtagccaccaacgcgcgcaaggctgccgccgaacgtcctcggtgaattctcggtgagtcctcggtaagtaccaatcagcgaaaaatcagtcgaaatcagtctgagggtctagtacattgccctgttgtttgcgctaggcttggtggtacgagacatggcaccaggccatgtcggacctcgaaggaggggtatcatggctgattttgatcttctgggtgatggcctgcgcaaggtcctgctggcgggcatcggagcccttgccaccggatacgagaagagcagcgagctcgtcgacgaactcgtcaagaagggtgagattacggtcgagcagggcaaggcgctgaacaccgagctcaagcgcaaggtgagcgagacggtggatgacgccaagaaggccgccgccgaagccggcgacaaagctgctgccgcagccgacaccagtgccgccgacaagcccgctgacgagggcaaggccgagtgaccaagcccacacgcgctacgccggaatcagggtcgaccccgctttccagcagggtcgaccctattctgacgcctgcgaaagccgaacgtgaggcggcggcgaaccggtccgtcgacacgtcggacacgctcaagcagaccgttaccaaggcgactccgagcgtatccgacgaaacgctggcactgttcggacgcaggaacgatttcgccacgcgctaccatctgacgcgtcgtggcaagatcaaacgactggggcagatcaccagaatcgtcgagcaattcgacgtgctgcacggcctgactccggtcaaaatgcgcctcatgttcgaggcgctcggccccacgttcgtcaaagtgggccagattctgtcgatgcgctccgagattctgccgcaaagcttctgcgacgaactcgccaaactgcgcgccgacgccgacccgatgccgtattccacggtgttggatgtgcttgccgccgaatacgggcgtcccgccgacgaggtgttcgcgcatatcgaccccaagccgttgggctctgcttcactggcgcaagtgcatcgcgccacgctgaaaaccggcgaagatgtggccattaaagtgcagcgcccgggtgtgcgcgaaaccatggcccaggacgtctccatcatgcgctccatagccaaggccgccactaaggtgattcgcacctcacagatcgtggacctgaagggcgtggtcgaggagctgtgggacaccttcgaatcggagactgactttctgattgaggcccgcaacctcgccgaattcaagcgtttcgccgcccgattcaaatacatggactgcccgacggcgtacaccgaactgtgcaccgagcatgtggtggtcatggagtacatcgacggcatctccgtctcccacccgggccggctcgtcgatgctggttatgacttgaaggagatcggcaccaagctcgtcgacaattacgccacgcagattctcgacgacggcttcttccacgctgacccacatcccggcaatatcatcatccggggcggccagatcgtacttatcgacctcggtatgaccggtcggctcgaccagcgcacccgtgcagtcctcaaagaaatgattttcgccgtcgccaaacaggattcgcccgctctggccgaggggctgctgcgatttgccggcaccgaggccgatccggaggactacccagcactgctggctgatctggacgtgatcgtcaaggaattcggcactgtggatctggccgaactggacattgccgccttcctgaccgcactgacgcagatggccggccgccacaacatcgaggtgcccagtacggtgaccaccgtcggccgcgcgttggttacgctcgaaggcttgctggacgagttcattcctgatgtgaatatgatcgaaatcatttccgaccatatcgccacgtcgaaatcgctgaagaacgccaccaaagacgagatcaagtcgctgggcgttgagggacatcaggctttgcatgccacgctcggcaccatgaccgaactcaagaccgtggcccgtatgctgacccgtggtcagttgcgcgtcaacatggaactggtcggctctgaagagccgttccagctgctttcggatatggtgaatcgtctgacgatggccctgattgtggtcggtttgttcgttggctcgtcgattgtctactacgccggcatgaagccgattatcttcggcattccggtcatcggcttcatgggctacgtcgtggccttcgccctcggcgtatggatcgtcatcgacatctacttaaaggggcgcaaaaccaagaagcggtagggcatcgattgatatcagtccagcgggagggtggattcgcgctggataaggtggcagggtacgtagtcgacaccgtgatgcgggttgccgtcgatggcatcgaccaagtatcgtgccgcacgccgtccgatggtttcggtttcgttgtcgatcgacgtcagtgcgggcctcgagctggaggtcagtaccgaccagttatcgtggccgatgacggcgacgtcatccgggatgcgcagtccctgctgcttgagcacgtcaatgcagccgcgggccaactgatcgttctggcagaccactgcatcgaacttgaccccttggtcgagcagcaggcgggtggcggcgcggccccagccttcgtcccatttgccgtaacgaattgggccggcgggttcaatacctaattcggagagtgcctcgagcgcgcccttggtgcggtcggtggcagcggtataggtttcgtcgccgccgataatggcgatgtgccggcggccacacgagatgagatggttgatggccatgcggccggcgtccacgttgtcgcaagtgaccgagcagtctttggggtcggtggaggggccgtagacgtagaccagtggcacgccccagtcatggccaagcgtgggcctggggttggtctcgcactgcacgatgagcagtccgtcgaccttgagggacagcagtttctcgacatgctgacgttccaaggcggcgtcgccacgagcgttggccaacaatactgaggtcgattgggctcgcaactcgttctccgcgccgataagaatcggtgtggagaaacgaccctgcagatcggaggtgaccaggccgatagtgccggtggtgccgcgggctagggattgagcgagtttgttgggagagtagttgagttgcttggcggcatccagtacacgctgcttggtttcttcgctgatacggggtttgttgtgcagtgccttggatgcagtggccgtcgagactccggccaatgccgccacatcctcaagtcgcgctgcccgtccggttgctggctgggtcatcatgcctcgattccttggttcttcagcagtatatagcgcattgttttgcgatgaaatacctcatacggtgtggtgcgccattgcatctgggaataattgtagcttcaatgcgaaaactttcgcaaacatctttttttcggcgtggcgtagtcagggaaattgttcaagtgcaaggtaagtgaaagaaagcgttacttccatgttcgcttttgtttgatttgctcgacacgccggaataatcattgatattaagccaattcaagcacgttattcatagtcgaatcacagtctcgaacccgtttgatgtgagaaaaaacgcgaaaatgcgaaagcgcttttgcaaaaacttccatgttcgtttatattgagaaaaggctttcgcagtgttacctgctccgggcaaaggagcgagcagggcgaaaccaaggaggcggaccgtccgccaccgcctctcatagttgagcggatatatagagaaagaagcgaacatggtgtctttcaataaactgacccgtactcttgctggcatcgctgccgccgcgttgatcgttccgctggccgcctgtggtggctccggcaatggtggcactgccaccgccgaaggtatcccggccaagggcaccgacgatggtaccgagatcaccctgtggacccgttcccctctggagcgtcaggccaagaacgtggtcgaggcttacaacaagagccacaagaaccaggtcaagctcgagatcatcccgaacgacgatatggaaggcaaggtcggcggcgcttcgcagaccgactccctgcctgacatcctcgccggcgacgtggtccgtattccgtactgggcttccgagggcatcttcaccgacatcaccaagcaaatcgatggcctggacaacaaggccgacctgcagcagggccacatcgaagccggtactgttgacggcgccgagtacaccctgccgttcatcactgacgtttccgtgatggtctggaacaagaacctgtacaaggaagccggtctggacccggagcagggtccgaagagcatcgaccagttcgtcgagcaggccaagaaggtcgccgccctcaacaaggatggcgtcgcaggctcctacctcgccggtcagtccggtggtgctctggtcttcgacctcttcccgtccgtgtgggctgacggcgaatccgtcatgaacaaggatggctccgaggccaccctggacaacgactccatgaagggcgtcttggacgcttacaaggagctggccaacaccaccaacggcctgggtgcaggctccaaggaagagaccggcgccacctggaccgctccgttcgcgaacggcaagatcggtgtcatgccttacccgaacacctccaccactgctctgttcgatgctgagaaggacggcggcttcgaggtcggcgttgctccgatcccgggcaccaaggaaggcaagacctccacgttcctcggcggcgatgccatgggtatctccaaggactccaagcacgttgctcaggcctggaacttcctctactggctgatgcagtctgacgctcagaaggaagtcttcgctgaccaaggcgacaccgcctccaacatccagaccctgaagaccgcttacaaagacgctgacccacgcatccagaccatcaactccgtgattatcgacggcaacggccagaccccgaagtccccggccttcaacgaagccttcaacgccgctggctccccgtggcagctgctcgtgcagaacgccgtgtggggttccggtgacctcaaggccgacaacaaggccgtcaccgacgtcctgtctgcccagtgattcggtggtgatgctcctcaccatcactcatcaaatcacagcaataactgaataacaactgaacagattgagccggtccctcccttgtgagggcaggagccggctcaaccacataatcgaacttctatcttcttcttcattccttctcttccttcatcactacataccttatgaatgcggtgtgttggcggggcttcggagtcctccttcctcgaagccctgacatcggattgcattcggattccgtgattaccatttcacagtaatttcccaaaggagagagaaacatgtcgagtgtttccaagagcgccggggctgtgcccgtgcataagtccaaggcgaaggcggcgcagaccaggcgaggtctgctgtacgcacttccggactggctgatgattatcgtcctgttcttcgtgccgattgttctactggtcgtcatggcctgctctcgttggagcctgctgggtggcaaccgcggcgtgaacttcccggacaacttcgtcaaggtgttcgagaacaaattgttctggccctcgatttggttcacgctcgagtacaccgtgatcgtcacgatcttcctgttggtccttggcctgggcatggccatgatcgtgcaggagagctcgaagtggaacaacgtgctgcgtacctgcttcctgctgccgtccgcgacgggcctggcgtccgcgtccctgctgttctacgccctgtattccccgcaggtgggccctgtcaccaagattctgagctcgttgggcctgatgcaggagggtggttcggtgctggccactggccagtcggccctgtgggccacgattatcgtgattgtctggcgtttctcgggctactacatgctgctgatgatgatcggtctgcaggccatccccggtgatctgtacgaggcggcccgcatggacggcgccggttcctggcgtatcttccgctccatcaccctgccgctgatgaagccgaccatcgtgatgtgcctggtctactgcgtgaccggctcgatcctcgcgttcgatcagttcttcattctgaccaagggtggtccgaacaactccaccatgaccgtggtgcagctcatctacaacttcgccttcgattccaagaaggatctgggtatggccgcggcgctctcgctgatcgtgctggtggccctggtcatcatcaactccatccagatgcgcggcatgcgcgacaacaccaagtgagaaaggggaggtaacacattatgactaccccattgtggaagcgtatcatcgcccggatcctcgaggccctgctggccatcatcttcatcagcccgctggtctgggtcatcatctgctcgttcagcccgcaggccggttcggcccagtccaagggctggggcgtggccaactacctgaccctgttcggttatcaggaaggtctgcccaagtacctgttcaactcggtaatcgtgactctggtcgcggtcgtgttctccgtggtcgtctgtacgctggccggctactcgttctcccgcttcgactacccgggccgcaacctcggcttcatggtcaccctgtcgatcctgatggtaccgtacgcctcgctgctgatcccgctgatggtctggtacaagcagatcggcctgaacgacagcctgctgggcgtgggcctggtcatcaccctgttccagctgcctatgagcacgttcatcatgcgcaacgcgttcgacgcgatccccaaggacatggaggaggccgccatggtcgacggctgcaacagcctccaggccttgttcaagattctggtgccggtggtcaagccttcgatggttacggttggcctgctcgccttcctcgaggcatggaacaacttcatgattccgctgtacttgagctcttcgtccaagtccacgctgccgctggcgatggtgaacatgcgtcagcagaccatgggcgtcatcgattacggtgccaccgaggccggcgtcgtgatcctgctgattccctgcgccatcctgttcctcgcactccagaagtactacgtcaagggctttatggctggagccgtgaagggctgatcatgaacgttacaatcacttccccgttctggaagcggcgtcgcgaccagattgtcgaatccgtcatcccctaccagtggggcgtgatgaacgacgagatcgacaccacggtgcccgacgacccggccggcaaccagctggctgacagcaaaagccatgcggttgccaacctgaaggttgccgccggcgaattggacgacgaattccacggcatggtgttccaggattccgacgtctacaagtggcttgaggaagccgcctacgcattggcataccacccggatcccgagctcaaggcgctgtgcgaccgcacggtcgatctcatcgcccgcgctcagcagtcggacggctatttggacactccgtaccagatcaagtccggcgtatgggccgaccgcccgcgcttcagcctgattcagcagagccacgagatgtatgtgatgggtcactacatcgaggccgccgtcgcctaccatcaggtgaccggcaacgagcaggcccttgaagtcgccaagaagatggccgactgcctggatgccaacttcggccccgaagaaggcaagatccacggcgccgatggtcatcctgagatcgagctcgccctcgccaagctgtatgaagagaccggtgagaagcgttatctgacgctttcccagtatctcatcgacgtgcgcggtcaggatccgcagttctacgccaagcagctcaaggcgatgaacggcgacaacatcttccatgatctcggcttctacaagcccacctacttccaggccgccgaacctgtgcgcgaccagcagaccgcggatggccacgccgtgcgcgtcggctacctgtgcactggtgtggcccatgtgggccgactgctcggcgatcaggggctgatcgacactgccaagcgtttctggaagaacatcgtcacccgtcgcatgtatgtcaccggcgcgattggttccacccacgtgggcgagtcgttcacctacgactatgatctgccgaacgacacgatgtacggtgagacctgtgcttccgtggctatgagcatgttcgcccagcagatgctcgacctcgagcccaagggcgaatacgccgacgtgctggagaaggaactgttcaacggttccattgccggcatctcgctcgacggcaagcagtactactacgtcaatgcactggagaccacgcctgacggactggataacccggaccgccaccacgtgctctcccaccgcgtcgactggttcggctgcgcctgctgcccggccaacatcgcccgactcatcgcctccgtggaccgctacatctacaccgagcgcgacggcggcaagaccgtgctgagccaccagttcatcgccaacacagccgaattcgcttccggcctgacggtcgagcagcgttcgaacttcccgtgggatggccatgtggaatacacggtgagcctgcccgccagcgccactgacagctcggtccgtttcggactgcgcatccccggctggtcgcggggctcctacacgctgaccgtgaacggcaagcccgcagtgggctcactggaagacggcttcgtataccttgtggtcaacgccggcgatacgttggagattgcgctcgagctcgacatgtccgtcaagttcgtgcgcgccaactcccgcgtgcgctccgacgccggccaggtggccgttatgcgcggtccgctggtctactgcgccgaacaggtcgataatcccggtgatttgtggaactatcgtctggccgatggcgtcaccggtgcggatgccgctgtggctttccaggccgacttgctgggtggagtcgataccgttgatttgccggcagtgcgcgagcacgccgacgaggatgacgcgccgctgtacgtggatgccgacgaaccgcgtgcgggcgaacccgcgacgctgcgcttggtgccgtactactcgtgggccaaccgcgagataggcgagatgcgtgtcttccagcgtcgataaatatcggcgatatgccggcctgcgcgcaactggccggcaaaaaaatacttatgccgccatcgtctgtaataagtcgatgacggcataggccggatgtcagtatcgattggagccgaaaacacatccggggaatgaggtctcctgtgcggggtaatacccgtgcaggagattattttttaattatatgctcctgctgtgagagctgtcggcggagtcgactgagggtggtcataagcggtaccgtgtaagccaccctcagtctcgctttgcgagccagctcccgccagcgggagcctgttggttcctgattcagcgaggctgaatcggcgcgccgtaggtactgcgacacggcgaaacgcagcaatgctctaatgcgaaagtaaatgcgaaaactgagaaattgccgggtttttgttgtgtaagatggttgatatcgctgagggaaagttgcgaaaccgtattcgctcggttatgatgtggaatcagcttcggtgaattgctccaaccgtgatatccatggcggatatcacaccagattcactgaagatactcattccggtgaacccaatagccaataaaggaaactgacggagaacgggctctgcggcccagcatccacagaagaagtcctggtcgcatagatgcgacgtagcctgagcgaagacgcgaaagaccggggcggagaggtccaagcaggaatgcatcactcaacacgaaagcggtggcttgcgtcaatcggcgcggttgcagcggtcgccacactggccaccggcggtgcagtcaccgcgcaggcagccgatgcgcccgtcatcaagaatgcggatgtggcatatccgtcgttcaagggatctgatgatccgatgaagacggcggcgaacaacaccacatataaccctgccgtcagctatctgcaggagacattcgataacgacgtgaagaacctggccggcatcgacaccgaccatgacttctggatcgataagattctcacccgtactggtgcacagccaactggtaaaggcacgaacgacaagggtgcttactcgtatgaaggctccgacggcaacaactacctgttcacccgtggtcgcgccgcctacatgtacacgcacacgcctaatcagctcggttttgtgggtgataccgcctactgggaccagaccagcaggagcggcttcaccgttaccgtaaacgctgatggatcaaaccagacccttaacgaagacgcctcccagcgcaagcagacgccgagctacttcacctccctgttccagaccggtggcaagagcctcaagatcaaggaagtcaagtacatcacctacaacaacgtgatggttgcgaacctcaccgtggaaagcacgcaggaccgcgatgtcacactgaccacggcctcgccgttcgccgccgagggtgctgatggtgccaccgaacttactggccgcgtgaacgtcaagaacaacctgacgaccatctatccgcgcttctccgccaacaaccaggacggttccaactggatcgtcagcggtggcaaactcaccagcacgttgagcctcaaggccaacgaaccgcagaccgtcaagattcagctcggcctgatcgccaacgaactgcctgactccaccaaggaatatgaggcccgttacaccggcgaccttaaggatgctgccgcctcctacaaggattccgtgaccacctacaacaagtggtgggtcgataacgctccctacgtggacactccggaagacaatatcgataagaccgtggtctaccgctggtggctgagccgtttcaacatgctcgacgccaacatgcctggcaacaccttccagtacccgacctccatcgagggtgtgctcggctacaacaaccaaatcgtgctcacctccggcatgttcatgatggacaccaagtggttccgcaaccccgagtactcctacggcacctggctttccgccggcgataccgccaagaagagcaaggcgggctattactactaccacgacaatccgggcgacccggccaactggaaccatagctacacgcagtacatcacgcgcgccggctgggactcctacaaggtgcacggcggtccgtccaccgtggccgaggagctggccgaccagggtgccgaggacgtgcaaggtctactcgcttccaagagcgagccggacaacaacgacaaccagaacaacaatgacaacagcttgattgactggtcctggtggtcgatgaccggtaacgatgccgacgccgtttccttctctgagccgggtcgctccggccagcgcatggatcgcgccgatggttccgccaatatgtgggccaacgctaacgcggctgctcaggcatacaaggctgctggcgataccgccaacgccgagaagatgcaggccatcgccgacaagatccagaaagaagtcaccactgaactgtgggacaagtccgacaacctgctcaagcacaagtggctgaacgacggtgctttcgccaagtacaaggagatcaataactactacccgtactccgaaggcctgatgcctaccggcaacgaagattacaacaaggctctgcgcctgttcgaggattccaacgagttcccgatcttcccgttcttcaccgccaaccaggcggacaaggcggcgctgaacttccccggttccaacaacttctccattatcaacgcacagccgctgctgcaggtctattcagccggcatccgcaattacgatgcagccaagaatggctacatcaccaatgagcagttcaagaagctgctgtactgggtggcgttcgcgcactaccagggcggcgataacaactaccctgatcaaaacgagttctggaacgaggacaacaacaacgtcggcgatgtaaacggtgacggcgtgatcaacaacctcgacaagaaccttgacgccgcacagaacggcggcaagatcacctaccgctcctggatccaccacacccagctcggcaccacgaactggacgatggtcgaggacgtagccggtatggtgccgcgcgaggacaacaagattgagctaaacccgatcgaaatccccggttggaactacttcacggtaaacaacctgcgctaccacgatcaggatgtctccatcgtatgggacaaggacggcagccactacggtggtcctgctggctacagcctgtacgtgggcggcaagctcgccttcacctccgacaagctggcgcacctcatctatgacccggctgcgggaacggtcgaggtcaaggacgattccagtgcccaggttaccgtcggcgccgaagccgtcaagaacgtgaaggccgccaatcaggttaccttcaatgccgatcagcgcgtgaccgacctgttcgccaagtccggcaccaacgtcgactccgcctccaagtccaccacgaacgtggccaaggacgcggacgtgaccggtaccacctacgccgagaaggacaccaactacccggccaagaacgcggtggacggcaagaccgtgatggaatcgttctggggtaccaagggctctgagaacaagaccgacacgctcaatatcaagttcaaggacggcaagcagaagatcgacgacatccgcttgtacttctaccagagctcgtccagccagaccatctccggctatgccgagcccgccaactacaagttggagtaccagaaggatgacggcacatgggccccgattgcggatcaggtgcgcaccccgaactacgcgggcgcgaactacaaccgtatccagttcactccggtggagaccacgaccatccgcgtcaccttcacgccgcaggccggcatggccgtcggtgtcaaggagatcgaagcctacaacaccggtatcaaggctgacggcacttccgagaaccagactccgcaggtggatgcttacgtgtcttccagcacctcatctggtgccaagctcgtcggtacggtgaaggatgacggtctgcccgcagaaggcgacgtcaccaccacatggtcccaggtctccggtccggaaggcggtactgcgaagttcgtggacgcctccgctgccagcaccaccgtcaccttcaacaaggagggtgactacgtcctgaagctcaccgcttccgatggcgagaaggaaggctccaaggaaatcaccgttcacggcatcccctctgacggtaccgtgaacgtagccccgcagtcgagcgcctctgccagctacaccaacggctaccagccgaaggacaacgccaagaaggtcatcgacggtcaggtggtatacgccaacacgccgaacgagacctggaacaactggggcgactccactggtgtggagccgtggctgcaactgaagtgggccggcaaggtgccgctgaagaaggccaaggtcttcttctggaccgatggcggtggcgtgccgatggtctcatcttggaagctccagtacgctgacgctgacggtaactggcaggatgtgaaactggctgacggccagtcctacacggtcaaccggaacgaaggcaacgaagtgaagttcgccgacgccgtcgaaaccgacaagctgcgcgtggtcttcccgaagggcgccatcgtgggtgcttccgagttcgaggcgtacgccatcgagccggtgagcgtggacgaagtcaaccgactggtgcagaccggttccaaggctgatgatctgaagctgccatccaccgtgagcgccgtatacaccgacggttctcgccgtgacctcgccgtcacgtggggtaaggtgaccgacgctcagctggccgccgatgccgtattcgatgtcaagggcaccgtcgccggtgcgctgaacggtacggttgcacacatcgcggctcgttccgataccgcatcgcagaccgtgggtaatgcgcagccggttgagcagaccgtctaccagaacgccaagtccatcgacctgcccgccacggttccggtgaagttcccgaacggatacaacgacgaccgcaaggtcacgtggaaggatgccgacatcaaggccatcgacctgaccaaggttggtgactacgaggtggctggtaccgtcgacgacggttcatcttccgcagctgccaagctcactgtccacgtggttgccgacccgaacggttcctccactccggagcctgagcctgagccgttggtcggttggattgaaggcaaggcgaccaggaccaccatttcgcctgattccgaggcgacctggtcaccggccgaaggcaagctcaacgacggcgtagtcgtcgatgatacttggccgaccacggatgatcagaacgtcaacgacaaggtctggggttcttggggcaaggcaaaggacggcatgtacgcccagtacgacttcggtcagtccgtgaccattgaccagagccgcgcccagttctgggccaacttcgctgagactgacgattcgaagggtggtctggaagtcccggacgcttggaagattcagtacctcgccgaggatggttcttggaaggacgtcgagcccaccgaggattacaccgtcgtgcgtaattcgccggcttctcgtgcggataccgatgccaagggttggagcgctgtgaccttcaagccggtcaccaccaagtcgctgcgactcgtgctcactccgtacaccggcagcagcaccttcggggccgccgtggccgagtggggcgtgcatggtattgacggcaccgagcctgaacctaccccggtcgacaagaccgcgctcgagtcggctcttgacacagccaacggcctcgatgcaagccgctacaccgccgcttcatgggctgagttccagcaaatcattgacgctgcccaggctgtgtacgacgatgccaacgccaccgcagaacaggtcgccgagcaggtgaccaagctcgaggacggccagaaggcactcgttgcgctcgccaccgacgtggagaagtccacgttgcaggcggccatcgatgcggccaaagccgaggccgcttccggcaagtacacggataagagtgtcgaggccttgaacaaggccatcgaggctgcggaaggtgtgctcaaggtcggtgaggtcggtgaggtcactcaggccgccgtccaggaagcgtccgcttcgctgaacaaggccgtcaaggccttggaagagaagcccgccgccgaaacggtgaagaaggagtccctcgaggcttccatcgagcaggccaagaaggctgacaagtcgaagtacaccgaggaggcatggcaggctctgcagagccagattgccgccgctcagaaggtgtacgacgacaaggatgccaagcaggccgatgtcgatgccgcacaggatgcccttgacaaggcattttgggccaccaaggttgagcagaagcccggctcccagcagcctggtgtgaccgacactgataaggatgataaggacaacaagggtgatcgtgtgcctccgactggtgccgcggtttccgtagttgctgcggctgccgtgctgctcaccgccgcaggcgtgaccatcctgaagcgtcgccagtccggcgaccacggttcggctcgccactcggcctgacccgcaacggagtcattctgccgagtgagccccctcacagagggggctctagccttttccttctacccatcattactcttttcactcactcaatgaggagcactatgagtttccatgtatccgcgcaatcggttcgcgcggtggccggtggactcgtcgccgcagcgacattgctgtcaggccttgcccttgcgccgaccgcaatggccgccgattcagccaccgctgacaacgcgcccagcgttgccggtcacgcgtataacgaactgccgtataacaatcctgatgtcaccgtcacccaaatcgacaatagcgcactgcccagctacatgcgcaaccccatcgggcagaacgagggtattgacaccccgaacgatctttcgcagaactactactctgcagatgcatccgcgctgagctatgacggcaaactcttcgtcttcaccggtcacgatgaggcttcgcccgactacggctccttcaacatgaaggactggggcgtatacgtcaccgatgaagacggcctgaatcaaggcaaatggacacattacaagaccatcgccaaggcaggcctgttcagctgggccaccggcgatggcgcgtacgccggccaagtcgtagccgacgataacggcaccccgagcgacacttccgatgattggttctactactacgtgccggtgaaggacaaggcttctgaggcggctggacaggacccgttcgccatcggcgtggccaagtcgaagagtccgctcggcccgtggaaggatgccatcggcaagccgctgctcaccacatcgcaaacccagattgaaaccatcgatccggcattctttgtggacgaggatggcaccggatatttgcactttggtacgttcggcactcagctcgccatcaagatgaagaaggacgccacaaccggccgcacctcatacaccgaggtggaaaccaaggctgatggcaccacgccgaacctccacaccatgaaggacgcggacagcaacgcgaacggcccgaagggattcttcgaggcggcgtgggtgttccgtaagggcgatacctattacaacgtgtacgacggcggtaagcccggttcgggcacggccacctgcgtggaatcgaactatcaagcttgcatccagtactccacttccgacagcccgctcggcccatggaagtaccaaggcgtaatcgtgccttctggctcggccaccacgatgcacccctcggtgctccagttcggcgacaaatggtatgtgacctatcacaccggcgacaaggaaggcggcaccgatttccgccgtgccgtgtgcattgatgaagtcgattggaccgccgacggccagatggtttccaccgcccatccaaccaaggccgagaaaacgcagccctccaccaacgtggctccgtacgcaaaggtgagcgccacgttcactgaaacgcctgcttggaagggttcggtgaacgacggccgtgtgttgcaaaccgctgtggtcccgccgaatcactggaccaactaccgttctatcccgcaatcgcagtccggcgattctctggtctaccaatgggatggcactgtgcgcgtcaactcgtctaaggtttggttcgacgtggattccaacgctctgcgcgcgcccgcctcgtggaagattcagtacttggacgcggacggcacatggaaggatgtcaccaacccgagtgcctatacaacgaccacaggcaaggccaaccccaacgccgtcaccttcgatgcggtgaccactactgccttaaagctcgacatgaccggtcaagctgtggatggcggctatgcctccgtggccgttgctgaatgggaagtcggctccgactccagcgaatcgccggcaatcactgcgccgaagagcgtgaccaccgccaccggtactgcgcctactctgccggccacagtggatgtgaagtacgggaacccaaccgttgcctccccagtaatttggcgtccagttgatgcttcctcgtatgccaaggtcggttcgtttacggcctacggcgtggtcgccggcgtgcccggtgaggcaagcgagcagggcaatgtgtcggtaaatgtcaccgtgcaggacggctaccagcctgccgctgataccacgaagccgactgtaaccgttgccgttactgctaacgcaggcaatagcgagtggctcaccaccgctccgttcgccaccgtgcaggccacggacgacaccgcacctatcgccaagctggagatttccgctgatcaaggcaagagctggaccaccatcgacgcgaatgcaaacgcggccattgccacgctttcccagcagggcgatgtcgaagtgtgggctcgcgccaccgatcaggccggcaacgtttccgacgtggccaaggccggcggcaaggtggactccgccgcgccaaccgtgaccgccgccgccgataaggaggagcgcacgctgaccttgaccgctgatgacggcaccggttccggtgtcgcatcaattgaataccgcattggcacagacggtcaatgggccacgtacagcaagccgattgctgcaccgagcgcgtcgcgcgccaccgtgtactaccgcgccaccgataaggccggcaacgtgtccgcttcggcgaaaaccgacattccatccgacacttccgtgccgctgaccggctacattgagggcgatgccaccgccaccgatgtggacggcaaggcatccggctgggtcaagggtgccgccgcgttgaacgacggcaagatcattcccgatatcaccattgccaacgaggatgtctggggcacttggcccaacaccggtgagatgcgcctcgactacgagtgggaccgtgaagtgactatcgactctagccgcgtgcaattcacctcggatgatggcggattgggtattccggcatcgtgggaattgcagtactgggacgccttggcgaacaacggtgccggcaacttcgtggatattcccgacgccacctacactgtgaccgccaattcaccgtctgctggctgggccaccggcgatgccaaggggtggtctgatggcacgtggaacactccggtcaagactaccaagttgcgtatggttatcacgtccggctcggcttctccggctgttgccgaatggcaggttcatgccattgacgacagtacgcctgagccgcctgagcccacaccgatcgacaagaccgagctcaagcaggcgctcgctgactcgcctaaggctgacgatgcctccaagtacaccgagacttcatgggcggagtacgcggcggtattggattcggcgcagcaggtgtataaggctgaggatgccaccgaagctgcggtggtggatgccgcaacccagctgaagcaggcagcgaagaagctggtgcttgtagctacggtgcaagatcgtgccgcgctgagcgctcagctcgatgccgctgctgccgtggatcgcacaaagtggactgatgaatcgctggccgtgcttgattcggcagtcgctatggcgaatgcgctgacgagtgatggtcaggccgcccagtctgacgtacaggctgcgactgaggcaatcagcgatgccatcgcgggtctggttgagaagagcaccacgaagcctggccagggtggcgataagcccggttccggcacggacaagcccaaccaaggcaacgattccaaccagaacaagggtgatgcagactccggcaagcacaagaagatacctgacaccggtgcagccgtgcttggtgttggcatcctcgccgtggtacttgctgttgcgggtgtaatcatcctcaagcgccgcaagtccggtacctgctagtcccactcgctcggcctagcatcaccaagcccccgcgcatgaacagcgggggcttcacttttgttcaataacaagcattatgtgcgcgtatgagactacgatggtggggaatctacgaacaggggcagcaatgacggcatacatggaccataaggatctcgccaacgaagttatcgatcaggcgcgcgcacaagagattactgatggtgtgcatcgcgtgcttgaccggattgcctcagcggagtccgcagccgggcgtgctgccggttcggtccaattgctggctgccaccaagacgcgcgatgtcggcgagattctggcggctatcgatgctggtattcgcgtgattggtgagaatcgtccacaggagattactgtcaaggctgacggtctggcaaaacgactgggggagcgtggttattcgctaggcgtgattgatgccgctgaggctgacacggccaatgccgcagctgcaacgcatattcctttccatctcatcggccaattgcaagccaataaaatcggcaaggtgctgccggtagtggacaccatcgaatccgtggattccatcgaactggcggaaaagatcgcccgccgtgccaccatgcgcggcatcacggtcggcgtgttgctggaggtgaacgaatccggcgaggaatcgaagtccggctgtgcgcccagccacgccatcgacttggcccagcgcatcggtgcgatgggcggactgcgcttgcagggattgatgaccattggcgcccatgtggatgatgagcgcacgattcgtgcgggcttcgcgcatctgcgccgcacgcgcgaccagattattgcctccggtgccgaaggcacggccgactgcaccgaactgtccatgggcatgacccacgacatgacctacgccatcgaagaaggctccaccatcgtgcgcgtcggcaccgccatcttcggcgagcgcgccttcatctgattggagctatacgaaaaaacgccgcttgatcaatagccaagcggcgttttttcgtaaggattttcggcgtatcaatcacgcatagatattgcgcggacgcatgtcctcgggcaggccgtcgagcagaatcgccacggaaccttcctcgaacacggagcgaatacccgcggccagcagcggtgcgcaagacagtacggtcatattcggcaggcgcttctcttcgggaatcggcacggtgtccataaacacgatttcatgcgcgccgcagtgagacaggcgctccacggccgggccggagagcaggccatgggtggcgaccagcgtcaccgacttggcgccggattcgttcagggtgcgcacggcttcgcagatagtaccggcggtatcgaccatgtcgtcgatgaccacgcagtcgcggccgtcgacatcgccgataatgccatgtgcctcggcatggttcggacgagtaatatcacgctgtttgtggatgaatgccagcggcagattgcctagcttggcggcccactgttcggacaccttgatacggccggcatccggggacacgatggtggtgttgcccagatcaagggtggaacgcacgtaatcgagcagcaccggcatggcggttagatgatcgaccggaccatcgaagaaaccctgctcctgagcggcgtgcagatcgaccgtcataatgcggtctgcaccggcggcgtggaacagatcgaaaatcagacgggcggtgatgggctcacgaccgcggtgcttcttatcctggcgcgagtagccgaggaagggcgccaccacggtaatcgacttggcggaggcgcgcttcaaagcgtcgatcatgatgagctgttccatgatccacttgttgatatcgcccgaatgacactgcagcacgaacacgtccgcaccacgcaccggttcggtgaaacgcacgtacatctcgccattggcaaagtcataggacgtggtttcgaggatttcggttcccaaacattcggccaccttctcagctagctcggggtaggcgcggcccgtgaccaatacgagtcgtttatccggagtgccttcaagaatcgccgacatgcgttcgcatcctttgtttgagtcgctgtgtgatttacgccttaaccagtgtacaagcaccccgccgcagcgaacgccacggcggggtgcttatttcgtaagagtgttgagattgccgaaattactcggagaactcgacactgaccttattgtctttgatggtgaagttgccgttgacctccttgccttcaagcgtgtacgtcagctgggcgctcacggtgccatcggcattattggaggtctgcgagatgcgcgcgttggtgatgcgcgtgttctcgcccgaggatgccttgctggtcagcagtgcgcgctggttcgtattcacgtgaggatcggcgatggtgttggccttgtcgtagttgccggaggagatggcggccacatagctgttcgcaacgctcttcgcgctgaacacggcggaagacagcacgccatacacgataccgaacagcacgaggaagccggccacggcaccaacgatgatgaagattttcttctgttgctcattcatggtggtggaggtcgcgccaggtgcggctaccggtgccgctccgggagtgatgggagccgcgggctgcgtgggcttggccaaaacggtggacatcgcgaaaccggcaagaatatgggcataccctgtcccgcctcatatatagactgtccaagttgcccgaagaggcggtgccggtttggtgctgcgtcatgggctaacacgcatacacactcctgccacggaacgtccgtggccgaatagtccgaaggaggtgggtgatgtctgcgcacaagtacgaactgatgttcatcgccgatcctgagctggatgagcgcggtctgaagaagctgaccgagcagtatctggaactcgtcaccaaggaaggcggctctttcgatgagcccgattactggggccgtcgcaagctcgcctatgagattgccggtaagaccgaaggcaactacgtcgtggtgaagtacaccgccgagcccgctaccagcgatgagcttgaccgtgttctgaacctcaacgaatccgtgatccgtacgaagattcttcgtaagggctgaatcaagcgtttagtcagctgaacagctggtattcaaggtaagtaagaaggaccgttatggcaggtgaaaccgtcatcaccatcgtgggcaacctcactgcggaccccgagctgcgcactattggcagcggtgcgaccgtggcgagcttcacgattgcttccaccccgcgaacctggaatcgtcagaccaaccagttcgaggatggtcaggcgctgttcatgaggtgctccgcttggcgtgatctggccgaccactgcgcccagtccctgaagaagggcatgcgcgtgattgccaccggtcgcctccagcagcgttcctatcaggcacaggatggttcccagcgaaccgtcgtggagatgcagctcgatgaaatcgggccctccctgcgctacgccaccgcacaggtgactcgccagtcgtccggtcagggcggcttccagggtcgttccggtggtttccagggtggtcagcagcccaatcagggctatggcaaccagggtggccaaggtggttatgccggtggccagggcggttacaacggtggctatcagggtggtggcgctggatactcccagcagtctgccgctcccgccaacccgtccgctcctgcggtcgacccgtggagtaatgccggtgcatctgatgccggtagcttctccacgttcggcgcttcctccgatttcggcggcgacgattccgacccggagttctgatcagtacttgcctccccgctgccagcagcaatcaatatcaagatttataaggagaacatcatgtcacgtaagaggccgcaaccgccggtcaagccgttcaagaagaagccgaacccgctgaaggccgccaaggtcaccgagatcgattacaaggacgttgcgctgctgcgtaagttcatttccgatcgcggcaagatccgttcccgtcgtatcaccggcgtgaccgtgcaggagcagcgtgagctgtccaaggcgatcaagaacgcccgcgagatggccctgctgccgtacgccacctcgggtcgctgagttagggaggctttgaacaatggctgaaaccaaggttattctcaccaagaccgtgtccaacctgggccattccggtgacgttgtcgacgtgaagtccggctacgcccgcaactacctgttcccgcagggcctcgctttcgcgtggaccaagggcgctgaggctcagatcgtcgctatgaagcgcgctcgtctggccaaggccgtcgctacccgcgaggacgccgtcgccgctaaggccgccatcgagggcactaccgtcgagatcgccgccaaggtgtccgagtccggcaagctgttcggtggtatctccaacgaggccatcgccgtcgctctgtccgacaaggctgcggtgaacccgaaggccatcgaggtcgagaccatcaagaccaccggcgatttccccgccaaggtggccctccacccggagatcaccgcttccttcttcgtgaaggtcgtggccgagtgagtcattccggcctagtgctggaatcacacagaccaagagtctgagcttaagcatcatccccgtgcggtttgcgccgcatgggggatttttgtattagcaaaaacgccggaaataggcgcgacacgccgagagttgcattcgcttcaaatctgagtatatttatcacctgttgcaaggaatacttcaacatctaaccaagcccctgtagctcagttggttagagcagctgactcttaatcagcgtgtccagggttcgaatccctgcgggggcacagacaaccggaatcgaaagattccggttttttgttttttccagtatcagtccgtagctggtgcggaaaggccgtcttcgcgcgtgacggccggacgtgtaaggagcaacgtcatgcctcagatattcacgttcaccgtatccgaccccgaaggcatgcacgcccgcccggctggccggttggttgccaaagcgcaggaatatgaatcgagcatcaccgttgcctacggtggaaaatccgtggatgccaagcgtatcttcggtgttatgggacttgatgttcaacaaggtgacgaggttacggttcgggtgcagggcaacgatgaagctgtcgctgctgcagagttcgagcgattcctcaaggagcacctgtaatgagaacgatacagggcgtcagcgtatccgctggcattgctatcggcacggtccgcgtgctcgccgccgtagattatgccgtagaacgccgcttaatcgacgacccgcaggccgagatggatcgattccgcgcggcccgtgacacggccgtcgctcagctcaagcaactgcgtgacaacgtcgccgctgagttcggcgaaaacaaggccgaactgttcgacgcccatcggcttatgctccaggacccggactatgcggaatgcgtcgaaggtttgattgcgcaagacaaggtgaacgccgaattcgcggtgaagagcgccgccgaacagttcgccgccatgttcgctgcgatggatagctcgaccatgcaggctcgagccgctgatgtcaaggatgtttctcgccgcgtgatgaacgtgctgcaaggcaaacgcgatagcacggcgcaggatggcagtgtacaaggcgatgctgtgcagaacggtattgtgcagaacgggatcgcgcagaacggcgaaagccacatcatcttcgccgaagatcttgctcccagcgataccgcgcagctcgaccgcgctaaggttttgggcctcgtgaccgccaagggctcagcgaactcgcacaccgcgattctggcgcgcacgatgggcctgcccgccatcacaggtatcggcgacgcctttgacccggccgatgatggtcacgttgccgtaatcgacggcaccagcggtgcggtattcgtcgacccggacgaggccacgctgaccgaataccggcgcaggaaggccgaggctgaggagcacctaagcctcctgcggaagctcaagggcaagcccaccgaaaccaagtccggtcagcgggtccacctgtacgccaacatcagccgtccctctgacgcagccgccgtgctggccaacgatgctgagggcatcggcttgttccgcagtgagttcctgtatctggaacgcgaggactggccgaccgaggaatttcagttcgatgcatacggacaagtcgcacaggagatgggcgaccgtccggtcatcatccgtacgctcgacatcggcgcggacaaacaggtcgactacttcaatctgagccacgaggataatcccgcgcttggttaccgggcaatccgcatctgcctgacccgcccggagattttcaaagtccagttacgcgcattattgcgcgcctcagcatacggcaacatcgccattatgctgcccatgatcacctctgtgcaggaggtacgcgacgccaagcggattcttgaagaagccaaaagcgagctgcgcggcgagcgcatcgacttcaacgagagtatccagatcggcgttatgattgagacgcctgcgtcggtcattatggccgacgagctggccgccgaagtcgatttcttctccatcggcaccaacgacctgacccagtacacgctggcctgtgaccgtcagaacccgagtctcgaacgctttgccgacccgcattcaccagctgtgctgcgcatgatccagatgactatcgaggctgcccatcgtcatggcatctggtgcggcatctgcggcgagcttggcgcagacttgagcctgaccgatacgttcctgcgcctaggaatcgacgaactgtccgtctcgcccaccagcgtcctgcccctgcgcaacgtcattcgcaaccactgagattcaaggtcgcttcggctgattccgatggctttttgggcattgcattcggctggacattcgacatcgcatcttgccggcatttcgtcgtggggcaaagtgtacaatcaccacgtttgctttcgcgcccagcgtaaatcgcgtcgccggctccgcgaacggatttccagtcacacagaatgccgtgaacagtcagccatgcctgttgcgcggcgaagagaaaagaagaagcagtggattatcctctctttaccaagctggccgccgagttcttcggcaccgccattctgatgatcttcggcaacggctccgtggccaacgttgagctcaagaacaccaagggccaccacgccggctggctgaacatcgccatgggctacggcttcggcgtcatgttcccggtgctcatgttcggtagcgtctccggcgcgcacatcaacccggccatgaccatcgcccaggccgtcaacggcctgttcccgtggagcgacgtgctgccgtacatcgtcgcccagctgctcggcgccctgctcggccagctcatcgtctacatcacttactacccgcactacaaggagaccgaggacgccgaggcgattctgggcaccttctgcaccactgacgcggacaaccagaaggtcaactacttcctcaacgagatgttcggcaccctggtgctcgtcttcggcgccctgtgctgcctgtccctggcttggggcaagcaggattacgccgccgcctccatcgtcgtcggcttcattgtgtggggcctcgtgacctccatgggtggcccgaccggccctggcctgaacccggcccgcgacctcatgccgcgtctgctgcacgccatcctgccgatcccgcacaagggctcctcccgctggggcgaggcctggatcccggttgtggccccgattgtcggcgccattatcggcgcttggctgttcgtgttcttcttcgccagctgattcgttgattgattcatatatgcaaatggcctccgctcgttttgggcggaggccattgtcgttgaatcaggtaaacgcagagactactgctccaggaacacctgcggggccttcatgaagttcgtggcacagtgttcgccgcagaagtaataggacttgccctcatactcgcgcgtgatcgcatcggcgttcacagccacggtcatgccgcacaccgggtcggtggcggtttcgccgtccgcaggggcggtgtggtgcatgtgcattcccgtatccatagtgttctccttgttggttggattattggattggtcagatacgtgattggtttgattcagcgtggtgcgatcgtcgatgatgacggtcggctcgtgaggcgcgttggatgtggcggagccggtgatgttggcggcgttggcggattcggccgatccggctgattcgacatccgccgtgctgctgcccgaaccggcgggaccatcggcagcacccacgttgatgttcgctccatgcagccggttcgcgttcagcaccaggcacactgagctcaacgccatcgccagacccgcgatcatcgggctcaacagccagccggtgaacgggtagagtacgccggcggccaccggaatgccgatgacgttgtagccgaacgcccaccccagattctcgcggatgttgcgcatcgtggcattggacaggttgatggtcttgatgacgccgcgcaagtcgccgctcatcaaggtcacgtccgccgactgcatcgccacgtccgtgccggtgccgatggcgatgccgagatccgcctgagccagcgcgggggcgtcgttgatgccgtcgcccaccatcgcaatcagagtgcgggattgtgcggccgtgcgggaggtgccgtacgcggacttggcggcggcctcgtcgcgttcgcgctgcagtttggcgatccagtaggccttgccgtccggcttgacctcgcagatcaccgtatcgatgccgacttcgcgggcgatgcgcccggctacctcggccttgtcgcccgacagcatcaccgtgcggatgccgcgtgcgcgcaacgccgcgacggcctcacgcgagccttccttgactgtgtcctgctcgtagctcggcttgtcccagtcggcggccgcgtccaccacgccgcgcgtgatggtgccggtcttgtcgaacaccacggtgccgatgcgacgcgcctgttccagcgccttggcactggtgaccagcacgccgttggtggcgcccaagcccagcgagaccgtcaccgacagcggcgtggccagtcccagcgcgcacgggcaggcgatgatcagcacactgaccgcagtgaccagcgcgtgcgccagttgcggcgccgggcccagtgacacccagatggcgaacgtccagatggcgatgatcatcaccgccggtacgaaataccgggcgatcttatcggccagttgctgcaccggcgccttggtcgcctgggcgcgggccaccatcgccgcgatctgcgagagtaccgtgtccgcgccgacttgggtggcgcgcatcacgcagtcgcccttgagcagcacggtggccccggtcaccgggtcgcctgcggttttggagaccggcttggattcgccggtgatcatcgattcgtcgatacgcgcctcgccggccacgatcacgccgtccgtgggcacgcgctcgccgttcttgacgatcagcaggtcgccggtgacgatggcgtcgatgtcggtgtccgtgaaatgcgccggattacgccattcgatgccgtccacattgtctgcggaagtggcgttgagcttgtgcgcggtgcgcgggcgcagtctgataagcgactgcaccgccttgccggtgccttcgcgggccttggcctccagcaggcggccgaccagcaccagggtgatgaccacgccgaccgattcgaaatacggctcgcgcgagccctccgggaacacccacggggcgatgcaggtcaccagcgaatacaggtaggcggccgaagtgcccagcgagaccagcgagttcatgtcgggggagcggtgcgccagcgcggggaagccgaccgtgtggatcggacgcccgcagtagaacatcaccggcgtgatgagaatggcctgcagccacgggttcaccatccaatgcggcaccagcgcgggattggccatatgcagcatggtgacggcgaataccggcaacgtcagtaccgcgcccacaatcaccagcttcgtcagcgccttgatctcattggcgcgttcagccgcctctcgccgctcggcctccgccgcatccacaaccggagctccaacccgcaagtctgagggagagaccccctcggcttcggccgagccgtcagcacgcgggcgaagcccgtccttatccgcaccgtccttactctcctctccctcaaccctcaacaacccatgcaccatattcatgccgcatgcaaacggatattcgcccgccggcaacgccggtagttccacgtcggtggtggcgttgcccggcagcatggcgtcaagccccagatccgcgaacaccacatgcgaagtgcattcgccggtctcctgtcgatcgaaagtcagcgtgatcggcgtacccgtgcgcatgctgatcacggcgggggagtacccgcccttgacggtgattgttgcggattggcgttcgccggaggcgtccatggccccggccgtggctttctgcgttccgaagaagaaccgcagtaccagccatgtcaatgcggccgccgctatcagcgccgtggcggccgagaagatgctgagctccataaccgttccttccccttgtttgttgtactgaacaacagtgtataccctatacccctagagggtatataatggggtgtgttcagctgacggataagtatcagggggtttgcgatgcatggttatgacgaagacaaggccaaggtcatcgcacgattgcgccgtatcgaaggacaggtgcgtgccatcacgcagatggtggaggatgacaaatactgcatcgatatcctgacgcagatttcggcgtcgaattcggcgctgaaatccgtggcgttattgctgctggacgatcatctcaaccattgcgtgcggcaggcgtcgattcagggcggcgaggtggccgatgaaaaacttgcggaggcttccgcggccattgcgcgtctcgtcaaatcgtgacgagttttaccgtcattcaccatcgatgacatactgggtaccatgtttgagcaaataggaaccgtgattatcgtcatcgtcgtgctagtggttggtgcagggcttggcctcttcgccggcttcgtgctaggccgtcataagggtcaggagatggctcgaggcgtcaaaagcgaggagctggaagaggccaagacctcgctggagaatgcgcgattcgagaacgctgagctcagtgctcgcaatgctgccgcacaggctcagattgaaggcgtgaaccagcaattggctttcgccaagtcacaacttgcccaggcgcagcaggctgagcagattcgcattcagcaggaacgtgagcgtgcagctgcggaggcagaacggaagcgtcaggcggatgctcaggccgccgaggccaagcgtgctgaacaggaagcacgtttgaaagaacagagcaaggtgctcgaggcgcttgcgccagtggccaagaatcttgataccttgcagaacaaggtcacgcagatcgaagagggccgcaagagggaaatgggcgcattgggagcccaactcaaggggctcaacgatcagcaggcccgtttggacaaggaaaccagttccttgtccgccgcgttgcgcaacaacaaggtgcgtggcgcgtggggcgaggcccagctcaagaacattgtcgagtccgccggattgctggaacatgtcgatttcgacacccaggtggtggtcacggatgccgatgggcgtacgttgcgcccggatatgatcgtgcatctgccgggaggcaagaccattccgattgatgccaaagtgccttatgccgattaccagcgtgcctgcgaaatcccggacaccgccagccccgaggatattgcccgccgcgatgatttgctgcggtcccatgccaaggcgttgcgcgagcatgtacgtgctctcggcgaaaaggcctattggaatgcctttgatgtagcacctgattttgtggtggccttcatccccaatgaggcactactgcaggccgcgctcgaagccgatcccacactgatggatgatgcgttctctcgcaaagtggcgctcacctcgccggtcacgctctgggccgtgctgaaatccgtggcctatgcctggcagcagcagtcgctcaccgatgacgccaagcagctgttcgatttgtcccgagaactgtacgaacggttctccacgctgggtgattatgccatcaaattgggcacccagattactaagacggtcagcgcctacaacaagttcgcgtccagtttggaacgccgtgtgttgcccaccgctcgcaagctgcaaaaaatcgaaccgaccaagatcatcgaggaagtaccgatcatcgaatcagataaaggcaatgtgagcgaactgtccgcccctgaagtggtgccggccgatgaaggtgatactcatctgactgcctcaggcgatagtctggagtcatgactgaatctggattccgccccactggtaccccggaccttgccgtcgcgaagagccataatgactttgccatgctggagccgcgtgaacagctagccaccttgctgaaggagcatgtggtgggccgtccgttctccgaacttgccgcggtgactttcgaccaccgtgccgccactgtcatgggccatgtactgattgacgctttggaagatgcgggctattcgattgatgacttcgatgctgttggtgccttgaccgcagcatctgtgcccatggtgtctgccatgatccaggccgccgcctctcgtggcgaggacctagatggattcgtgatggacttcgtctacccgtccatcaagggcccctccatcgaaggccgccgtgtggtgctgttggatgcttggctgtccgaaaagtcgtacgtgcagacaagctcgctggtcaccctgcgcaacggcaatgagctgagcctcgactttggcatagtggagcagctgggtgccaaggtcgtggccatcgcctcgctggtcggtggcggtgccaaagacatcaatgtggtcaacccctccaccggcgacgagcaaacgctccccttcatccaggtcttcgacgaatccgaactgcggtaaatccacctttgacgtccctcgcataaagtcagccgggctgagcagcgaagctgactaagaggaaccggtgaatagcgttatcgaggagaaagattgcacgcacccaaccagatttctttggctgccaaggcttcaggtgaaccggaattccgtgaaatcggccttgggccgtggtctgagacccatcccggtgagcctcgtcccgatgatccgacttcttcgaattatgacggtcgtttcgactcggtgctgttgaacgacggagaccgccgcaacgtattggaccgttaccgctactggaccgttgctgccattaaggccgatcttgacgctcgagggcgtcacgacttcgaagttgcggtggaaaactggacccacgattttaacatcggttccatggtccgcaccgctaatgccttccaggccaagcgcgtacacattgtcggtccacataagtggaatcgcaagggcgcgttgatgaccgaactgtaccagcacgtcgaacaccacccctccatcgccgaactggtggaaagctggcatcatcgcatcgccggtgaaatcgcctatgaacgagccaaggccggtgccgccgccatccatgcgcatgatgtggctgtggatggagacaacaagcaccttcatgagctgctggccgaaatcgatgcttgtgatgcacgcatcaaggagcttcaagccgcccgcgtcatcgccctcgacattattcccggcgcagtgccgatggaagcctatgccttccccaagcggtgcctgctgctcttcggtgcagaaggccccggattgagcgagaaggccctcgcattggccgacgatgtggtctacatctctcaattcggttccgtgcgctccattaatgcaggcgctgcggcggccgtggccatgcacgcatggattgcccaacacgccgtatcaggcgtgtagccatgcgccgacaatcctgccgcatggatcggcggtctcatcgtcaccagaaaagcggatatcaaataatgacccgagtgcctgccctgctgaaatggtctcaaagggtaggaaaatgcggtttcccgacaactgcgtgtcacatacggctcatatagttatggccatgccaacattttcacgcgaagaaatcgtgcatttgggcgatctggcccgaatcgcgctcaccgatgaggaaatcacccgtctgcagggcgaactgaacgtcatcgcagactccatcaacaaggtccaggaagtcgcctccgacgatgtgccgccgaccgccaacccggttccgctggaagcctacctgcgcccggacgtcgccgaaaccccgctcacgcaggaagaggcgctcgccggtggcccgaagaccgaggccggcatgttcgtggcaccgcgaatcctgggaagcgaggagtaatcgatgagcaacgaaaccgcaactctcgtcaaactgtctgctgccgagcaggccgctgccgtcaagaagggcgacgtcacctctcgcgagctcgtcgaagcccacctcaaggtgatcgaggctgccgagccgtccatcaaggccttcctgaaggtttccggcgatgtggctctcgagcaggccgacgccttcgacgccaagtccgccgaagacaaggccgccctgcctgagctggctggtgtgccgattgccatcaaggacatgatcgtcaccaagggcatcgaaaccaccgccgcctccaagatcctcgagggctgggtgccgccgtacgacgccaccgtcatcgaaaagctcaaggccgccggcatgccgattctcggcaagaccaacctcgacgaattcgcccaggggtcctccaccgagcactccgcctaccagaccacccacaacccgtgggataccgagcgcgtgcccggcggttccggtggtggctccgcctccgcagtcgccgcattcgaggcaccgatcgccctcggcaccgacactggtggctcgattcgccagcccggcgccctgaccggcaccgtgggcgtcaaacccacctacggcggcgtctcccgtttcggagccatcgccatggcctcctcgctcgaccagatcggcccggtctcccgcaccgtgctcgactccgcactgctgcaggagatcatcggtggccacgacaagcgtgactccacctccatccccgaaggcccgcgcccgatggtcgccgccgcccgcgaaggcgccaagcgcgatctgaagggtatgaaggtcggcctcatcaaggaactcggcggcgacggcttccagcccggcgtcgaggcccgcttcaacgaggccgtcgacaagctcaaggagatgggtgccgaggtcgttgaggtctcggtcccgcacatcggctactcgctaggcgcttactacatcatcatgccgtccgaggtcagctccaacctggcccgttacgatggcatgcgctacggcctgcgcgtgatgccgccgaccggcgtgccgcagaccgccgccaacatgatggcctacacccgtgaagccggcttcggcgacgaggtcaagcgccgtatcatcctcggcacctacgccctgtccgccggctactacgacgcctggtacggctcggcccagaaggtccgcacgctgattatcgaagacttcaagaaggccttcgaacaggtcgacgtgctcgtggcccccaccagcccgtccaccgccttcaagttcggcgagaagatggacgacccgctggccatgtacatgaacgacatcgccaccattccggccaacctcgccggcgtgcctgccatgtccatcccggccggcctgtccgacgacggcctgcccgtcggcttccagttcatcgccccgcagcagcgcgacgaagtcatgtacaagccggccgcggccctcgaagccgcgctggaagacagctggaacggcccgatctggaacgacctcaagaccccgtggcttgacggtctgggcaagtgagcatcggaaggaaagaaacaacatcatggctgaaaaactgatgaagtacgccgatgccaccaagaagtacgatgtggtcttcggtctggaaacccacgtggagctgtccacgaacaccaagctgttctgcccggcccacatcgagttcggtggcgagccgaacaccgagctgaccccggtgagccttggcctgccgggctctctgccggtgatcaacaagaccgccgtcgattacgccatcaagctgggtctggccctgcactgcgaaatcgccgagtggagccagttcgcccgtaagaactacttctacccggacatgccgcgcgactaccagatctcgcagtacgacaagcccaccaacggcaacggctacctggacgtcgagctggaagacggcaccgtgttccgcgtgccgatcgagcgcgcgcacatcgaggacgacgccggcaagaacacccacgtgggtggcgccgacggccgtatcgaaggtgccgaccactcgctggtcgactacaaccgtgccggtgtgccgctgattgagatcgtcaccaagccgatcgagggggcgggcgaccgcgctcccgaaatcgccggtgcctatgtgcgcgccatccgcgacatcgtgcgcgcgttgaacatctcccacgctcgtatggagcagggcaacatgcgcgctgacgtgaacgtctcgttgcgcccgagcccggacgctccgtacggcacccgttccgagaccaagaatgtgaactcgttccgcggcatcgagaagaccatccagtacgagattcgccgtcaggccgctcgtctggacgacggcaaggagattctgcaggagacccgccactgggatgaggctacgcagaccaccgctggcggccgtctgaagtccgatgccgacgactaccgctacttcccggaccccgacctcgtcatgctccacatcaccaaggagcacatcgaggagatgaaggcccagatgccggaaatgccgcgcgagcgccgcaaccgcctcaagtccgagtggggcctgagtgatctgcagatgcgcgacatcctcaacgccgacgccctcgacctgattgaggaaaccgtcaaggccggtgccaaggctgccggtgcccgcaagtggtggctgggcgagctttcccgcgaagccaacgccaagggtgtgtccctcgaagagctgccgatcaccccggccgatgtggccgaggtcgagaagctcatcgcctccggcaagctcaacgacaagctcgccaagcagaccgtcgaaggcgtgcttaagggcgaaggcactccggatgaagtcgtcaagaagcacgactacaagatcgtcgaagacaacggtgccatcgaggcggccgtcgacgcggcgttcgaagccaacccggacgttgtcgagaagctcaagagcggcaacatgaagccgatgggtgtaatcatcggtgccgtgatgaaggccacgcgcggtcaggccgacgccaaggccgtcaccaaggtcgtcatgggcaagatcaagggctgattagattcactggctcccgctggtgggagctgtcgaacggagtgagactgagggtggtcgccatgtacggatgaccaccctcagtccgcttcgcggacagctcccgccagcgggagcacttatttgtagggaaattctccagttcaaatccgttagacagctcccgccagcgggagcctttattgattctgtaagaaagtcgactcagagcatttccagcgttcacccagtcgagtaagatatgttcggcactggaccgtgagccgaaacaagccgaaccgggggacgtataccgatgaccgcaaccaacgagacgctgagcatggctaccgaagcgcaactgaagcgcgatctgccacagagcatcgtcattccgccaatccgtggcgaaatggtgcacctgcgccccgccaccgtcgaggacctgcctcgtttggatgaacttgatgccttctatggcgcatccaagatcacaggtaaggatgcggtcaccgaacgcgccatcgtacacacgtgggtccgccgctcccaggcttgggaagccggtcaggcacccgccgaatccggtgtgggtgatccggaatcccgccgcaccatcgcatgggccgtattgactgacgccgaccatgacgatgacggtcagctcgatgcggccagcaccgataatgtcatcggcatgattttccttatcgacatcgacggctggtccaagtccgcccgcatccagatcatcttgggccgtgaataccgtggccgcggctactcccgtgacgccatgccgcgtgtgatgacctacggtttcgcgcccgaaccggccggcttgggcatgcaccgcatctgggtgagcgtgccggaaaagaacagccgctcgatttcggtctaccagtcgctcggcttcgtgccgtccggcacctcgcgcgacgcgttgtgggatgccgaaaacaacaaataccaggaccttatcgtcatggacacgttggctgacgagtacgatccgattcgttcgcttgacgcttttggcatgcacttgattgaggacaacccgggtgtcaaggaagcgctgtccgcgcgcgagcattccatcgccatccagcagaacaagccggaacccgagccggcacagcgtggtgaggcagccggcgccacgacgagtgacgtgcagtcccaggcccagacgccggcggccgcacagccagtcgagccacaggccgagcaccacgacgatacgcagaagaacacgcgccacagtctcgaagaggaaagcaactggccgtacggtcaggcagaacgcaagccctcaaaggaagcatggtggcgtacgctgggccgcggccgcaaacgcgatacggaaagtgagtgagtaaacaagcatgagtgccgaggatctcgacaattacgaaaccgacgccgaactcgcgctgtatagggaataccgtgacgtcatcaagctgttcacctatgtggtggagactgagcgtcgcttctacttggcgaataaggtcgatttcaacgtgcgttccgctggtcaggacgtgtatttcgatgtgcagctgactgacgcatgggtatgggatgtctaccgttccagccgtttcgtcaagtccgtgcgcatcgtgaccttcaaggacgtgaacgtcgaagaagtccagaaaaccgatatcgacattcccgacgatattcactgacaggcaatcgtctgatacagcctgtattgacaatgcgcggcattccgtcatcttacggcggggcgtcgcgcattgttcatacaacgcatagcaaaagttcagactcgtaaccttgccatcgtgtgtcttgtttgcttgcggctgatagaaaatgctgcatgaacacacaccatatgcagcagggccttaagggctccatcgcgggcgtggttgctgccgccacattgctggccggtggcatcctgaccgttccgcacgccatggctttggaggccgatggccagtattacagcagcaagcagccatatgtggcacctagcgaagcgaccactgccagctatagccaggcgccggaaggctacgaaacggtatacaccgagtcgatggctcgccacggttcacgcggcctgtccagctacaaatacgacgcattgcttatgaagatggccgaagccgccgaagcggataacggttttaagtctgatgccatcaagtccgaattcatgaagaatctcaaagccatcaccgccgcaaatgtggagaatggctacggtatgctcaccggtcagggtgctgaccaacatcagggcattggcgcacgtgcctacgagcgcaacaagacgctgttcgacaacgcagccaaggacggcggcaagatcgcctaccagtcctccggcgaagcccgcgctactgaatcaggcgagaattttgctcgcggtttcaacgcggcctcgaacaataaactggcgaacagcactgtgacgcccgccgatccggccggcaccggcgaggcggcggctttcgacaagacgccgaacacgctgtacttccacaagtccgaaaacccggacggcactgagaaaaccggtgaggccaagcagcgtgccgacgattaccagaacttcgtggaaaacgatgcgattatcgcaggcgctgagcaaaccatcgccgaaaacgaggacgtgaaaacagcctctcacgatttgctttcacaaatcttcaccgatgacttcctcgccaaactggccgacggcacgtacgcctggtacaacactgtcgatggcaccaagggcggcgaggccaactgcgcgccgggagccgaccccagcaaggatgccgacgcctgcggcgcagccaagaagaagatcgcctccgaatacgatgccgcgatggatctgtacaacctgtacatcatcgccgctgatatggagaacgagaacaccggcagccataccttcgacttcaaccagtacttccaaggtgagcaggcagacgacgccaagttgttcgcctgggcgcttgacgccgaggacttctacgagaagggcccgagctacgccggccaagacgagacctacacaatcgcacagccgctgcttgacgatttcttctcgtcgattgatgagcgcgtaaacggcggatccaccgttgctactttccgctttgcccatgccgaaacgatgatgccgttcgccgcgctgcttggccttcccggttccacccagcaggcggccgccagcaccaccgacgtgtacacctacgccaacaatgaatggcgcggtgaatcggtgactccgatggccgctaatgtgcagtgggatgttgccgtcaaatccggcaacgacccgaagaccggccgtgcctacacgccgctcgttcgtatgctctacaacgagcaggaaatcgccttccgctccgaatgcacgccgattgccgatggttccacgtggtacaagctcactgagcttaaaagttgcttggcctccgaccaccaaaccctaggcgacgatgcgcatctgactgatgattccacaacgcagccgggcacaggacctaacactggtgaaggaacgagtaccactccgaataacaatggtgcgggaactcatcagcccagcaacactcaggctaatggtacggaaaacgagttgagtcgtaccggtgttgccgttactggtgttgcggggattatgatgctgcttgcacttgcaggcatctcgctgaatctatggaaagttcgtcgctgacgaattagcctaagaccaaaccgattcgccgcgctgtgtgtgacgcaacgttgccgaatacccctacctcacgattcgatgcgtcgcctttctgctgatggaaagacggcgcatcggtcgtatatcgggagaattctgtaagcattcgctcatctttcggtgtgcgattccggggcttctagtagactgtctctgattttgcgtttataaggagcataatgaccgacaagcaatccgtagtgattatcggcggcggtccggctggacttaccgccgcatgggaactcatcaaggacggcggtgccgacaagtacgacgtgaccgtgctggaggggacccgcgaattcggcggtatctcgcgcaccgtgaagcacaacggcaaccgcatggatatcggcggccaccgtttcttctccaaagacgaacgcatcatggattggtggaagaccgttctgccgttgcagggcgcaccctcctatgatgacaagaagctcggccgcgaccacgacatggagccgggcggccccgatccggagacggaggacaaggtgatgctcaagcgccaccgagtgtcccgtatcttctggaaccgccacttcttcgattacccgatttcgctgagccccaacacgttgaaggccatgggcttcaagctcaccatggtggccggcttcagctacctgaagtccatgttccacaagctgccggaagacaatctggagaacttctacatcaaccgtttcggccgcaagctgtattcgatgttcttcgagggctacacggagaagctgtggggccgccacccctcccagatctccgccgactggggcgcccagcgcgtcaagggcctgtccatcatgggcgtgctcaagaacgccttccagaagctgctgcccaagaagcgctccaacgcggaggtcgagacctcgctgatcgaggagttctggtatccgaagtacggtcccggccagctgtgggagaccgtcgagtccaattgcgaggccgccggcgtcaaggtgctgaccgacgccagggtggtcgaggtccgccagaccgatggtgccgtgtcttccgtggtgtacgaggattccgagggcaaccgcaccgagctttccggcgaccagttcatctcctcgatgccggtcaaggacctggtcaacgccatcgacgcggccggcgccgatcccgaggccgttgattccaagcccgccccggccgatatgaccgaggtggccaacggcctgccgtaccgcgatttcgtgaccgtgggcctgctggtcaagcacctgaagctcaagaacaccaccagcatccccaccctcggcaatccgccgatcgtgccggactgctggatctacgtgcaggacccgggctacaaggtcggccgtctgcagatcttcaacaactggagcccgtacctggtcaaggacgtggacgacaccgtgtggatcggtctcgagtacttctgcgaggagggcgactcgttctggaacatgagcgaggaggatgtcaccaagttcgcgatttccgagctcacccgcatgcgtgtgatcaacggtccggacgaggtcatcgactcccatcgtgagcgcgtcaggaaggcgtaccccgcctacttcgacacctatgagcacatggacgagctcatcgagtacctcgacggcttcggcaacctgtactgcgtgggccgtaacggccagcaccgctacaacaacatggaccactccatggccaccgccatggaggccgtcggcaacatcaagaccggcaagacgtccaagaagaacgtgtggtccgtcaacaccgaaaagtcctaccacgaagaaaagtgaataaaccttgttgagctccctcgtcacagagggagcttttttggttttcggcgggccgttttgcgttggtcgagttggcgttgtacagtgaacgaagttcgcagagactcagagacgcagcgaacattcatgagcggtgcaaccgcaataatcactcttaacgcctggataggcatgggtctgttcggtatggaaagggcaaccagtggcaaatagccagaatcttgaggatatgaagctgcctgagctcaaagagctcgctaaacagatgggcctgcgcggcacgtcgaccatgcgcaagcccgagctgctcgccaccctgcaggcggcgcgcaatggtggagagccgccggccggtgtgaccgtgcgcgcccccaaggccgccaaaaccgccaaggtcgtcaaggctccgcagtccgatgccgctgaggccaacaccacagacaatgctgacgtggccacccagtcgccggctccggctccggctgccacggaaccgcagctcgatttgccgcttcccgtggccgacgatgccaagaaggacgagaccgaaccgcgacgcacccgtcgtaaggccgccgatgatgccgcatccgaaccgcgtgcggcccgccgtcgtcgcgatgacgaccagcccgatttcgctcgccgcaagccgcgcaagaaggccgatgaggccggcgatctgctggccacgctcgatttgggagatgcagcgcctaccgagcgtcgccgcgagcgtcacgaggacgtggaagttccgctgattcgccgagtccgtgatgatgaggacgagcagcctcgccgccgtcgtcgcactgcggaaaacagcgaagaaaccgtgcgtgacctcgacgatatcctggccacgctgcccacgcagaagcacgaggaaacgtccgaagacggcgagcagaacgacgatcacgagttcgtgcgtcgtaaccgccgcgaccgtagcgatcgcaacgatcgcgatacccgtaatgatcgcagcgatcgccgtaaccgtcgcatgcgtggccgtgatcgcgacaacgccgatgatgatcgtcgctatgatgatcgcgataatcgtagcgatcgcaatgaccgtgatagccgccgcgaagagccgcaggaggatctggtgccggtggccggcatcgtcgacgtgctcgactcctacgcttttgtgcgcacttccggctacctgcccggcccgaacgacgtgtacgtttccatgggccaggtcaagaagtacggcctgcgcaagggcgatgccgtgcatggttcgattcgcgccccgcgtgaaggcgaccgccgcaaccagcgccagaagttcgtgccgctgcaggccatcgattccatcaacggccaaagcgttgaagaagcgctcaaccgtccgcagttctccaagctcacgccgctgtacccgcaggagcgtttgaagcaggagaccgccccgaacaagctcaccggccgtatcatggacatcgtttccccaatcggcaagggccagcgtggcctgattgtctccccgccgaaggccggtaagaccatcaccctgcagaacatcgccaactccatcgccgccaacaaccccgaggtccaccttatggtggtgctcgtggacgagcgacccgaagaggtcaccgatatggagcgcacggtccagggcgaggtcatttcctccaccttcgaccgtccggcctccgatcacactacggttgccgaactggccgtcgaacgcgccaagcgtcttgtggagctcggccaggacgtggtcgtactgctcgattccatgacccgactggctcgcgcttacaacatcgcagcccctgcctccggccgcatcctgtccggtggtgtggacgcgcaggccctctacccgccgaagaagttcttcggtgcggcccgcaacatcgaaaacggcggctccctgaccatcatctcatctgcgctggtggaaaccggctccaagatggacgaggtgattttcgaggagttcaagggcaccggcaacatggaactgcgcctgtcccgcgagctggcggacaagcgactgttcccggccatcgacatcaacgcttccggcacccgccgcgaggagctcatcaccaacccgcaggaactgccgattatctaccgtctgcgtcgactgctgggcggcatggagcccgagcaggcctaccagacgctggtgccgcgcctcaagaagaccgccaccaaccgcgacttcctcgccgccatcgtgcagcaggccaacaccggcaacgcggtcaacggcaactgatcagaccgctgaacaatagtgtaagggctgcaccctgattgatacggggtgcagcccttgtcgtatctgatgcaaatacatcaactatcacattgcagttgtagtattgccgtcaacgttcacatgcacgctgacgatatatgagatgaaagaggcatcactgggttcgattgttttgggagtgggcagtggtgcggccatgttcggcgatgcggatgccagccatatcctcaccggcgactatgacatctgagatatctgactttgcgcatcgtgcaaagccgtaatcgggagtatcctcgaatctatgagcgaaacgagcagcgactggcaaaggaccaccatcgactccgcccaggcggcggcccacccggaaaccgcacaagcggtggcgcgcatcaaagcgctgcgccaaaccatcgataacatcgattcggcggtcatcgcattactggccgagcggttcaaggccacctcgcaggtcggcgtgctcaaagccaacgccggattcgcgcccgaagacaccaagcgtgaggactatcagatcgaacgcctccaccgcatcgccatcgatgccgggcttgatccggaaattgccgaaatgtaccgtgaattcgtggttaccgaagccaagaagcgccaccagcgcatagccgatgccggtggtgacccgggcgtactcgacgtattcgcctgattcgcccgcagcgaatgggcacctttcggatattcgtctatagggcaagttgcctgcagcgactacattaatacgggaatggaatgcccgtagtggtcgactgtatgaatgggatacgtagatgagatgtggtgccgcactggtcagttgcgcattgtgcgtggcttcgattctcggcggtgcttggatgtctcgtccgactccggttgattacggtccggtgctcgctacggcaagtgatatgtacgccgtcaccgatgccgaaggggagccggtccgttggtatgtggtagggaagggcggcgccggcaatggcgccagtgccgattccggcaatagcggttccactgataccgattccgccaatagtaattccggcacgtccaaggtttctcgtatccccgcttccgccgccaccctgccatggaaagtcagcgtcacctactcgcttgacggtccgaacgtcgaggcaaacgaggttgccggcgcgtctggactgatcggcgtgtatatcgatattaagccgcaaaccaaggaagccaaccgtacgatcccggttgtcgcctttaccgtgcctacgcaggtagccgatgatgtttccgctgacaactccattacggtgaccacgcaaggttccaataccgtagtcgccgcagctggaaaagccgcaaccggcttggaattcagctgctatatgaacgccaaagacttctccatgagttccgtggcgctcgccgtattgccttccaattccagcagtccggcagttggtgctaatcccgatgccgcgaatgctgcgaatgctgccgcacagcctgctgccgatacggatgtcgcccaactcaccgcctctgccgccacactggtcgattcactgaccgacgccggttctggtgaacagcaacagctcatcgagcagcttcaaaccctgcgcgataacgaacgtgcgctgaacaagtctgtagtggccgaacgcgaaaccgcccataagcggacgtttgaagactatatggccgcgtatgtgggctcatataccacgcacctgtctggatcgattggcacctccacccagttgccggcgttgatgggcacggccggcgaactgtccggggacacgcctttggctcaagccgtactcgacttggccaacgcggtgaacaacgtcagtgccgcacatcagcatgccggtgcggtcgatgcgttggacgaggtgattcgccgcatccagcagcaaggcaccaccggactggtggatgatctgatcgccgaggcttcggaggaagccactcaaggctccaagcaatacgccgatggccagagccagctctccgccgcaatgattccgtattcgatgaaatacacggacgtttacacggccaatttgagcgccctgaccggcggcacgtcctcgggcgccaccgcttacgagagccaagccatcgccgaaaccaacggtagcgatgaactcgccgacgctcaatccaaggtcgatgccgcgatgagcacgcttgccaccgcctccgagcatacgggcaaagccacggccttgcgccagattgtattgcgattctccgatcagttcgaaggcggcgcgtcctcggcttccggcagtgatggtgatggttcgtccggtgatgtctcttccgatccggtgaccgaggctcaggcactgaccggcctggtcgattcgcaatcgcaatcgttctacggcaagacccgggtcgcccaagccaagcgtaaggccgatgccgcccgtaagcaggccaaagccgcgcaacagcagcagtcgcagcattccaaggcctcactggtcgatgacaccatgtccatgtctgctggcgatgtgatgaactatgcgggtggtcttacttcggccatcggtggtggtgataagtccgactcgtctaagagcgctggttcgggaacgaacgactcagccaagtcgagcgacactggcgattccggcaacggcaaggcctccaacgccagcgattccggcaacaatcttgacaccgctccagtactgttcggctttggcactggcggcacgctgttcaagcacgatatgaacgcgctgattaatgagaccgtgaaaatcagtgatgctggcacgctcttggcgcaggccgtcgcgcagctcgacagccccaatacgcaacaaaaaaccgccgaaacccgatatctcatcgtgattccgacggtgtgatggtgtatgcgggatatttgcgtgccgtcccacagtcgtgtcatccgaacgtcaaaaaacaaaagaggggaacctcaataggttcccctcttttgttgttgtgcgtaacgttcagtgctttggcttcttagctggccgagccgttaagcgggaagcccggtgggcttcccgtaggctcggaacgagcggcattgccgtgagacctactgttgttgtgcgtaacgttcagtgctttggcttcttagctggcggctcaccgagctcgctggcttcgacggcgacctcggtttcgggcgtgccttcggcggcggattcctcggcgtgcttggccaccaagtcgaacttgccgaccacgcgaccggcctgcgcgatatcgcccaaggcggcgtgaatcgcttccacaccttccgaagcagcggacagtgccacagacaggattggggtcttcatggagaccttggcctcggacttgatcttacgcagctgctccacggccttgccggcccaagtcagcagctcgggggaagcaccggtggcggcctcgacatacgggtccacgaccggccaggcggcgcgatgcacggaaccggaaccggcgtgcatccagctccacacttcctcggtggcgtacggcaggtacggggccagcagacgtgcgaaggcgtccaggcccagacccagagcggtgcgggcggacttcacagccttctcggacggcacattgccgtgctcgtccggagtgccataggcgcggttcttgaccagctcgatgtagtcgtcgcagaactgccagaagtaggactcgatgacttccagcgccttggaatgctcgtaggattccagcgcctcggtggcctgacgcaccaccaaagccagcttggccatagcggcgcgatccagcggttcggtcacatcggccgggttccacgcggcctcggcggcagcgcccacgtgatggttctcgtcctcacggccgatggccagcgcgaacttggtggcgttcagcagcttgatggccagtcgacggccaatcttcatctggccgatgtcgtacgtggcatcgaggcctaggcgagcggcggcggcccagtaacgcacggcgtccgcgccgaacttctcgatcggctcgttcggcaccacgacgttgcccttggacttcgacatcttcttgtggtcggggtccagaatccagccggacagcgtggcatgggcccacggcaggcacttgttctccaagtgcgcgcggtccacagtcgagaacagccaggtgcggatgatgtcctgaccctgcgggcgcaggtccatcgggaaggtggaagcgaacagggccttggaggcctcgtccggctcggcccagtgggtcacgatctgcggggtcagcgaagaggtggcccaggtgtccatgatgtccttttcggcggtgaaaccaccgggcacatcacgctgggactcgtcgtagccctccggcacgtcgatggtcgggtcgatcggcagacgatcctcggacggagtgatcgggtgatcgtaatccggctcgccggaagcgttcaccgggtaccacagcgggaacgggacgccgaagaagcgctgacgggagatcagccagtcgccgttcaggccgtgcacccagttctcataacgcacgcgcatgaagtcggggtggaactcgagttccttgccacgctcgataagctcggcgttcagcttggcgtcggtaccgccgttcttcaaataccactggcgggaggtgacgatctcgagcggcttgtcgcccttctcgtagaagttcgtcatacgcttggtcggggtcggctcgccgtccagatcgccggactcgcgcagcttgtcgacgatgatcttgcgggcggagaacgtggtcttgccagcggtttcggcaaagacctcgcggccggccgggtcctcgatccagtccggggtatccatcacgatacggccgttgcgctggatgatcgggcgggtgggcagcttcaggtcgcgccaccactcgacgtcggttacatcaccgaacgtacagcacatggcgataccggcacccttgtccatttcggcggccgggtgcgccagaatcggcaccttgaccttgaacagaggggagtagacgtactggccgaagtactgcttgtagcgttcgtcgttcgggttggcgatcagcgaggtgcaggccgccagcagttcggggcgggtggtctcgatgtagatcggggtgccgtcctcaaagcggaaggccaccttgtggtagaagccggggtattcgcgcgattcgagctcggcctgggccacggcggtctggaaggtcacatcccacaggccgggggcgtcctgctggtaggcctcgccacgggcgaggttgcgcaggaaggccttctgggccacacgctgcgggtgctgaccgatggtgtggtaggtctgcgaccagtcgatggacagacccagcttgcgccacagggcctcaaacagcttctcatcctgagcagtcagacgctcgcacagctcgatgaagttcttgcgggaaatcggcacctgatccttggcgtcaatcttcttgccatcagtgccttcaaacggcggcttgaagtccgggtcgtaaggcagagacacgtccacgcgcacgccatagtagttctgcacgcggcgctcggtaggcaggccgttgtcatcccaacccatcgggtagaacacgtcgtagccgcgcatgcgcttgtagcgcgcaatcacatcggtgtgcgtgtaagagaacacgtgacccacgtgcagcgaaccggagacggtgggcggcggggtgtcgatggagtagacggccttgcggtcgcgggtgttgcggaatttgtaggtgccgtcttcatcccagacggtgcgccacttgtcctcaagtccgtccacgccgaccttgtcgggcagcggggtgaggttggcgttgatgatggatttgccttcagtcataaggccaaagtttatgcacgttgcatgacaagccgaactgtacagtaaacagcccagtaggctgttcgcaggcgaggtacgaacgatcgaacgatagtgagccaaggactatcgggcgtagcccgtccgtgactgaaggttgcctacttcaccgtcaacccggccagcggcatgcggcgattgatcatcgaggtcgggtagccggagaccttggtggacgccacagtgaagcatttgcgggtatacagccaatcactggccgcatcctcgctgatcagccgggcgtacgccttcattcgtgcctcataatcggcgtcattagtggcggcgcgagcatccgcataggcctgttgcgcttcggtatggtcgtaatggaacatggaatcggggtcggcgaatatgccggcatcatccgtgccgtccatgctcatcacggtcagttcccatttgccgtccttgattcgtttggcataatcctcatcggagagcacttcaaggttcaccgtggggcgcggctgccgctcgatctgctgcttgatggtttcggccaacgaccggtattcttcgggaaccaccagattcaccgtagtcaggtattgcgcaccaaagtaggagaacatctgcccagcttggttttcgtcatgcgggtacagtccggtcaaatcttcgtatccgggttccagcaggctgatggggccgcccaatgctccggctgcgtcgggttgggcggaggcgatgccggctgcgtcgatttgatagcggaaggctttacgcgcctgttcgtcggagagcagcgaatcggtgccgttgttgtaggccagcagcaccttatccgtagtggccccctccttgacggtcaggccatccttgccgttcaagccggtggccgtcgaagccgaaaccggtgccgccatatcgagactgccgtcggtcagggccttgctgagcgcatcggcgtcggagtattgcataaattcaacgacattgctggccgctttggtgccatggtaggtatcgctgcgcgccagcttcagggaatggccaggctggaaatcggccacggtgaatggtccggaacctatggccttgcgttgataatcggcactggacgactcggaatcgtagacaatgccgagtctgccggacagcgctcgcagcagcgtcggattgggcttggcaagcgtaatgaccaccgtggtggcgttcggattggcgaccgacgccagatcgcccaattcgtcgacgtccgccaccttgttggtcacgttctgttgcaacgaccacacggcgtccgaggcgtccaacgtatggccgttcgagaaggtgacgcccgattgcagtgtcagggtgacggtcagtccgtcatcggaagtcttccagcttgtcgccagtcccggctgaagcttgttgtcttgatcgacggtcactaatgtctcatacacattgtcgacgagcaggcgttcggctgccgcagaggaatcggaccgaatatccaaggattgcggcatatcgtcgatgccaatggtcacatcggcatcgagggatgatcccggctggaaccggttttgcatgaacgtccatcccacaaccacgagtgcgccgagtgccacggcgactccgagaaaaatcccccacttggaccatgtattgtcccgcttgctgtgctgcatggttttcagtctagcggtggattcagcctagaatccgcaattcaccatgatgaggtatgagttagcgcttggacgtgctcttgccggcgggcggcgcatagctagggcaggtgtcggacagcgggcagttggcgcagtcaggggtacgtgcgtggcaggtggcccggccgaacagaatcagtcggtggctgagattcgtccactcttcgggcggaaaacaggaggtgatttccttctcgattttcacgggatcggggtgtgcggaccgccaatccgaccgccaacgcagtcgtccggttacgcgcatcacatgcgtatcgaccgggaatccggggatatcgaacgcgttgccgagcacgacgttcgcggttttgcggccgacccccggcaagctggtcagttcatccatcgtgcgcggcaccacgccgccgaatcgttcgtccagtgccgtggccagtccgatgagatgctgggttttcgaacgatagaaccccagcggatgaatgatgtcttcgacttgggccgggtttgcggccgccaagtcacgggcggtggggtaggtggcgaacagttccggggtgaccgtgttgacacgcttgtcggtggtctgggcgctgagcacggtggcgatcagcaattcgagcggattcgagaaatgcagtgcgcaagcgggtgccggaatcacctggcgcagaatgtcgtattcgtcatgcatgcgcgtgagacgcgcggatttggtttctctcatcgtatggacctaagcggcgtaatatcgatgattgatagtttgcagcgccgctggtctgtcaggcgacggtgttgagatcgggagtatcgtcatcggtgtcgatggcggcagaggatgctttggcggcctgctgtgcggcggcagtttccttatccgtctccggcgggtcgaatcggtagcccacgttgcgcacggtgccgatgaggtgttcgtattcgccgccgagcttggcgcgcagacgacggatatgcacgtcgaccgtacgagtgccaccgtagtagtcgtagccccatacttcctgcagcaactgggcgcgcgtgaacacgcggccggggtgctggaccaagtacttgaggagttcgaactccttgtatgccagatcgatggggcgtccatgcagggaggcggtatagccgttggtgtccacaatgaggtcgccggagcgaatctggccatcttccaccgtggtggtggattcggcgggagaaccggctgctgcggctgcgggagcgttgccgcgctcggagaccaatcgcaatcggccctcgacttcggccggggaagcggtggcgaccaccacatccgcaatgccccactgggagttgaccacggtgaagccgccttcggtcagcaccagcacgattggcgtggacaggccggaagcgtggatgaggcggcacaaggttttggcggtcgccagatcgtcgcgtgcatccagaaacagaatggtgttctccggcatcttcaccaagctggctgcatccatcggcagtacgcggacgcgatgagaaagcagggcgagtgatggcaaaacggtggcggggtcgctggcgaaagtcatcaacgtaagatccgtcacgctaatcccccttatcctgcaatgtgttacgcaattgctcggtgtggctgtacgagtcgtcagcggcgttatgccgctttcgcacggttttcattattctacgcgcttgtagtggacacataggttacaagtttgcggaatatggaacggtggacgtccatcaaccgatgatacggccgagcaccagtgcggttgcggcgatggtcacgcccatcagcattaccggcatcaggccggtaccgatccacggataacggatatccgggtccggatcggcgtcgcgcacccacaacgtggaagccacggccaaagccagtcccaaaacgatgaggatgatcagggcaacggttcccgcaacggtgcccttggcgagcatcgcgcccaaatcaggtaggaagcaccagccggccacggcgagagctgccacaccggaagtcacggcgtgagagagtgcgcggataagatgttcgcgcttctcacgagccatctggcgtccgaaggagaagaccaccagcaccaccagcagcaggcccatggccagtgcccatgaataccaaggaagtaccgagccatccgcagcggtctgatccggcggcaccttgccggtcgggaacggcacggtgacgaaaatcagagaaatcgcgccaaacaccaaagtgacgatacgatccagtatgctgccgcggaacggccagaatacgacaaatgcggccaacgtcagagcggcgataatcaaagggatgatggggacggtgccaggggagggaatgaccgtggctgcgatgaacagtacataggacgtcagttgggccaacaacatgctcagagctttgttcttccaaccctcctgggtgatctcggtcatgatacgcctctcagataatcgaatttctatcccaatcctacgtcgggcattggaacggtgaaatcaaacaaaatagccccttctggtgaaggggcttatggcactaaatcagaacgcgataacgcccaaatgctccaatagcactttgatgccgagtagaatcagcaccacgccgccggcgatctgcgccggcttctgccagcgggaaccgaacgcgcggccaatgtgcaggcccgcagcggagaacagtccggtgaccacaccgatgctgaggatggcgaatgccatatgggctttggtgaacatgaaggccaggctcacgcccacggcgaacgcatcgatgctgcaggccacggccaggggaagcatatgcttccaatcgaactgggcggtctccttggagttttcctcatcttcttcgaaggcttcgtgaaccatgttgccgccgatgaacaccaacagggcgaagatgatccaatggtcgaattgggttacgtatttgctgaatgtagatgccgcgaaatagccgagaatagggaacagcatctggaatccgccgaaccagagggtgcttttcacggcgtcttgtactcgtacgcgggatacggtcaggcctttgccaatggatacggcgaatgcatccatagctacggaaacagaaataagcaggatttgaatgattatcgaaatcatggtgtgacagaaggttcatcgccggattaccgtgcgatgggcctcgaccagcgttcctacacgccgcctacgcctagttgaaaagacaaaacattactgtatcacaaaatacaagctccctctgttggggagctggcgcagtgaaactgcgactgagggagagtagagcggctttgccacaaatacaacaaaaggccccgaaggggcctcctgtcaacgattcagaatcgaatcacttctcggaatcggcgagacgctgacgcgcggcaatgatttccttttcggcggcgtcagcaccagtccagtagtcgcccggcaggacttccttgcccggctccagagccttgtactgctcgaagaagtgcttgatttcggccttgtggtactcgttgacgtcgtcgatgtccttgatgtcatcgaaacgaacgtcggcgggcacgcacagcaccttgtcgtcgccgccggcctcgtcgaccatgtggtacaggcccacggcgcggcactcgaccacgcagcccgggaacacggagttcggaatcatcacgagagcgtccagcggatcgccgtcctcgcccagggtgccgtcgatgtagccgtagtcatccgggtaacccattgcggtgaacagggtacggtccaggaagacgcgaccggtctcgtgatcgacttcgtacttgttcttggagccgcgcggaatttccacaacgacgttgaaggtttctgccatgtcatttctccttgaaaatcgacagttacgttatcgtctcaccacaataccctgtttacgcctgcaaaacaggtgcggaactcaagaaaccgtgctgagattatgccgacactatgcccaaacagacgaaatcctccccttgaggggaggatttctagcggtttacgcgcacgataaacccatgcacgtcaacggcatcactgttgcattaccgttgcagtaccgcatcactgcacggacaggatgtgggccacatccgcccaaggagccagagacacgtagttgtcccaaccccactggaattcgcggccggtcagctcgtcgcgcacgttgagcgggcggtcggtgggcagacccagctcgctgagttccaggtgaatcatcgactggtgtgcgttgtgtccatcgaggttcacgaccacaatcagcgtgtccgcttggccggtaccggtcagttcggccggcgtgtggcgtgcgaaagccagaatattcgggtcggacgtaggcagcacggtgaggttgtggtagctcaacgcggccgggtgggcgcgacgaatcttgttgagtgcggtgagcatctcggccacgccgtactgcttggccttgctccaatcgcgaaccttgacctcgtacttctcgttgtcgatctgctcttcgaagccggggcgctgcttgttctcgatgagttcgtaaccgttgtagataccccaggacggcgagcccatggctgccagcaccgcacgcacgcagtggccggctacgccgttgtctcgcacgtaagcggtgagaatatccggcgtggtgggccagaaggtgttgtgctggtagtagccgtcgtcgccattggtgaccggcagatactcttccagttcgtccttggtgttgcgccacgggaagtagcagtgggactgggtgaagcccacgtagctcagggcgcgcatcatgcccgggcgggtgaatgcctcggccaggaacaggatctccgggtgcttcttggtcacggcggcaatcacgtcctgccagaaacgcaccggcttggtgtgcgggttatcgatgcggaagatggtgacgcccgcctcgatccacagattcatgatgcgttcgacttctttttcgatgccgggcatgtcggcgttgaagtcgatcgggtagatgtcctgatacttcttcggcgggttctcggcgaaggcgatggagccgtccggcttgtggcggaaccagttcgggtgggccttgacccacgggtgatcgggcgagcactgcagggcgaaatcaagcgcgatttccagacccagttcatgtgcacgctggcacagggccttgaaatcgtccatggtgccgagcagtggatccacggtgtcgtggccacctagctcggagccgatgccgaacggggagcccgggtcatcggggccggcgaccagcgtgttgttgcggcccttgcggttggtcacgccaatcgggaagaccggcggcaggtagacgatgtcgaagccctcggcagcggcgcgttcgaggccggccatcgaagtcttcagcgtaccctgaatgatcttgccggtgttcggatcgatggtggcgccttcggaacgcgggaagaactggtaccaagccgcgaagctggacttcgggcgttccaccttgaagcgctggggctggctggggagatgccgtcgcgcagcgggtgagtctcgtgcagggcggcgatggtcgggttgtcgccggcggcgagacgatcctcggcgctcagcgtctgatcggccatggtctcagcggccttctccaaggtcttgcgatcgcgtgcggtcaggccggtgtccggggtttcggcccaacgggccagcaactcggcaccggaattgagtgcgttgtccacgtcgtccatcacacgcaccttgatgcgggcgtcgtgcagccaggagacgtacgcgtcttcccaaccttcgatggtcacggtccattcgccgagctgacgcttgacggccgcgtagccatcctcccaaggcttcagatcgctgtgctcgccgcacttgaccatcacggtccaacgatcgaggccgggatttacgcaggtcatggcccggcgcatggtttccttgccgcgcgggttgcgcacgatggcggtggcacccaccttggtacggccttcgatgaacacctgggcggtcatctcaaacggttcgccgagttccacacgggcggggaagatgccgcgctcctcggcgggagtgatgtccatgacattgatgcggccgaactggccgggctcgtttgcttcgatggacggtgcgggggcttcgacagccaggcctttcagcgctgctgcggcgcgtgccgtttcggcgctgactctcttgcgcttggttgcggggctctttcgggcagaagtcgcctttgacttcgttttcgtggtgctgttatcggtattactagtgcgcgtggtcgcgcgatgttgtactgctgccataaggccctattctaagggcttttgaacatatgttgcgcattgtggataactatcaggtaaacgttcggtcaaccgcatgaggtggataactcggcggaagagttatccacaactcgccggcaaacggcaagctcggaccacataggtcgaaaaaccggctgtagcgaatgaaaatctgccatgatcgtggcctacccgcacacagtgcagtatgcggggaaacgtaccaggaaaggacgaatgatgataacgacatggcggcaacggggcatggccatcgtagcgatgctgaccggtctgataataatggtgggagtggtgttcggctcggcgaatacggcgtatgccgcgacgttgacgcccgccgacgaaagatatcacgtggcgtttccatacaacgatatggaatattacgtcggtgtcgcggggctggacgcttcgggcaacaagtactactgcatcgaagcggggaaactgagcgactatgtgataggccccaccacggtgcttgcctccgatgagaacgcccggcgtatggcatggatccttgaccggtaccgcgacacggatgccgccacccatgcggcgatcggcatcatcgtgcaggatcacttcgggcgcgatcgggacgagtgggcgagacagatggcggtcattcaaggccggtaccccgagatcgtggcgaaggcggcccggatatgggatcaatcggccggcaagacgcctgcgggcacgacggtggaacgcaccgatgccgaggctttgcgcagcggttccatctcggtgaaagtggtgaaccgcgccggtgacgcgatcgcgggagtgccgttcaccgtcaccttgcagggggcggcgcggttcgtccaaggcggcaacacgttctcgggggtgtcgacgagcgccgggtcctcgatcgcgtgggaggcgaccggcgccggcgaggtgacggcgaacaccacatacgagtatgggcggatgcacgtcatggacagcactcaggacatgctggcctttgactcgatggcttccactggcggcgcgtcgacgacatttcgggtgcgtaaggattttgttccggcggtatccaccaaggtctccgagaaggtgcttgatgtggcttctccggtgttcgatgacgtgaccagtggcgtggcggatgcggacagttattgggtgcccgatttggaattgcaggcccgcggatactatttcgatggtcttgatacgggcgatgtgggcaatgtcattacgccgaatgcacaagagagcgccgatgcttttcttgcgcgattggcgactttgggttatgagccggtggcctatggcaaggcctctttcaccggggtggggcagcaggcacgtgtgcaggccatgaccaagccggatgacggtgccgcttaccggaccaagcagaatagcgtttttggcacatgggtatgggtgtttcggcggtccgagcagagcaaacaggcgcaggaataccttataggcgactggataagtccgtttatggaggctacggaaagcaatacaagtcgcaggaagctagaagtcatgtcgacggtcactgagcattcggcggatatcggtgccgagctcagcgacaccattaccgtatcgggattccctgcggatcatggccagtatgccggcaacgaagagtatgagttcgcggcggatcggccgtatgcgacggtgagcgtatggtggtccggcgatcccgacaacccctccaacgatgaggcgtacaagccatccgggggagaggttcccacggaagacgacaaccaccggttgctggccacctgggagattcccgcgatgaacggcacgttcaaaatcggcgccggggcgttggacgcgcatggcgctcctatgtatctgaccgccgaacggcctgggtggtacgtgttcgtctggcggttcgaggggatgaccgtgtttccccggcgtccagccggtatgacgatgcctgggagcgtgtgcgggtgttgcccccatgcgagtcggagaaaccgtgcgaaccggagaaacccgagacgccgccggcgccggcggaggcaaccacgcccaaccctcgcccgtcactgcccgtcacgggtggcgatgtgtcgcttgcctcggttctggccgtgtcagctctggcgataggcgccatactgtccatcgtcgttcggtggcgtcgtcgctatgaccgattcaagcactggacgatgcgctggccgatacgttgacccgctgcggcatgatgccgatgatgtcggctggatggtgaaccacactccgcttctgagcagaagaacgggagctgggcacgaagtcgatcgtaacatacgacttgtgcccggcttccgcttcgttgagaaacttcacgcctgtcgcctcccgtggattagacaactgaagatccgcgatgaaaatgacgagacgtttatgatcgccgacttccctgggcaccgtagctgcctgatcgcctttcatccatatcgccacggtaaacggaaaggccgctgatttcggtaccgaaatcagcggccatataaccacgttcgtagcggggcatggatttgaaccatggacctctgggttatgagcccagcgagctaccgagctgctccaccccgcgtcggcttgtctctcagacagctctatctacaataggtgcagatttcagaaagtcaacatcggcgtgtcgcgtcatcttcccgcggttttaaaacgtgaattggctcacgcagcgaggggtttggggcggagtcggagtcggggtaataacgcgccataaatggccgttataggaatgccctgaaccgttatcccgaatattgacataataggaacatgcctatcaagatccccagtggcctgccggccagagatatcctcgattcggagcgcatcttcgctctggagaagcccgaggcggagcgtcagcgcgtccgcccgctcaaactggtgatcctgaacttgatgcctaagaaaatcgagactgaaacacagctgctgcgtctgatttccaagtcgccgctgcaggtcgaaatcgacttcatgaagacctccacgcatgaggccacgcacgtttccgccgatcatctcgtcaagttctacgaaaacctcgatgcgttcaaagacaactattacgacggttttgtggtcaccggcgcgcctgtagagcatatgccgttcgaagatgtggactactgggacgagttcaagacgattctcgactgggcctccacccatgtgttctccaccatgtacctgtgctggggtgcgatgggcgcactgtactaccgctacggcatccacaaggtggattaccccgagaagattttcggcgtattcccgcagtacctgcaggatgaatactgcttcctgaccaatggcttcgacgagattgatctgcagccgcactcccgcctcgccggcgtgaacgaaaacgaggtacgtgccaaccatgaccttcagatcttgacttgggggccgcagtccggcccgggcctgatcgccacgcgtgacttctccgaagtgttcgcgctcggccattgggagtacggcaagtacacgctcgccgaagaatacgagcgcgatatggccaagggcatgaccaacgtgcccttcccgaagaactacttcccgcatgacgatccgaagctggaaccgttgttcgcctggcgcgcccacgccaatctgctgtggcgcaactggctcaactgggtgtaccagaccacgccgtatgacctgaccgaggtgccgcagctcagggctgagaagaagctcggtactgatcgttcgattcggcatgagccgggcgggccgcgccaggatgatttcaagccgtttgtgcatgacgggtatggggtgattcagggctgagcctacgatctcccctcagtcgcctacgacgacagctcccctcgacggggagctcctttgcttctccttcacggctcggcccatcagagggagctactgttggaggttgcgttcgtagcgtggacggttgttcgtccacgatgtggacggcttgatgaacgtaatgccacacatccgcgtaatgcgaccaatagtgcacaacgttcgcgaaacgcccgggaaaaccttgcagcagtagggatttcaggagactcgccggtataatattgacattgtctagacgcaggcaaataatcactcttcagtcattcggagccgaatgcccagcgcagactccgtgtccatgcccggcagactccacaccgaggagacaaaaaaagacgaaagtaacgagcacgtcacatttgcctgcccggtgggtttaaactgacacctgacattgaagaagcaggaggcgtgatatggtcggttcgctcagcgcaggattgctgttggctgacgaggcaggcgctcatctgccctcggttgatgacttccttcccccggagattctgttccagggaactccgtttgccatcaaccgcattattttgattcgtatcgtggcaaccatcgtgctgttggtggtgctcggcgtgaccgcaaagcgcgccaagctcatccccggccgttggcagggcgtagtcgagtacggtctcgacttcgtgcgcgacaaggtcgtgtatgacgtgatgggtgaggcccgtggcaagcgctacgtgccgatgatcaccaccctgttcttcacgatcttcattttcaacctgtgcggcatcattccaggtatgaacatggcggccaacgccacggtggtcatgccgctcgtgttcgctgtctggacactgatccagtactggatcgccgccatccgctcgcagggcctcggccactatctgcgccacgagctgttcacccccggtgtgccgtggccggtctatttcctgctggctccgatcaacctgcttgagctgttgatcatccgcccggcctccctgaccatccgtctgttcgccaacatggtttccggccaccttatggtcgccacctgcctggcgttcgcacagttctggatggttgacgcggtcaacaagctgcagggcatcccggtgggtgcgctgtggttcgccggtggtttcgccatgacttgcttcgaggcgttcgtcgccttcctgcaagcctacgtcttcgcgattctttccaccgtgtacatcaacctgagcttcccggaagagtgacgggcgactaacccgccgcttccggtccccggtctgggaaaatcgcagaccgaccaaaccccaagatttataacgtcgccaagtacgttagaaaggaaacacaatggatatcatcaccctcgcagaggtcgccggcaacctgtccgtcatcggttacggtatcggtactcttggccctggcattggtctgggcatcctcttcggcaaggccatggaatccaccgctcgtcagcctgagatgtccggcaagatccagaccatcatgttcatcggcctggctctggtcgaggtgctggcactgatcggcttcgtcgccgccctgatcatctgatctgcgcagatcaacagacgaaaaccgattatgtccatcactgaaaggagggcttgatgacacaagcagcaagcgggattgacctgttcattcctgaggtttatgacatcgtatggtcgctgatcattcttgtcatcgttgcggtgttcttctacaagttcttcatgccgaagttcaatgcgatcttcgacgagcgcgccgccaagattcagggcaacatcgccaaggcggagcaggctaggaaggacgccgacgaggccaaggccaagtatgaggcccagctgagcaccgcccgtgtggacgccgccaagattcgcgacgacgcccgtgcggaagcgtcccacatcatcgccgacgctcgttcccgcgccgagtccgatgcggcccagatcaccgcatccgcacagcgctcgatcgaatcccagcaccagcaggccatcgtctcgctcaagggcgaggtcggcgcacttgccaccgccctggccggcaagatcctcggtgccaagctggaagacaacgacgtgcagtcctcgatgatcgattcgatgatcgacgacctgggcgccaagaagtgaccgtgaccatccgtaaccagaaagggaggtgaccatgcgaggagaggcatcacgtattgcagaccgcgagtcgcgtgattcgctggccccgaaactgcgcgacacccgtgaggacgcgtggcggatcggcaacgaactgttcacgatcaccaaggtgctcgatgacagcattcagctggagcgcgcactgaccgacccgtcccgcccggttgccgacaaggtggccgtcctgaaggaactgctcggtgacaacgcgcatccgatgaccatggagatcatgactgacttggtctcccgccgttggagccgtgcgcgcgacatcgccaacgcagtggaagacttcggcgtggacgccatgatgtactacgcggacgccactgacgccacgctgcaggtatccatcgagctgtccgagctgcattccgcactgctgaacctgccggtcgtacgcgccaagctgtacgactaccaggccaccagcgaggcccgtgtgaagctgttccgcgaggtgttctctggcaagaccctgaacaaggtcaccatgaggctcgccgaacacgccacttgcaacctgcgccgccgccgctacttggagaccatccagtggctgatcaacaagttctcccgccacatgggcgagtcgatggtcaccgtgaccaccgccaccccgctgaagaaggagcagatcaagcgactggtcgaggtctactccgccaaggtgggccgtcaggtgcacatcaactcggtggtcgacccgaccgtgctgggtggcatgcgcatccaggtgggcgacgaagtcacggacaacaccgtggtcgcacagctgcagaacttgcatcgcaaggtgcagacggaggcgactccggcctgaccggccgagccaatccgtccaacaccacacacaagcaaagacttgactgaacaataaccaatagaaggagtgatcatggcagaactgaccatcgatcccgcctcgattcgcaaggccctcgacgacttcgtgtcgtcgtacaagccgagcgacacccccacccaggaagtgggctatgtcgccacggccggtgacggcattgcacacgtgacgggattgcctggttgcatggccaatgagctgctgacgttcgaagacggcacgctcggcctggcgttcaaccttgacgcccgtgagatcggcgtggtgatcctcggcgatttcgctggaattgaggaaggccaggaagtgcgacgcaccggcgaagtgctttccgtgcccgtcggcgacggctatctcggccgcgtcgtggacccgctgggcaagccgctcgacggcctcggcgagatccagggcattgagggtcgtcgtatcctcgaagcccaggcccccgacgtgatgcaccgccacccggtcgacgagccgctgtccaccggcctcaaggccatcgacgcgatgaccccgatcggccgcggccagcgccagctcatcatcggcgaccgccagaccggtaagaccgccatcgcgatcgataccatcatcaaccagaaggccaactgggaatccggcgacccgaagaagcaggtccgctgcatctacgtggccatcggccagaagggctccaccatcgcctcggtgaagcagagcctggaagacgccggcgccatggagtacaccaccatcgtggcctccccggcagccgattccgctggcttcaagtacatcgccccgtacaccggctcggccatcggccagcactggatgtacaacggcaagcatgtgctcatcgtcttcgatgacttgtccaagcaggcagaggcctatcgttcgatttccctgctgctgcgccgcccgccggggcgtgaagcctacccgggtgatgtgttctacctgcactcccgcctgctcgaacgttgcgccaaggtctccgatgacctgggcggcggttcgatgacgggtctgccgatcgtcgagaccaaggcgaacgatgtgtccgcctacatcccgaccaacgtgatctccatcactgacggccagatcttcctgcagtccgatctgttcaacgccaaccagcgccccgccgtggacgtcggtatctccgtctctcgagtcggtggcgccgcacagaccaaggctctgaagaaggtctccggtacgctgaagatctccctggcacagtaccgttcgctggaatccttcgccatgttcgcctccgatctggatgcggcttccaaggcccagctgacccgtggtgcccacctgaccgagctgttgaagcagccgcagttccacccgtactcgccggaacaggaagtcgtgtccgtatggaccggcacccacggcaagctcgacgacctcgacctgaaggacgtccttccgttcgagcagggactgctggactacatcgaccacaacaccgatatcctcaagaccattcgcgagaccgaggaattcaccgccgacaccgaggctgccctcgataaggccgtggacgagttccgttcgacgttcgtctcttccgccggcaagccgctggtcgagaagaagccggacgttgacaaggccgcgccggtcgatcaggaaaagatcgtggcgggagaaaagtaagccatgggctcgcaactcgcattgaaatcacgcatccgctccaccgagtcgttggcgaagatcttcaacgctcaggagatgatcgcgtcttcgcatatcgccaaggcccgtgatgtggccctgaacgcgaagccgtacaccgatgcgattttcgatgccgtgcaagcgttggtggcccacacccatatcacgcatccgatcgcggtgaaggacgagaagaacccgcgcgtggctgttctcgccctcacctcggatcgtggtatggccggcccgtacacctcttcgattatccgtgaaacggagtcgctgctgtcccgcctcgatgcggcaggcaagcagccggagctgttcgtgtacgggcgtcgcggttcgacgtactacaagtaccgtaatcgtgacatcgcggcgacgtgggaaggcgacaccgaccagcccggcgtggaaattgctgaaacgatctccaacaccttgatggacgcctacatgaagccggctgagaagggtggagtttccgaactctacatcgtctacaccgagttcatcaacatggtggtgcagaaggtgcgcgtgctgcgcatgctgccggtcgaaatcgtgaaaaacgagaccaaggtgcccgatcctgatgaagaggcaccggctactgcggatgtcgctccgctgtacactttcgagcccagcctcgaaaaggtactggatgcgattctgccgaagtacattcagtcccgtatccacgagtgcctgctgaccgcggccgcgtcggaaaccgcaagccgccagaacgccatgcacacggcaaccgacaacgcacgaaacctgatcgacgaccttacgcgcaagctcaacgcttcccgccaggcctcgatcacccaggaacttaccgaaatcatcggcagcgctgacgcgctgaccaagaaggaagagtaggaacgcatatggctgacaaccagaccactgcggccgagcctaccaacggtcgcgtcacccgcgtccagggctcggttatcgacgttgaattcccggtgggtcatctgcccgacatctacaacgccctgaaagtaacgatcgtcaacaccagcgccaaggaagaaggcgaggcgaaggagaccgagatcaccctcgaggtcgaacagcacctcggtgattccacggtccgttgcgtcgctctgaagcccaccgacggcctggttcgtggtgcctccgtctccgacaccggcgccccgatctccgtgccggtcggcgacgtgaccaagggccacgtcttcgacgtgtccggtaacatcctcaacaagaagccggatgagaccatcaccgtctccgagcgttggcctatccaccgcaacccgccggccttcgatcagctggagtccaagacccagatgttcgaaacgggcatcaaggtcatcgatctgctgaccccgtacgtgcagggcggcaagatcggtctgttcggtggtgcaggtgtgggcaagaccgtgctgattcaggaaatgattcagcgcgtggcccagaaccacggtggtgtgtccgtgttcgctggcgtcggcgagcgtacccgtgagggtaacgatctgatcggcgaaatggccgaggccggcgtgcttgagaagaccgcactggtcttcggccagatggatgagcagccgggtacccgtctgcgtgtcccgctgaccgcactgaccatggcagagtacttccgtgacgtgcagaaccaggacgtgctgctgttcatcgacaacatcttccgcttcacccaggccggttccgaggtgtccaccctgctgggtcgtatgccttccgccgtgggttaccagccgaacctggccgatgagatgggttccctccaggagcgcatcacctcgacccgtggtcactcgatcacctcgttgcaggccatttacgtgccggccgatgattacaccgacccggccccggccacgaccttcgcccacttggatgcaaccaccgagctttctcgtgacattgcctccaagggtatctacccggctgtggacccgctgagctccacctcgcgaatcctcgatccgcgttacgtgggccaggctcactacgactgcgccaaccgcgtcaaggcgattctgcagcgtaacaaggagctgcaggacatcatcgccctgatcggtatcgacgagctcggcgaagaggacaagaccaccgtgaaccgtgctcgtaagatcgagcagttcctcggccagaacttctatgtggctgagaagttcaccggtcgccccggctcctacgtgccggccgacgagaccatcgaagccttcacccgcatctgcgacggcgtgtacgacgacgtcccggagcaggcgttctccggcatcggcggcatcgacgacctcgaagagaagtggcacaacatgcagaaggaactgggtgcgtgatggctgcggaaaaaaccacgatgaaggtcaacatcgtcgccgctgaccaccctgtgtggcacggcgaggcgacgagcgtgaccattcccgcctctgagggcggcatgggcatcctgcccgaccatgagcctgtgctcacggtgatcaagcagggtacgctcaccgtggttgagcccgatggcgatcgccacatgttcgaggtgaccgacggattcatttccttcgactcgaacaaactcaccgtggcggtcgagcgcggccacgacgtccagtactccggcaccgccgagtgacctgaaccaactccttaaggggctctctggttttccagagagccccttttgctatgtatgccatgtgttgcgctacagtggtggcctatgcgagttattgttgccgactgttcggccgagtattcgggccgcctcaacgcctcactgcccctggccaagcgcgtattgctgatcaaggccgattccagcctgttgattttctccgaattgggctcctacaagccgctgaactggatgaccgcgccctgcacgattcgtgagatcgacccagccgccaaatccgcgcaacattcccgggaaagtgtcgctggtggggctgtggatggtgattctgcgacgcattccccggaaagtgtcgccgctggtgagccggaaaaggtgctacgtgtcagcgccgacaagggttcggacattcttgaagtgacgctgcagcatatctattccgaccaaacctatgatctgggcgaagatccgggtctcatcaaggatggcgtggaagaccatctgcagcgctatctggccgagcaaatcgagcgtatcggcaagggagccaagctggtgcgtcgcgaatacccgaccgccattggcccagtggatattatggccgtgaatgccgagggcgagcatgtggctgtggaaatcaaacgtcacggcggcattgatggcgtcgagcagctgactcgctactgcgaactgctcaatcgagatccgctgctggccccggtgcacggcatcttcgccgcacaaaccatcacgccgcaagcccaggtcttggccaaagaccgcggcttcacctgcctcatcctcgattacgacgatatgaaaggcaccgaggacgacagtctcaggctgttctagatatagcaggggctccctcatcagagggagcccctgctatatcttttagtacgcggcgagaatatcgattacgaagaccaacgtggagttggcgggaatcggaccttgctccttatctccataggcctgatccggcggaatcaccagcagaacctgagagccgacggtctggccgaccagacccttctgccagccctcgataacctgatgctggccgctggaatcgctgaacagatcggcgtcgattgtggaatcgcgatcccaggacgaatcgaactgcttgccattcgtaagccaaccggtgtacttgaccaccacggtgttcttgtcggtcagcttggcgccgttacccttgatcagcgtctgcgagatcagcgaatcaaccgaaccctgaccgttcatgtcgatggacggctcgccgtttttggctcgcgtcaccttcggcagattggccggcacatccttgacttcctcgccagtggccttctccaagtccttggacttggacacaaacgtcatcgccagaatgtaagagtacccggacgaatcctgagcgttgacgccaaagccaatcgtggtgttgatcttggcacccttgatctggttgtagtaggtcgaggagagggtcttggaatccaccttcagcgagcaatccggcgtgttcttggtccaggtgtccatgagctcggttccgtctttaacgttgagcgcgatgccttgggcgcagacgcggtcgccctcctcgatcacgtcgccatcgcccttctgcagcaccacataagagccgtcggacacggtcatcggcgtattaaaggagatggtcggcttctcgccgagcttgcccttggcggtcacgccggcaatttggcccttcttgtcagaagagtcggaagatgaagaggaatcggaagaagaggatttcgagtccgagctcgaactggagcaggcagccagcgacacgcacatcgccagcgagcaggcaagggcaacggccttgccgagggggataacatagacttaacagacttacgcatgacacatcaccctactggtaaaccttgattttctgcgctcctaggtaataaacaggtgaagattgtagaatggttgagttatgagtgctgaagaacagactacaagaccggataagggcgccaagcgtccatcccgtcatgccaaaatcatgcgtggagtggtgacgcctatcttcggactattggccgtggcggctgtggtgttggggtacatgaatgccacgatgtggaagccctccactgaaatcaccgcttccgcaaccatgagcggctcccggtatgtcgtcactgatccgaatgtgctgaccttgttggatcagaatgccacgataaccgtggactcgggatcctctcaggacgaggcgtgcgtggcgttgggttcgtccaaggatgttgccggatgggtcgcgtccgagaagtcctatacccgcatcaccggattggcatcatggagcgagctgagcacccagaagggaagcagcacgagtcagggagcgcctaccagtgccgatgacgcggtgtcgttcaaggattccgatatgtggactgccgtgaaatgcggcactgggtccgtttcgctgaagagcaagaagaccggcgcctcgacggtagccattgtggatttgggcgaaaatgtcaccaacgccaaggtgcagctgcactgggtgcgctccgaagtgccggactttgcgatgccgttctatctgtccggcggattgctggccgtgctggccgtactgtgcgcctccgtgttcgccatgccgccgcataagcgccgcaagcgcatggtggaaggcatggcaagcgccgtaatcgaggaagaggcacccgccagcatcgcagtgtccgggaagccggatggtgcaagtcgacgtaatcgtcgccgtcacgccacacatcggcgttcgggccgtgcgtcctcgcaatcctcgcaatctgaagccaccgaaacaccggttatcatcgacccaagttcgcgtaacctggtcgccgaccagcagaccggtgccgaaagcggcgctgagcccggcctcagcgccggcgataacgaatcgacttcggtaatcacccctgacgaactgcaggcctacttctcccgcttggcccaagaggtcaataccggagacgactcggccgatgacggacaggaggaaagctgatgaacaagcgatggaacaaactgtgtgtgtccgccctcgcctgcatggcgttggtcgtgccgttgaccgcctgtgaaggccaactgccgacgccggctgctgatacctccaccaaggttgcgccggatttgaccgaggcgcaggagaagaagattcgtctgaagattctcaagacgatcgatgaagccgatcaggccaagaatcccgatgggtatgcgaccgttatgggcgggccccagctggacattcgcatcagccagaccacgatcaatcagcgtggcggcggtatgtccgaatatgcgaccattcccaaggacatcgcccagacggtgattcctacggacgacggatggcctcgctcggtgttcaccatcacgaccaccaccgaagatcagcagtccaagcgtttgctggtcttcgatcaggaatccgcccagcagaattacaagctgatggctatggctcgactgtttgagggcgccaagctgccgaagttcgagattccgactattggctcgcagatgggcaccgcaaaggatgagaagctggtggccgctcccgccgatgccttggcccaatacgccgatgtactgcagaacggctccaagagccaatacgcttccaagttcgcagacgatttgctgcgccaggaactggccaataccacggccaaggtgcaggaaggtatgcaacgcaacaacggtacgcaggagcaaaaattcaccgctgtgcctgaacagatgtgggtgatgcgtgctgcagacggtgccggtgatctggtggttggccgtattaacggcgaatggactcgcaaggcaggggatggccgcgaatcgcagccggcttccgacgacgagaaggcgctgttcaatagcgacaagtacaccagcaccatgaaggtcacgtatgtgaacgtggtggccttgtacattccgttggcaagctccggtgagcaaatcaccgccgtgggtgccgaccgtcagccggtaaaggtcgaagcgctgtagttgttgccgccgcccaccgcgcggttaacgccccaccacgatatgattcatccaccacgatgtcggtaagttttacctttcgcacaatggtgccgttttgagtcacatcgtggtgggcgttttgctacgtggtgggaatttcaccgcgtagtggaagaatccctacgtggtgggaatcggcattacaatcaatgtcagcaaatgtgattgttgttgtacgcgaatcgcgtggaatcgggaggcattatggcagagcagcagttcaatccgggagtctcattggcgggcgccgtcgatttggaggcgctgaagcatcaggtcaaggccaagcccggccaggcgggtggcgctcctgccgctggtgggtacgtgatcgacaccaccgaaaacaccttccaggcaatggtgcagacttctgcgaccttcccgatcctgctgctcctgtggataccgaccgatgaccgcctgttcccgatggcccgtgcgttgggcgacgcggtgaacgccctgaacggccagattcagctctcccgtatcgatatctcgtccaatccttcgattgcccaagcgttgcaggtgcagggcgcgcccgcactgttcgcgttgattgccggccgtccgatgccgctgttgcagggccttccgggtgacgacgagctcaagcaacttactgacgaggtgattccgaagattattgaggccgccgcgcagtctggtgtgaacggtaccgcgccgtactcgggtgatcctgattccgatgccgccaagagcgctggtgccaccggtgccgtcgcgggtgctgagcaggtgccgccggagcatgccgaagcccatcgtttggccgaggagggcgattacgccggtgccgccgccgaatacgagcgcgtgctcggatccgacccgtccgatgcactggctgcccgcgaacgtgcgaaggcgctgttgctggcccgctccgggtccgctgatgtacgtgacgtgcgtgccgctgccgccgcagcgccggacgatgtggaagcgcagttggctgtggctgatatcgacatgatcggtggccagattcaagacgctttcgaccgtttgctggactttttggccgccgggcacaaggccgatatcgagcaggttcgcaagcgtctgctcgaatacttcaccatccccgaacccaccgacccgcgtctggcccgcgcccgccgtcgcctagccaccctcatgtactgattggttttggctcccctctttgaggggagctgtcaggcgtagatgactgaggggagcgcgcgagcgtacttgattgcttcccctaaaccatccgattcttcccgaaatattgctggaaccttggcccctccagcgccagttcctcctcgaaatcatccgcccacttacagaacggacggttggcgagaccatcgttattgaatcgcgcctgatcggtgatttcggtgatgcagaatttcggaatcgtcagattggtaaccggcccggatcgttcggcctcggctacgatcagcggcgcgttcggcccgccgaacacgtccacgctccagccgtcttcctcaatccacacggaataccggttcttgatgattaccgagccgccgcgcttgatgagttcggccgcgatacgcgtatcgatttcgcgctcgacttcgtagcgcgtgccgcccacggacggacctttgacggtgacatatgcttccgagaaccggtcgcggtattcgtccagcacggccaccggatttacgtcgggcgtcatgtcgacgtgaaccttgcgcgagaccagccgcacgcgcaaggcgtaattgtcggcatgcacgtagtagctctgaatgatgagggtcggggcgtcgccgtcgtcgtattccgccggcagttcgcggcagaagaagcggcgttcgtattcgaagtcatctgtaggttccgacataaccccattgtagagccgataatggcgattttctcgttattttggcgacgtatgtgccgcatgcaacgtgatgtggtgtacagtaaagaagttgctcgggtttgtagctcagtggatagagcgtctgtctccggaacagaaggtcgtgggttcgatccccatcaagcccaccagcatggctttcggctaaccgccggaagccttttgcatattcggcgcgtgcaaggctggtgctggtgtcggcaatggcaaggccggtgatgccggctcgcttgggtcgtggaaaaaccgtccggtttggcgagaacggtagccgaatcgtctggaatcgtctggaatcgtctggaatcgtctggaatagcaaggaatagtctgttgatggccgtatgccgggcatcatgcgcgctaaacgcgactttgctcagtagactgctacgtaatcggcattgccaatcgttgctgatcgtgcgattggtcgtagccggtggtgatgtgtaccggcgccggccgcagcaggtgggcgcccccaagatgagaaggagcacaatatgagcgaaaagatggaagccgtagccacttccgaggcgccggccgcgctgggcgcatacagccaggcggtgaaggccaatggcttcgtgttcgtatccggccagctgggcattgatccggccaccggcgaactggcgggcgagaccgctggagagcaggctgcacaggcgctgaagaatattaagcacattctcgacactgccggtaccggcattgagcatgtgtgccgtgccaccatctacctgaagaacgtcgaggacttcaaggaagtggacgcacgttacgctgaggcgttcatcggctccgtcaagcccgcccgcgtggcctttggcaacaacatgattcccaagggcgcgctcgtggagattgacgccatcgcggtggagtgattcgaacgtttccccggcggcccgtctgcgcgcatggtgtgtgcagacgggccgccgcgtattgtgcgacgcattccggggaatgtttcgctgggcgggggtgcgaggtgtggttccgcgacacgttcccgggaacgttgcgctggaatcgttgggcggtggtccgtgccacaatagagaccatggcatccaaaggaaaaccgtcgccgcgttcggccgtaagcccgctgagtgatgagcaggtcaagcgtctggccgcccgccacacgcttgtggactcgacacagtattacccgaccggcccccgcacgcccaatcagccggaaatcaacgcccagaatcccaaggccaccaaacgactgctgggaggggtgtccattgtgttccgcgccagctgcaagaccaaggcctggggcttggaacaggtgccggaaaccggaccgttcatcaccgccgccagtcatgtcaccatgtttgatgtgttcgtgccaatgatgagcctgttccacatgggccgccgcccccgttacatggccaaggccgagatggcgaagtggccattgatcggcaagtggttccagttggtcggcatgcagccggtgcagcgtcattcgggcaaggccaagcagatcgaagagacctcgattgatattctgacgtccggccgcccgctgacggtctggccggaaggcaccgtgacccgcgacccgaaaaagtgggtgatgagcattaaggagggcgtgggatatatcgcccttgaatcctcgcgcagactggggcatcaggtgccgctgtacccggcggtgacgtggggtgccgcctccatcaaccactggtggccatggccgcgcaaaaacgtggtgatgtgctatgaccatgcgctcgattactccgatttgcttgccgacatggactcatggggtgaagagccgcctgccgaggccgtgaacgagctgatgtggcgcgtgctcaaacgcatgaacacagtactggaggaaattcgtggcgagcagttccccgctgaaggctactgggactaccgcagtatgagtcgtaagccttggcctgaagccggcggcccgttcccggctgagaagtagccgcaccggttcccgtacggggagcctaggcgagtagcatggcacaagattgtgccgatgaagttgcgcgacaagcgaaggtaggaatttgatatgggtaaaaatataacggttctcggtgcaggagcatggggtactgctttcggccaagtgctggcggacgcaggcaacacggtgaccatgtgggccaaggagcagcagattgtcgagggcattcgcgatcaccaccacaacgccgtgcgcctgccgtccgtcgaaaagttgccggacaacatgaccgccactggggatcgcgccgaagccgtcaagaacgcggacatcgtagtcgtggccatcgccgcgcagttcgcgcgagtggcactcgtcgaattcaagggactgattcccgatcacgccatcgtcgtcagcctgatgaagggcatcgagcgtggcaccaacaagcgtatggacgaagtcgtccgcgaatcccttgacttgccggccgaccggttcgccgccatttccggaccgaacctgtccaaggaaatcgccgatcgtcatcccgccgccaccgtggtggcttgcacgaacctcgataatgccacgaaggtggccgaggcatgcaccacctcctatttcaagccgttcgtgaccaccgacgtcatcggcctggaaatgtgcggcagcctgaagaacgtgaccgcgctggccgtgggcatggcccgtggtgccggctacggtgagaacaccgcagccatgatcgaaactcgtggactggccgaactgaccgcgctgggcgtagccgctggcgccgatcccaagaccttcttcggcttggccggtgtgggcgatctcatcgccacctgtggctcttcgctgtctcgtaactatacgttcggcgcgaatctcggcaagggattgacggtcgaagaggccaccaaggtcagcaacggtgtggccgaaggcgtgcccaccacggatgcggtggtggctcttggcgatcagcttgatgtgccgaccccgttggcgtatcagatgagccgcgtgctgaacgaaggcatttcctgctcggagatgcttgccggactgttcggtcacgaggttaccggcgaataacgagagaagcgacgtatacgtggcgtatacgttgtacgtgcaaagtcgcgtggcgtatacgtcgttgacgtgcacgagtagactggtgtgcgtctcttgtgcgcggcgttccgagcgcggttcggtccggttggcggtgcaaagcataggcttgaaaacggttgtagtttcaacaaaaggatggttatggccaagaagcgtgttgtggtgctctatggtgggcgtgcagacgagcattcgatttcctgcatctccactgccggtgtgctgggggccatggacactgaacggttcgagccgattccggtcggcatcaccaaggacggcaagtggatcatcaatggcgaagatccgcgtggctggaacttggacggcggcgagctgccgaccgtaaagatcaccccggaatcgcgcccggtgatgcttgacccctctcgcggacaggacggtttcttcatcggcgagcccagccacatcaattccgccgattccggcttcggcaccagcttcgtcagcatgtccgacccggaaatgcaccatgtgctgacctcccttggccatgtggacgcggtactgccggtgctgcacggcccctatggcgaggatggtacggttcaaggcctgctggaaatgatgggtgtgccgtacgtggggtgcggagtgtttgcttccgccgcctgcatggataagcattacaccaaggtggtactggatgccgccggcattcccaccgcgcccggtgtgacggtcgatgcgcgcaacttcaccgccgccgatgtgcttgccgagatcgaggacgccggtcttacttatccgctgtttgtcaagccttcgcgcgcaggctccagcttcggtgtgaccaaagtcgagaaagccgatgaccgcgagacccagcaggatcgtctggccgccgccatcgccaccgccggcgagcacgactggaaggtgctcgtcgaacaggggattgatggtcgcgaaatcgaatgtgccgtgctgtgcccgaaggccggtgacgagcccgaggccagctggcccggcgaaatcgtgctcgatcatcagaacgacgaccagttctacgatttcgactccaagtacatggatgcctccgccagccacgtggaagtgcctgccaatctgccggtcagcgtgcttgaggacgtgcgtgacgtggcccgtcgcgcgttcaaggccgtggatggtgccggcttgagccgtgtggacaccttcgtgacgcctgatggcacggtgatggtcaacgaaatcaacaccatgcccggcttcacgccgatttccatgtatcccaaggcttgggatgccaccggagtgagctacaccgaactcatcacgcgattgattgagggcgtgctgaggtaagtgtggtgcggaatcggccgcaggccggttccgctattgacacatcgcccatacctgtcagtaattcatgccaagttttcctaagttcaacaggcgtacagcaaatggcgaacgcaattcacttgcgcgccagtgtcaggacagattaggcgcatagtttcttttcttggattcacgggccgcgcgaatgccgcgcataccaagcccgactccccagactgtcgtctggatgatgttgagaaaaggaacattatgaacaacctgcgtaagatcgcggccggctccctcgccgccgtgctcgcgttctcgatggccgcctgcggctcgagcaacgcctcctccgatggcaccggcgaaagcaccggcaaggccgtcaccgtgaacgaaaagtccgccaaagccacctccctcgccgacttcggcaccatggaagacctcgagaaggccgccaaggaagagggcgcgctgaacgtcatcgcccttccgcacgactggtccaactacggcgaggtcatcgagagcttcaagaagaagtacccggagatcaaggtcaccgagctcaacccgaacgcctcatccaaggaagagctcgacgccgccaagaccaacaagggcaccgacgccgcccccgacgtcttcgatgtcggccaggccatcgccgccacctccaccgactacttcgccccgtacaaggtgcaggcctgggacaagatcccggacaccgccaaggacgccgacggcgcctactacgccgactacaccggcatcatgtccgtgggctggaacgccgacaagtacggcgacatcagctccctggacgacctgctcgacccgaagttcgccggcaccgtggccctcaacggcaagcccgccgaggctggcgccgccttcaacggctacctgatggccaaccagctcgccggtggcgacatcaacaacctgcagcccggccttgactacttcaagaagctcaaggaagccggcaacctgaccaccgtcgacgtgaccaacggcaccatcgactccggccagaccggcgtggtcttcgactggacctacaaccaggcctcctacaagaaggagctcaaggacaagggcgtgaactggaagtacaagaccttcccgaaggcccaggtcgtcagctactacaaccaggccatcaacaaggacgcgccgcacccggccgccgcccgcctgtgggaggagtacctgtacaccgccgacgcccagaacctgtggttcaagggcggcgccaacccggtgctgctcgattccatgaaggaagacggcaccgtcgaccaggccactctgaaggacgccatcaccatcgaaggcgagccggtctcctacaccaacgacgactccacccgcatcaccgagtggctccagaacaactgggacaagacgatcggcaactgaggcacagaccgatgaccgccgcaatcgcacccattgcatcgaacggacctgctgccgccaaggctgcgggtccgtccgctactcccgcttctcctctctcctcggcgatggccaagcaccgccaggagctgggcacgctcgccaccacgctcccgttcttcgcctacaccgcctgcttcctgctcgcacccaccgtcatcgtgattgtcggtgcattccaggatcgcagcggcaacttcacgctcgcgaacttcaataagatgttcgaggccaacaccatcgccgcattcggcacctcgattctggtgtctttagcatcctctctgatcggcgcagtggtgggcgcgctcgcttcctacgcactggtcattggtgccaagccgaacggcctgctgcgtcgtatggtctccgccatctcctccgtgcttgctcagttcggcggcgtgatgctcgcgttcgcgttcatcgccaccatcggcatcaacggtatcggcaccatgcttatcaagacactgaccggctacaccgtgaacccgaactggctcagttcgttgccgggcctggtgaccatctactgctacttccagattccgctgatgatcatcatcttcctgcccgcggtcgattcgatccgtccacagtggcgcgaggcatgcgaatccctcggtggcaacacgttccagtactggacgcgcgtggcctgcccgattctggcaccccgcttcatctccgcgttcctgctgctgttcgcctccgcgttctccgcatacgcgaccgccgcggccctgttctcccagcgttcgattctggtgccgcttatgatccaaggtgccatgcgcaacgaactggaccccaaccagcagggctttgcccaggtgctggcattcgcaatgatcatcgtcgtggccatcgtcatgctgttgagccacgccgtggaaaagagggccggacgttggcaatgaccgaaacttccgcaaccaagccgccgcagctgcgcgccgctcgtgcgcgtaaacagagcatcatcaaattcgtgatcctgttcgtcaccctggcgttcctgttcgtgccgctgctggccatgctcatcttcaccctgcgtcacccgctgtccggccgctggtcggccgcgccgtggatcgcgattttcaccggcaacggcgagtcgctgggtgccgacctgaccgtgctgtggcagggcatcggcacctcgctggccctgagcgcggtcaccgtggtgatcatgctggtgctgctggtgcccaccatggtcatcgtgcatattcgctccaaggttttggagcgcgcgatcgaatgggtggccacgctgccgctgaccatcccggccatcgtgctggtggtgggtttgggcccgatctaccgctggctgtccgccgacgtgctgagcaccaacccaatctggctgtgctttgcctacgtgattctcgtgatgccgttcgccttccgcgcgatcgccgtggggcttaactccatcgacgtcaagacgctggtcgaggcatcccgctcgctcggtgcctcctggcccaaggtgttcttcaaggtgatcatcccgaacctatggcagtcgattctctcggcatcctttatctccatcgccgtggtgctgggcgaatacaccgtcgcctcgctgctcggccgtatgaacctgcaggtcgcgctctaccagctcggccagtccaattctcaaatctccaccgccatgtcgctgctggctctgctcttcggtgcggtgctcctcgttgcgctcgacctgatctccgacgcaatgcgcaagtcaagggaaggtaagtaacctgatgaacagcaattcgattttcacccgtcgccatgccggtgccgatgccgcggcttctgtttcggcacccgccaccacgtccgctgccgccgaggacgccttcaagaacgatcccaccgccaccctcgaaggcgtgcgcggcaaggacgtgaccaaggccgccaaggccctgctcaaagacagcgtcaagcgcggcggcggctccatccagatgcgcgacgtcgtcaagatctaccccggctccaccgttcacgcgctcgacgacttcaacctggacatcaagcccggcgaaatggtcgtgctgctcggcggctccggctgcggcaagtccaccgcgctgcgctcgctcgccggcctcgaagacatccagggcggccgcatcatggtcggcggccaagacgtcaccggcgtgccggtcaacaagcgcgagatggccatggtgttccaggcctactcgcttttcccgcacatgaccgccctggagaacgtggaattcggcctcgaagtgcgcggcatgggcaaggcagaacgccgcaagatcgccatggaacagctggagctcgtgggacttgccgatcaggccaagaagtacacgcagcagatgtccggcggccagcaacagcgcgtggccctggcccgcgcgctggccgtcaagccgcgcgtgctactgctcgacgagccgctctccgccctcgacgccaaggtgcgcgtccagctgcgcgaccagattcgccgcatccaactcaccaccggcaccaccaccgtcttcgtgacccacgatcaggaagaggcgctggccgtggccgaccgcatcggtgtgatgaacaagggcaagatcgagcagatcgccgccccgcagaacctgtaccagcgccccgccaccgagtacgtggccacgttcattggactcaccaaccgcctgcccggcgcatccaatggcgacgaggccgtggtcttcggccagcgcgtgccgctgctcgccggctccgccaagggcgattccgtggccgtgctcgtgcgcccggagaacctgacgctggccttggccggcagcagcgattcgcacgtcggcgaacgcgcccgcgtggaggtcattcacttccttggctccttggtgcgcgtggatacggtcattacctccggcgaataccagcgctggaacaagggcgaacagctcaaggccaccgtgcagctgcccgccagcgagctgccggccggtctggcggtgggcgatgacgtgattgtcaccccgcgtccggtcgccgcgctcgcctgctgaatggcgttgcgatgatcgtgcggttctgttctgtttttgtgactgtacgatcgtcgaatggcttatcggcaatgatgtgtgtgggacggcggcgatttttgggcgattatcgcgtgccgtcccacagcaatcttgcagagtaggggactttctcggcattgggaatgattgacgttgatcattccttgcccattgatgatttcctcccccattcccaatgcaatcgaaacgccgtgccgtattcttgaagagtattgcacgtgtgatcggtccgtttgcggccagtaactatgggggataagtatgagcgaaccaatgccgccggcgcagcagccgcaggcacctcagcaatcgcagcagccgcaacaatctccacgcgattggtggttcacggcccatcgccggttttcgacaatcggctcggcgctcgccattatgatggtgttctggatcggactgaatattctggccactgaagcactacgaacgctgcttggcaccgatgtgcccgcttgggctgtgctgctcgcctcctccggaccgctgtatgtggtggccatgccgctgagtatgttggccttcactcgcgtaccggttattcgcacccggcagtaccccatgaaggcgggggagttcattcagattttcgtcatgtgcattccggtaatgttcttgggcaatatgattggcaatatattgtctgccggagccactgatggtcaggccaccaatcgcatcaacgacgtgattcttggcagcgactggcgggtgaacgcattgttcataggcctgttggcaccggtttgcgaagaatggatttttcgcaaggagattatctcccgcctgcgccggtacggagagaagaccgcaatcatattctccgcattggcattcgcgctattccatatgaacgtgttccagttcttctacgcctttggcctaggactgatgttcggatatgtatacacgcgcacctcccgactgcggtattcggtggctatgcacatgctgatcaacctgaacgggtcagtactcgccccattggtgatacaacagatcgatccccgcatcctcgacggcacggtcagcgaggccgaaatcatgcgtatggctgaagccggcaacatgggcgacatgggcatcatgatgttgtacggcacagtgatgttgggcctctgcattgccggtatcgtactgcttatcaccaagcgcaagagctgggagttctatcttgcgccagaggagttgcctgcggggcttaaaatacgcaccgcctatgccaatcccggcgttatcgcgtacctactgttgactgtgatgcttaccggttggatgctgttcgcatgactgtcatagccggacccagagaggcgagccgggagatatcacagattgcctgacgagccgccatcttcaacaaggtattcggtgcccgaaccggcgatggctcgcgccgccatatctttgatggtggaaggcagcacaccctcgcgcgcgaacacaagcacttggccggtcatgccgtaaggggagaagccggtgaacttgaccaatggcggctgaccctccagcgccacgtcggcggtggctttggttacgcggtcgagaatatcctgactgatcgcagacgggtcgccggaggccttggccgtgaactcaagcgtggccatgccttcgctgaccggcgtgagcttggtcagggcggccgtattgagtaccgaattggggatgaccatcatgtctccggaacgggtgcgcaccacggtctgacgccaggtgatgtcgtgcacggtgcctgtgacgccttgaatggtcaccagatcgccgggttggattacgcggcccagcatcaggccgaagccgccgatgatgttggcgattgtatccttcagacccagcgagatcgccacacctccaacaccaagggcggtgataagtgtggtcggattgatgccgaatacgggctgcagtaccatcgctgcgccggtgacccagatggtcacgcgcgtgaggttcacgaaaatcgaggcgctgggaatctgagaattgtccagaatcttgcgcaacacgcggctgatgacgcggtcggccacaaatacgatggccaatacaatggtcagccagatgagtttgccggcgttcacctgaaaccagcgtgcgatgtcttctgcatattcagtcatacgcctactgtatcggtcgtttctggtgaagtcgtggagacggggtggcagaaagcggaatcggcctacggtcgattccgctactcctggcgttcgcggcaggtctggccgaggccgcgggccagtcgaatcggatcgagaatctcgtccaactgctcggcgggcaggtcggtgcgttcgccggccacctcgcgcacggtacggccggtatgtacggcttcggcggcgatgtcggccgcgtgctcgtagccgatgtagtggttgagcgcggcggaaatcgacggtgaggactgggcgtatgaacgccccaggtcagcattgatttcgatgccttccacgcagttgacgcggaacgtctccatggcgtgcgtcagcaacgccatgccggtcagcagctcatgcaccatcaccgggtcgaaggcgttcagctgcaactgtccctcggccacagcccagttcacagtcacgtccatgccgaaaatcgtgaagcagcactggttgacgcattcggggatcacagggttcactttggccggcatgatcgacgatccggcctggcgagccggcacgttgagatcgttgaaaccgcagcgcggcccggaattgagcagtcgcaaatcgtcggcggccttcttcaggtgcacggcgaggctcttgatggcagccgacgtggccacgtacgcgcccatatccgtcatggcggccaccggatcgggcgcggcggtgaccggcagcccggtgatttgcgccagatgcttgatagcggacttgcggaatcgcagatccgcgcaaatgccggtaccgatggcggtggcaccgaggttgagctgggccagcagcggcaccacgcgatcgaatgcagccaaatcagacttcaacagcgtggcaaacgcatgaaattcctgaccataggtcattggtacggcgtcctgcagctgcgtgcggccaatcgtcacgtcattgatatgtttgtcggccagatcgtggaaggccttggcgagtttcttggtggactcggcgagcggcccgatcgcgtcgataagcgcgagtttgcaggcggccgggtaggtgtcgttcgtggactgcgacttgttgacgtcgtcgttcggatggatgtatgtgtaatcgccgcgctggcggccggcgatttccaacgcacggttggcgatcacctcgttcatgttcatgttcgacgaggtgccggcaccgccctgcatcacatcgaccgggaactgatcggccagtttgccggcctcaatttctaggcaggcggcgcgaatggcctcggccttggctgggtcgatcaggcctaattcctcattggcgatggcgcaggcgcgcttgaccgtggcataggcgcgaatcagctcgggatgttggctatcggtgatgccggagaccgggaagttgccgatagcgcgctgggtgtgaataccccagtagacgttcgccggcacctccatctggccgatgcagtcatgttccagacgggtcttgttcgatgtttcgctcatgcttccatcttcctgtgcgtgggttggaaacgccagcatgagaggctgattgcgccttgtgagaaacctcacgcgaggttcgtgcggcggaaacaatccagactcgctggttttcggtcaagcggtgtacccggggaatcctgcggggccgttcgacgatgagatggtggatggcgcggcatgcgtggcggcgaccggcatgccgggggcggtcgaatcctgcgcattgtgcacgaagatgcgattccagtaattaagcatgtccttttggctcatggccaggtatatgcccatggccagcacggccacatcttctttaagcaggtctttgatttcgatggtgtcgctcaattcgggccaacgttgcagcacggcgagcatgccgcccacggtgaactcgaccatgagatcggttttcaggtcaaggttcttggggtcgcgttgcaatgtgctgagcatttgcagacggcagaagtcgcgcagcgattcggtcagttcaagcgtgctgtgcgggcctgccaacagggccaggtggtcgaggcgctgacgctgctctggatcggagagcgtggcggtgacgcggtctcgccattgttcctcgggattgccgttcggatcgggggtgcggttgatcggaatcgattcgacctgatgcaggatggctgaatcggccaattcgggcaggctggagaagtgatagtagaacgaattacggttcacgccagcctcacgcaccacgtcggtaacggtgatcttgcgatagtcgcggtcggcgagcaattcccagaaagcgttctcgaggcgttctttggcgggcagcacctcggaatcatggcgtggacgtggcatctcttcctcctgatgcaccagcgtgatatggtcacgctgtctaataacttattgggcagtataactattatttgtggacatgtctatgagctaatcggcgatttcagttgcgtcctccgctgatggcgaagctgtggtgccggcatcggcatcagtatcggctctggccggagctgcgctatctgctcctgctgcagtttctgctgggatctcggctgttgctttggaggtcgcagaacttggtgcggaagccggggcgggcgtcggcttgcgtttggccgtggacgccttgaacagtatcgccagggcctcaaccaaatgacgccggtctgcgggggtcagcccaacgtacgcgccaagcatcgccggaatcgaagcggggaagttgctcatcacctcgctgaagctggtggcgccgttggcgtgcagcacggtgaacagcgcatccaccgcacgctcgcgctgttcgggcgtaagcgtggcgatccaatggttcagctcctcgttaaacaactgcgagctggaactcaaatccggctcggtgatgaactggtcaccatccaatagccaggtgaaggcggaatgctgcatgatgccatccgaatcggaagagaccacgcggcaaggctccggggtctcgaaaatcatgcccacaatcgacgaactcggcacgattttcgtcaccttcggctggatggtgcggtaggcggggctggtcacaatctccggcgggaaaccggggccatccagtgaatagacatgctgaatgcgcttgcgcaccttgggatcggcgttcatggccgcgtaaatcgccagattgcctcccttggaatggccgaccagaataatcggaccctcccacagtcgcgccaccatatccagataggcgctggctgaacgttgcgccggcaccggatactggaaagccatattgaaatcttccttccatccgatgagcgaatcatcggtgccgcggaaggaaataaccaacgtgcctttgtaggtcggctttcggcgcttgtggccgtcgggcagttggaaggtggcggcggcgaattgggtttgctcaccctgattgatgtgctcgaccaccgcgcccaggcgaacgttggcgtagcgggggttttcgcctgcggcctggaacaggtcgtgggtcaggtccgggttgaccactgaaaccatttgggcttcgtgcggcttgtcgtcggcatgtgtttccggcgaacgatgcagctcgcggttggcctcgtcaaggcttaccgattcaagctcgggatgccagatacccttcagccagatcagtggatgcttgggttcgaaagcgcgaatgcgtgcggcgaacgagcctgaccgcgtctcatccagcatcaacgtcggacagacactggccacatcctcatagatgagcgtggagatgatcaaggcgtcgatttcgttgaacggcaagtcggcgaaggagcgcgtttcggtgtgcgcgtaatcgataatgccggtcatgcgcacctcctgcttccgttgatattgcatatccccttgggctgcgtggtcttgcgatcgcgtgcggccgtgcggctgcgcgcagcaattaaccatatgcattccattgtagggattgtacggttttggccggcgcgatcgagcaagactgcaccgacggcgaacaattcgtggaaggattcccgtcggcttgtcgaaaattgtcgggtagcagggttgcgatgccagccagccgaccaccctccggcgctacgcgccatctcccgccggcgggagggttaaccactcaatcctttttgacgaggcggaccgctgggcccgtcaaaggttcggcagatcgaagcgcgccagatccacgccctcgagttcaagcaactcggccttgatgtcgagtcggccgccgtagccgccaaacgcgcggcccgagccgactacgcggtggcagggcacgatgatggtaaccggattgcgcttcactgcgcctccgaccgcctgcgcggccatgcggccgccgccgcgtcgttcggccaattcggcggcgagttcgccgtaacttaccgtcatgccataggggatttcggccaccagattccacacttcatgttggaatggcgtgccggcgggatgcaaaggcggcacctgatccgagccggggcgttcgccggcgaaataggcggtcagccattcgcgggttatacggaatacgtcgggttcactatcggattcgcgattcgaatcgagaacggcttggtgatcggtggcccaccaccagtcttcaagacagagttcggtaagtccctcgccgtcggaggccatcatcatccggccgatgggcgtttcgactgtggcccgcatcagttgtcgttgcgtcataccgccattatcgcgcgttgagggatgaagcccataccgtgcctgattccatgaaggacggcacgtcggcgtagttcgggaacttcacttcggcgctcgataatcgttggaaaaccggtgggacacgcgggggcttggctttttcctgagattggcgtatctttgtcacctgttgcctgtgaaggtaacacatgcggacatagcttagttggtaaagcgcaaccttgccaaggttgagaccgcgggttcgagtcccgttgtccgctctcggatggttgattcatgctgattgattcgaccggatgatgacccgggcggttggcgcagtggtagcgcacttccctgacacggaaggggtcacaagttcgaatcttgtatcgcccactcgatgaatcgccggcagaatgttgccggttttttcatcacaggctcgggcgattggcgcagcggctagcgcacttcgttcacaccgaaggggtcgtaggttcgattcctacatcgcccacccgagattcacgctcgttggccatgtggccgcgagcgttttttcataatcgatgtattccgattatgccggtccaatcggggtgcgggctagaatgccgcggagccggcagaatggcgggattccgccgatgcaacctgtggttgcgcgcgaatatgcaacctgaagatggtggcgcggaactggtttgccgtggcatagtgagggcatcggccgaatatgtcatgatgagcattacctatgaagggacactccgatgagcttccgcgccaacctgcaatacctgcgcgcacaacgcaacatgccccaggaacagctggccatgttgctcggcgtctcgcgccaggccatctccaaatgggaatccgagaaggcctatcccgagatggacaagctgcttatgatctgcgacctgttcggttgcacgcttgatgacctggtacttggcgatgtgagtgcgagcgtgaacgtgggtgcggccgcgcgcggcgcagcggagggcgaccatggctcggctgccagaaccgtaaccggggagggagccggggaacccgcgtatatgaaggatgctgatgggaacatcggtgaatcagcgcggtccggcggtgacggcatcaatggcccgagctccgcaaatgcattgcccggcgaaatgttgcacggaaccagttcatcacgtcccggcacgctggctaatgtggctgccttaccgcaggatctgaccggctacgatgaacaccgctgccgattcgcgctactgattgccggcggtgtcgcggcgattatcgcgggagccggcatcggcaacctgttcgattccgataattccattctcggcgtgacgccactcaacgattttctgacattcctgggcatctgcgtgggcgtgattatcgggctggcgatgctgattccgggcggcatgtcacataccgacttcaaacggcggcatccctatgtcgaggatttctatgctgcgagatgtcgccctcggcacagagttgccgagggccggcaaatcactcccgcgtcgggtccttttgcaggagcaggaagacgagtgccgcgacgagcaggacggcgatggagagcacgccgagcgaggcgttgccggtcagggacgtggtggtggccaccaggaaggtgccgatgatcgaggcggtcttgccgaagatatcgtagaagccgtagtactcgttggcgtgatccttggggatgatcttgccgtagtacgagcgggagagcgcctggatgccgccctggaacatgccgaccagaatcgccagaatccagaactccacggccgacttcaggaagaacgcggcgaagaacacgatgcacatgtatgccacgaccgccgccgtgatcatcgccttgcaaccgaatcgcgccgccaggcggccgtagagaatcgcgcaggggaaggccacgaactgcgtgacgagcagtgccaccaccagctgggtggagtcgatgccaagctcggcaccgtaggaggtactcatcgaaatcaccgtgttcacggcatcgatgtagaagaagaacgcgatcatgaacatccacaacggcttgttcttcacgattttgccgaacgtgcccgccagttcgctgaacgtgccgcgcacggccgagcccagctggtcacgggtggcgcgatagtgcacttggcggtagctggtaagcagcgggatggtgaatgccacccaccagatggcggtgatgatgaacgaggcgcgcgtgcaagccaccgtggaccagtcgaagagcgacgggccgccgaagatcagcgcgatgcagaagatgaacggcacggtggagccgatgtagccccagccgtagccatgcgaggagaccttgtccatgcgctcgttcgaggtggcgtcgatgagcatcgaatcgtagaacgttagcgagccgttgaggccgatggtcgccagaatgtagacgactaggaacggtagccaggtcaggggcagggccattgcgcagcaggtgaccacgccagtgccgaagaagccaaggaagaacttgattttcatgccttgcacgtcggcgatggagccgagcaacggcatgagcagcgcgatgaccaaggaagcaatggtttgcgcgtagccccaggcggacacgatgttgccgtccgccggcatcagcgatttggcgtaaatggggatgacggcggtggacagcagcacgaatgccgagttgccgacgtcgtagatgatccacttcttctcgcggtcggtcagtttggcgctttgcggcaccggttcgtggacattcgtgggatcagtcatatacactcctcgacagtattcaactcaatctatcgtagaagcgcggactagggtaggggagccattccggttgaacggcggatgaataatgccgggcctctttctaaggggagccagagcaaaaatagctcccctcgctgaggggagctggccgcgaagcggactgggggagctacctatagtcgactattcgccgatcagcgcgatggcctcgtcgtaatcggggcattgcggcacgccgttgaggctgtgctggatggcgatggatgccgccgcgttggcgatctttaccgattcggccagactatggccctttgccagcatcgcgcacatcacgccggtgtggcaaccgcccgccgaacgggtgtgtacggccttggtcgggtatccctcgatatgaatcgtctcgccacctggctcacgaatccaagcgccgcgggcgccgacacgcaccaccagcggcgcgcgcagtgtagcgcccaagccgtcgcacaactggtgcatgaagtcgtcaagtccgccgccaatggtgactttgctgtcgtcgattggcgcaccaagtcgctcggccagcgtcatggcctcctgacggttgcaggaccagaccgggcgtgcgagcaccaggtcctcaagcatatggtcgttgaccaaacgcaacgtattggtggggttgatcaccagcgtgtagtcgcgtgcagccgggtcggtaccggccttgagcaggaatccgtccacgccggtggccgtgtggtccatcagtgtgttgccgctgatgtgcaccacgtctttgggctgcggctccagcgtgtcgaacgtgtccgagtcgccatgagcctcggcgccataggaagcgatgaatgtcttcttcggcgcgccggagctcagcaccacgcggaagccggaatcctcatcaagacgatcctggccgatatgcgtaatgccgttgtcttggaatgactggcggatgaaatgcgcccacaggccgttgcccagaatgccggcgtgctcggtcggcacgcccatgcggctggccgcctgcagcacgcgatagctgccgccaatggagggcttcggatgatcggccacggcgaatccgccctgtgccggcaccttgtccacattgagcataatgtccacccagacttgccccagtgaaatcacgctgggctcgtgagtgccgatacctcgcttgagattcaacatgacagcctccttcgtcgtaagttgcacgtcgcaagttgcacgaggaccccttcgtcccttgccgtctcttataccgagattatatgagagtttgctggatgcggaaaaggaaggccggcgtgttttatcgggtaaacgctatgatttgcagcgtaattcgccgctggcgaactgctgacgaactacttgcggaccgctggcgaaccaatgccgagccgctcgtgaaccgctgatggcccactcgcaagttacgctcgaaccgcgcgtgaaccgccgaggttcgcccatgatacacgcaagagttgcggttgtcggtattgggctatatatttgtgaagttgtgtgttcggcatgtcgggtgaaaccggcggtcgaatgcgtgaaagacttgacacatcaaggttaagggagtccatcatggcagctcgttgcgcagtgtgcggcaagggaccgcagaccggtttcaccgtttcccattcgcaccgtcgtaccaagcgtagcttccgcccgaacctgcagtctgtgcgcaccacgattgatggcgagaacactcgcctgcgcgtgtgcgtcaagtgcctcaaggctggcaaggttcagcgcgtggccgcgtgaatcgcgtactaacgtggagcaaaacccgtttgagcttcggcttggcgggttttgttgtttctgcggcctaaagaggccgtgcgaatagaataggccaatatgagcatcactatgggcaccactctcgcttcgctggtcaccaacaagcgtcgcgtgtccgcgctcaaatcgctgggaatcgtcactgtcggcgacgccttgacctactatcctttccgcgtcaccgaaccggtgccgcttcgcgccatccgcgaggccgcacccggccagcagatggcatttgccgccgtgatacgagatatgcgcgtggtgccgatgaacgctcgccgcggctaccgactcgaagcgacggtcgatgacgccgacttcgcccggtctcgtcgcgtacccggcagtacggcccggctcacgttcttctcgtatcgtaaatcgtatgtggattgggtcagcgtgcgactgcgcgccggcacgtctgtggtggtctccggtatgcccggcgaatacatgggtcagctgcagttcacccatcccgaaatcctcactgtcgcgcccgtgccggccggagcaggagcggggcttgagggttacgctcggggcgcggcatccggcaatggtgcgtttgcgggaagtgccgatccgtatgccagtgcgcagtccgcgtatccgccggccgcgactgccccttccggggccgcgttgaaatacgacgccgataccgtgcaagaggcgcttacccgcgtctgccggccccgcccggtatatcacgccagttcgcgtatctcgtccgaacatattcatgagacgattctgggattgctgtggatgatgggggcccgcacgtcatccacgcctgacgggcaactcgctggcgctggggcagccggcattgtggctcccgcgactgacaccatcgccgtccaaaacggggaagagaagtccggcacgaccgccgaatccggtgctgaggcgctctcccaatccatcccagatgtgctgcccgaatcggtgcgcaaggccaagaacctcatgcatcgggctgaggcgttcctggccattcatgatccggcctccacggcccggttcaaggaggccatcgaaaccctgcgctatgaggaggctttcgtttcgcagacctcgctgctgaagtctcgacagcacgcgcacaagtcatcggcgcatccttgcccgctgaacgaggcgctggaaacagctcgagcgtcggtgggcgaagcggttgcggagccaagtacgcaaccagaagcatcggagcgcggttctgcgaccgatctgcctgatctgcccaatttgcccaatttgcgcgaccgcttcatcgcatcgttgccgttcacactgacagccgggcagagtcaggtggtggacgacatcgcgtccgatcttgaacgtgactggcccatgcagcgtctgttgcagggcgaagtcggctccggcaaaaccgtagtggcgctcgcggccatgctgcaggcggtcggcgccggctatcaggcggtgctggtggctcccactcaggtgcttgccgaacagcattacgagaccatcagcaagatggtgtcggggttgacccttgcacagccgggtgccaaggagaccgatgccgcggccgacgttgagggcgcgatgggcgcgtccggtgcttcgacggtctcttcttccaaggtgactgcggaaattcccgtcaccctgctgaccggtggtatgaagcttgccgcccggcgtaaggcgctcgctgcggccgccagtggtgagccgggcattatcgtggccacgcacgcggcgttttccaagaccttccaagccccgcacttggccttggtggtgatcgacgagcaacaccggttcggtgtggaacagcgcgaaagcctcaacgccaaaaccgatgacggcaccacgccgcatctactggtgatgaccgccacgcccatcccgcgcaccgccgccatgacttggtttggcgatctcgatatttcctggctcaccgaattgcctggcggccgcaaaccgattcgtaccgtggtggtcaatgaggccgacgccgccaccatggggcgtatgttcgcgcacattcgcgcgcgagtcgacgcgggggagcgggcctatatcgtgtgcccgcgcattgatgcggatgatgaggagaacgaaggcggttccggcgtttcggcagcagccggttctgcccgcggacgcgccgcagcatctggttccagtgcccgcacagctgcgggcggccgtgcgacgcgcgcggcggccgatgccatcggcatcgacgacccctacgaaaccttcgacgaaaatggcgaaaccgtggctcgcccgccattgcatgcggtggccgaaatcgccgaccggttgcagaaacttccacagttccaaggcattcggtttgcgactctgaccggccgcgacaaggatgacgtcaaaacccaggtcatggccgattttgccggcggcgagactccgatcctggtgtccaccacggtgatcgaagtcggcgtggacgtcaagcaggccagctgcatcgtcatctttgatgccgaccgatacggcctctctcagctgcatcagctgcgcggccgcgtggggcgtggcggcaccaactcgtgggcgttccttatttcccgtgcggaacccggctccccggccgagcaacggctcgaagtgattcaccactcgctcgacggtgccgaaatcgcccaagccgacttggaattccgcggtgccggcgatgtgctcggcgacgcccaatccggcggcaagtccagcctgaagctcctgcgcgtggtcaaggacgccgacatgatcgccgacgcccgcacccgtgccgggcagcttctggccgccgaccccgaactggcaggtgaggtccaactcgccggtgccgtcctcgacttcacccgaggcaacgaaaccttcctgacctccagctgaggcacctccagctgaggctagggctgcgcccccgtaatcgcacgatatagtttttccgtatgccgatcgtgaggaaatcacggtcgggaagccctcgaatgtgcttcagtggaggcaagaccattcgtacatgaggtactcgaagtgcatatatcattggtgcgcttcgagcaccccattgttgttcatgattggtatgcgcagatgaacctgtacagtgaaagctatgcgtgtaatttctggacgattcaagggtgtggtgcttgctacgccgaaaacgggtacccggcctaccacggatcgcaccaaagaggcgattttctcgcacctcgactcatggggagtgctggatgatgcccgtgtactggacctgttcgccggtactggtgcgttgggcatcgaagcgctgagccgtggcgcgcgagaactcgtggccgtggaaagttcccggcctgcggcggcgctgattaccaagaccttggcgcagctacagaagaatcgttcgtgggatgcttcgctcaaggcccgtgtgctggtcaaaaaagccgagcaagtggctggcggcttcggcgaaccattcgacgtgatattcatcgacccgccctatgcctatgagaccgctgaatgcaatcagctactgtccgatctggcggcgggcagcgccaccaacgagaacacggtgatcatgctcgaacgctcggtacgctcggatgatcccactgccccggaggctggcaaatcaccgaaagccgcaactacggcgaaaccgccgtcttctacatcgaatccgcggatgacgactcggatatagagcgttccgacgattccgccgcgtagtgaatctcccaccgtgtggtgaattaatcggcgagccggcgcggatgggcggcggagacctcccagcccaaggccatcagggtcttgcgatcggccttatccagcgccttgcaatccagtgccgcgataaggtctggccgaatctcggcggtgcgggccagcgcttcgtcgcggcgaaaacggtccaccttgccgtggtcgccggacaacagcacatccggcaccgcaataccgcgccacacggccggcttggtgtactggcgatgttcaagcagtgcgccctcgccggtgtaggattcctcaacaatcgaatctgggttgcccatgaatccgggcatcaggcgggtgatggcctcaagcatcaccgataccgctacttcgccgccgttcagcacatagtcgccgatcgaatattcgcgtacgtcgacgccttgggcgcggtagtagtccgggatgcgcgcatcgtagccctcataccggccgcagccgaacagcagatggtcggcatggctgagctcggtggcgtcgcgctgggtgaacaacggggccgatgggttcgggaagatgagcaccggtgcgccggatggggcgggggagccggacggctgcgagaatcccagcagttcgtccagacattcgctccacacttcgggcttcatcaccatgccggccccgccgccgactggcgtatcatccaccgaatgatgcacatcgtgggtccagtcgcgcaggttgtgcgccttgatctccaacaatcccttggcctgggctttgcccatcaggctgaggttcatcacctcaaagtattcggggaacacgctcacgatatcgatcttcatgtcatccagcctaacggtagcccctcccgcattacacggccaccactacactattgcggtgatgaatacgacgatgaacctccccacccgcaaaaagcccgaagtgttgtccccggccggcaacctgaggggcctgaaaaccgcggtcgattatggtgccgacgccgtctactgcggcggcaaagccttcggcatgcgatcggcccccaaaaaccttagccttgaggatttcgaggaaggatcgcgctacgcccatgaacgcggcgctcgcgtgtacgtgacctgcaacgtgctgccgcgcaacaacgagatcgaagccatgcgcgagtacgtcggccagctcaaagacaccggcgtggacgcgctgatcgtctccgatattggcgtgatgatgatggcccgtcaggtggctccgaatctggaactgcacgtctccacccaggccggcgtgactaattatcaggctgcgaacgccttctacgagcttggtgttcgccgtgtggtgttggcccgcgagatggacttgcaggccgtgcgtgatattcgcgccaacattcccgatgacctcgacatcgaatgcttcgtccacggtgctatgtgcatggccttctccggccgctgcctgttctccaactatctgaccggccgcgatggcaatcacggcgaatgcgcccagccatgccgctggaagtattcgatcgtggaagagaagcgccccggccagtacttcccgatcgagcagaccgagaacggcgcctatctgttcaattcgcaggacatgaatatgctgggacacttggatgatttgattgactccggtgccaccagcctcaaaatcgaaggccgcgcgaaaagcgcctactatatcgccgccatgaccaacgcctacaaaaccgcggttaatgaatacatgattcaacgcggttttgaagacgctgatggcaatgttttgaagcctttccatgaccgtgtgattcgcccgggcgaccccgattttggccaaggaaccgaagatcaagtgatgcgcaatgctgatgccgcgttcgccggtgtggccgatgagggatatgaccgtggctctgatactgcggttgccgattcggtcaccggctcggttgccgcagaacgtgaccgcgtgacggttgctgatgccgtcgactcaactgcctctggtacgccggccggcaccgccgtcgaacccgacggcatgagctctcacgcccgttccacgcgccgcaagtccaacaccgcggtcgaacagattgagaccgattggaaacatgcggccgttcgcccggccccacacgtcgaactgcccgaatggctgctcgaggaaaccgacaaggtggcccaccgcgactactccaccggcttctattacccggagcacaaggtcacacagaacaccgaccgctccgcctacttccgctcatggctggtagtgggcgaagtgctgagctggagcgcggacgaagacggacgtgtcacgctgatgagccgtaacaagattgagcccggtcaacaggtcgaattcctgctgcctggcgagagaccattggtctttaccgtgccggaaaccggcctgcgcgatgccgatggcgcgccagtacccgccatcaataatccggcgcacgtgttctcgatgccctgcccgcaccaggtgcccatcaacgccgccatccgctcgcgcaccaaaaagcccaccctcaaagccgaataacctaccactccgcccccgctgactgggggtggtcatgaaaatcatgaacaccgcccgcacccaagaaagaatgccttatgcctgaatacagcgaagaaatcctcgattccaacagcatcagctctaccgataaagccggtcgccctattccggtgaccatccccatcgcactggcccccggcatcaaggtggtgtacaccacgcgactgggcggcctgagcaccggcgattacggcaacctgaacctcggcggcaagtccggcgacgaacctgaggccgtgctgtcgaaccgcatcgcactcgccgaagcggtgcaagcccgcctatcgctggtctcccaagtacattccggcgtggctgtggacgtggacgactcgttcgtcatcaacacccccttcggcttcgacgtgtccggcacacatggtgagactgacactccgcacgtcatcgaggcggacggccaggtcaccgcacaatccggcatcgccctaggcatgttcgcggccgactgtctgccggtgctgctgggcgacccggtcaccggtatcatcggtgcggcccactgcggccgtcgtggtctggaacgcggcgtgatcggcgccacggtggacctgatgaagagcaagggtgccgacccggcgaacatcgtggccacactcggcccgcgcatctgcggcgactgctatgaagtgggcgacgagatcgccgaccagttcatcaagcgcttcccgctgaccaagacgaagacccgtttcggcggtgccggcatcgacatcgccgaagccgcgatgatcgacctcgccttcgccggtgtacatcaggtggtcgattcgatgccgcgcgtgcacgccgccacccagtaccttgaggaagacccggaactcgccgaactgtgccgtacggacggcgaaggcccggccgagctcgcggagcgcatcgacaacatcagccacagcatgtgcacgctcgaaaacccactgtggtactcgcaccgccgcgccgcgctcgccaacaaaacacacgaaggccgcctcctcgccctcatcgtgcgtgactaaacggagaatgcgagcacattccgtggagaagatgtgatgcagttcacggacggccagccctcaccttacggtggtgcctatgactgagagagatttcgatacccccgtcgagacgcctaccgtccaaccggcccccgctcagggtgccaaaccggcgcaaaccgtgccggtggtggccgtggtgctggccgccggcttcggtacgcgcttcgaccccgataatcccaagcagcttgtctccgtgggcggcaagcccatcgtgtgctggagcattgatgcctttgaacattgcgatcgcgtcagcgacatcgtggtggtggtcaatcccaaggtgcgcggtgaagtggaaacgttggttggcgagatgggctacaccaaagtccgcgtcatcattgacggcggtgacgaacgtgtggacagtaccgccgccgcgctcgacatgctggctacggctggcattccggacgatgccaagattctgatccatgacgccgtccgtccgttcgtggaacagtccgccatcgacggttcgattgatgcgctcgaccagttcacggccgcgaccgtggcctacgcctcaaccgacaccgtgctgttgaccgaggatctgggcgatttgaaagtggtcaagtcggtgccggaccgcccgaacaccttccgcgcgcagaccccgcaatccttccgcttcgcgacgattcgtcacgcttacgatttggctgccgccgacccggacttccatcccaccgacgacacgcgcgtagtggtcgattatctgcctgatgaacccgtcgccattgtctccggtgcggaaaccaacctgaagatcaccacgctggaagatattcccacagctgagcgtatcgccgaggagattctcggtcgtgatcccaaggaagaggcccgcgcccgcatgcacgccctgctggcccaagcggccggccagatgcatcgctagactggcattatgcgtgaactcaatgttgtgatctccggcttcgaccactatgacggcgtggaggtcaatcccgccgtcgaagtgcccaaggccatcgccgagcagggactgggcgtctcctctgctccggacgatccgttggagcaggtcgccgtcaccgttcatgctgtcagcatcccggtgagcttcgccaaagcctggcccacgctgaaagagacgattgaggccaccaagcccaatatcgtcatcgccaccgggctcaagcacgcagcccgaggcgtgatgcttgaacgatgcgccaccaacctgatggacgcgatcaagccagacgcggacaacgtgatcccacgccgcgaacccatcgatcccaatggcccggccgcctattggacccgcctgccgttgcgctcgatcctgaatgatttcacggacgattcgattccggccaccttgagttcggacgcaggtacgttcgtatgtaattcgctgttctacaacttgctcaactggaccgccacccaggagcaggtgctgggcggattcgtcagcttccctccggtcgttccggcgcattccagccagcatggtctaccactcgaccagcagatcgccgctggccgtgatgtggtgcgcgaagccgtgcgctactatctcaagccctccagctccgacatcctcatcgcctagcacgctgtgcgccacgccggaatagaacatggttcgcacgcattgtaacgattgcgcgtcgctcaacgctcagcgctagtgcgatgcgctacagtgcttcaaggatgtgccaagagctttatgcgtgtgcgaaaggaataaacagcgatggtggatcgtttcccggtggtgctgcgaggatatgacaaggagaaggttgatgctgccttcgacgctactcaggagagtatgaagcgtgcgcagcagacgttggccagcatgcgtgagcagattgcggcggatgacgaccgtattctgcaactgcaggcccaacttcaggaagagaagaacaagaagccggaaggcaacagcttcgcttccttgggagcgaacgcccagcagatgcttgcctccgccgaacagacgagtaccgaactgctggaacgcgccaagcaggacgcgtcctccatccgtaccacggctcaggctcaggccgaaacactgatcaacaacgccaagctggatgcccagcatattgttgacgacgccaatgccaaggccgcctcgattctgacgaacgccagcaatcaagccgaatcagtgaccacctccgccaacgaggatgccgcacaactgcgctccgaaactgccaagaccatcaccgaacagcgtcagaccgtcgagcttgagctcagcaacgcgcgcgaagagcacactaagaagatggcttccgaacgctccactcaagagcgcgaaatcgccgacatgaaggcggaggcgacccagcaggttgccgcaatgcgcaaaagcgccaatgaggagatcaccaagcttaagtctgattccaacgatcagattgaggcggcgctcgccgaggccaacaagaagctcgccgacgtgcgcgagcaagtgtccaagatgatgaccgaagcccagcgcaaggccagcgaaatcattgatgcggccaaaaccaagggtcaggaaatcactgatgaggccgaggtcaagcgcaccagcacgatgagccaggtcaacgccgaggtcgagcagatccgtcacgacatcgccgctcagcaggatgaggccacgaagaaggtcaacgaactgctgcagcacctcgaagagcgtcgtgtggcggccaagcgggaagccgatgagttggtcggtcaggccaagaacactcgcgaccaagccgattcgtatgccgcgtccaagcgcgaggaggcggacatccaggccgccgcaatcgtacataaggcgggcgaggaagccgatgcgcagatcgaggagcgtcgcgccgccgcccaaagcgagcttgacggtctgtccaagcgcatcgccgatctgcaggaacgcgagtccgtcatcacccagcgtgtttcggaactgcgttctatgttctcgcaggcgttctccggattcgctttcggcggtaatgcggcggcctctggtcaggatcaggaagccgctgccgcggcggcattgccggtggttgcgcccgtcccggaagtcaagcctgtacacaacgaggccgatgaccagccgggtgagttgagcggaaacgagtcggctgccgacgattacaatgagacagatgcggcaccggctgattcggctgattcggctgattcggctgcgcagaatgagcagtccgaatcgtctgagccgtccgagcaccagacacagggcgaaccggaggccccgactcaggagaatccggccgtatctgagcagaacggcgaatgacaggccttcgattagactactagcggtaagaattacggcacctgcgctttcgagccaggtgccgtattcgtttgaatctgcgccacaagcgcaccatcacagaaggagtatgacatgagtgaattgacgcctctgaccgacgaagcgttgaataccctgcgcggcgatttcgcacagagcggcaccaaccgtctggccatgaacgcggtgaccgccgccggcatcgacaaggtggctcgcaattatgaccgcgctcgtctgatgcagcgtcgtttctccaccatcgttgacaatggcgaagccacccatcaggatcgctccggccgctgctggctgttcagctccctgaacgtggcccgtttcgtggccaagaagaacatgaacttgaaggagttcgagttctcccagaactacgcgatgtactacgacaagctggagcgcgtcaactacttccttaaggatgtggccgctctggtggctgccggagagccttccgactcccgcctgatgcagcacctgctcgccgacgtgatgggcgatggcggccagtggaccatggccatgaacgtgtacaagaagtacggcgctgtgcccaaggacctgttcccggagaccgaatcctccaagaacaccggtgaaatgaacatccagctgcgccacatgctgcacaccgccgtggcgcacatgtacgccgctgacggcgatgcctccaaggtcgaggcgattattgccgacgccactgctgccggccaccgtattctgaccatccacctgggcgagccgccggtttcctttgactgggaatggaccgacaaggatggcgaattccaccgcgacggcgagattacgccggttgagttctggaagaagtacgtgggtccggctgatcttgaggactacgtgtgcctggtggacgatccgcgcaccgagcacgccaagggcaagaagatcggcatcgagcacctcggcaatgtggctggcggcgacgccaccgagtacctcaacgtgccaaaccagttcatgaaggactgcgtcaagcagattctcgttgagcagggcattccggtatggttcggtgccgactgccacccgttcatggaccgtgagaacggcgcttgggccaccgacctgttcgagtacggccgcgtgtacgacgtggacttcgatttggacaaggaagcccgcgtgcgcttcggcgactccgccatgaaccacgccatggctttcgccggcgttgacgtggccgacgacggcaccacccgccgctggcgcgtggagaactcttggggcgccaagatcgccgacaagggctacttcaccatgtccgacgactggttcaccgaatacgtctacgaggtagccgtcccgaaggccctgttgcccgaggaataccagaaggccctcgaagagccagccaccatgctccccgcatgggatccgatgggcgctttggcctgacttcgtcagcctcccggaatcggcctgacggccaatgctgtgttttctcgcagcctgtcggctgctagggtctctccctctgtcagcgcgaagccgctgacagagggagagaccgcggtcgcaggccgcacaacaacacagcatcgccgcaggcgagtccacccaaagtccataactgccggcccaacaagcagtccccgtaacaaactgctatagttgggcttttgcgtctatggcgacataccgacagtacgtatacaaggaaaggagtcgagcaatggcagcactacgtggtccggatagttccgaggatgaacgtcgtttggggagcaggccgtctttcctgagaccgtcgatgtcaacattcgtcagcttgaccccattcccgcgccgcgtgctttcctcagggagcagccgctcaccgatgagatgagcgagctcgtgctccactcgcggcaggaaatccgcgatgtgctcaacggccgcgacgaccgactgctcgtcatcgtgggcccctgctcaatccacgacccgaaggccgcgcacgagtacgcagaaaagctggctgccgtcaagcgcgagttggaagaccgactcgtgatcgtgatgcgcgtgtacttcgagaagccgcgcaccaccatcggctggaaaggcctcatcaacgaccccgatctggacggtcgcttcaatattcgtaagggcatgtggctggcccgcaaggtgctcaccgacgtgctgagcctcggcctgcccgccgccaccgaatggcttgaccccatcaccccgcagtacatctgcgacgcgatcagctggggtgccatcggcgcgcgtaacaccgaatcccaagtccaccgcgaactggccagtggcctgtccatgccggtgggcttcaagaactccaccgacggctccatcaaggccgccgccgattcctgtttcgcggccggcttcgagcatcacttcctgtccattaacttggacggtcgcgtgatttccgccgaaaccaaaggcaacccggattgccatctggttctgcgcggctccagccacggcccgaactacgatgccgaatccgtgcgtcaagctctggaagacctcaaggtttccaaagcgtccggcccgagccagcatggcctcgtcatcgatgccgcccacggcaactgcggcaaagacgaaaaccgcgaagccgaagtcatcgaagagatcgctgagcgcctggcgcacggcgaacaaggcatcaccggcgtaatgatggaaagcttcttggtcggcggtcaccaaaagccggccccgctcgaccagttggtctacggtcagtccgtcaccgactcttgcgtgccgtgggaacgcaccaacgaactgctgcacaccctagccgacgccgtcaccgctcgccgctcggctaaatagctttgtctttgtaaaaatgctcactgagacccactcagtgagcattttttgccaataacggtggtcatgtcagtttgttcccgtgacaccttatccttgggaaggatactgacccaaggagagatgttatgcagcagcaggaggaagcagcacattcgctgcatccgttgcaagtcggtccgcagccgttgcaagtcggtccgcagccgttgaacaccccagaagagcttcgcgccattcgtcaggcgatgggggaggggaagaacccgctcgttgccactgatgtgccgcgttgggaagatcaggtgggtgtcagtcgcatcatcaaccgccgcgtattggagttggagccgctgcccacgcccgcgcaagtgctcgctgaactcccgctgactgatcaggctcaggaaatcgtcgcctactcgcgtgatgagattcgcgcgtgcctgtacggccaagacgacaggctgttggtcatcgtcggcccctgttcggttcatgacccgaaggccgcgctggactacgcgcgccgattggccaagctgaaagatgagctcggtgaacagctgctcatcgtcatgcgcgtgtacttcgagaagccgcgcactaccattggctggaagggcctgatcaacgacccggatattgatggcagccacaatattcgcaagggcctgttgcttgctcgcaaaaccttgcttggtgtgctgaaggaaggattggcggccgccacggaatttctggagcccaccagcccgcagttcatctcggacgcggtgagttggggcgccattggtgcgcgcaacacggaaagccagatccaccgccaattggccagcgggctttccatgccggtcggctttaagaatgccactgacggctcggtgaaggcagcggtcaacggttgcttcgccgctgctcagcagcacacgttcttcggcattgaccatctggggcgtgcctgcgcagtcgagacccttggcaacccggactgccatgtggtgttgcgcggctcgattcacggcccgaactacgatgccgaatccgtggccaaagccatggaagacgtacgcgccgaaatgcccgccgaatccgcagcctcgcatggtctgattgttgattgctcgcacggtaactccggcaaggacgaacatcgtcaggccgaagtcgtgcgcaatattgccagcagaattgcagctggcgaacagggtattaccggcatcatgatggaaagctttattgaaggaggcaatcagaaggccgcgccgcttgatcagctggtctatggcaagtcgattactgacaagtgcatcagctgggaagaaaccgaggccttgctgcgcgagcttgcggaagccgtagccacacggcgttggcactgagttgcgtcatcggctctctcgcgggagcaatgcaacgaaacgtctctacccctcagcctgccattcggcggccatctcccctgacaaggggagccgaaagtgttgtgaaaggaacttacgtatgggtatgaaaactgtagctattattggcgcattggatgaggaagtggcgctgatcgccaaatcgctcacgcatgtgacgcacaccgccaagggcagccttgacatcgtgtccggcacggtcgactccttcggttctgacgtcatcaaggttgccgcaacggtaggcggcatgggactggtcaatgcggccgccaccacgcagctgctgattgacgagattgccccggacgccgtgattttcagcggcatcgccggcaacctcaacacccacctgtacatcaacgacgtggtgctcggcggcaccctgcgctacctcgacactgacatgcggctcgtaggccagtggaagcccggcactgcggacgctccggtggaggaattccactctgatgaccgtctgctggaagtcgccgacgaggcgcttgccaatgcgggcattacccacatcaccggcatcatcgcctccggcaactacttcgtggacacgccccaaaaggtcgaggaggtcatccgactcaccggggctgacgccgtggagatggaaggcgccgccgtggcacaggtcgccgcccgcaataacgtgccggcactggtgattcgtgccctttccgacaacgccgacaccgattacgaggtattcaaggagttcgacatctccgaatacgccgataccgccgcccgtctggctgtcgacatcgtcaagcgcctgtaactggtcacctccaagttcggcgttgccggtgtgggctggtacatggccatcatgactgccctcgctctgctcgctctgttcctgatcaaggaaagcaaggacaaggactacgagctgtaaatagagctccccatattatgctcccgccagcgggagcattttgttatgtcgtcccgccaaaaatgaacaatagacgaacttacgtagtttaggcatctcactacgcctcgcacgttttactctggaaatcatggatatctggcagatcgtcgtgattgtggtgctcgccgcgctgatactggtgtgggttgccgtcatcgcctacaacaaaggccgcgtttcaggccggctcgccgccgaacaggacctgtccggcgacgaggatacgcattctctattcggtgatgatgcgcccgtgcgccccaccgagcgtcgcctgattgaagtcctgcccgaagccctgatcgtcaccgaccgcaacggtctggtccaatattcaagccccggctcagtgccattcggcctagtctccggcgaccgactcaactcgcgtgaagtcgaggacatcctcactcaggccgccgccgacggtggcatgcgtgagcgtgaggttcagctgccggtcaatcgcaattcctatccgtcctctaatggccgaggactggaggccggccagtcacgcccgtccaacacgctgtatttgcgtgtgcgcattggcgatatcggcgatgacctgtacgccatcttcatcaacgacatgtccgagcagcgccgtttcgaggccgtccgccgtgactttgtgaccaacgtttcgcacgaactcaagactccggccggtgccatcgcgctactggccgaaaccgtgaccgacgccgccgatgatccggacgccgtacggtatttttccggccgtatctccaaggaatccgcgcgcctgaccgaactggtgcatcatcttatcgacttgcagaaagcccaaagcccgcaaagcgtgatcgatgcgcggcgcatttccgcgctggatgtggcacgcgccgccatcgccgccaatcagacccaagccgactcccgccatgtggatatccgactgagtgtcaacggacagtcagtacccacgaaggtcgaggagccggccgatggcgaaggttccttggaagaatcaggcagcccagccacgaacggtccgatgatcaaggccgacaaagaggccatgcaaaccgccgtcaagaacctcgtagagaacgccatccattactcgcccgaacacaccactgtggcggtcggcgtgggggagcgcgatggcaaagtcaccattcgcgtggtcgatcagggcatcggcatccccgccaaatcgctggaccgcattttcgagcgattctaccgggtcgacccggcccgttcgcgcgagaccggcggttcgggactcggcttggccatcaccaagcactgcgtgcaggagaacggcggtcggatttcggtctggtcgcgtacgggggaggggtcgacgttcaccatcgagctgccggccgccccggatgaggatgacgacgaggcccggtcggacgagtcgacacaagcgtagggccttggttggtgcccgacatggtgccattccattgccacacaatcacacagtgggcgaggtgcgcacaccgcgcgtagcccaattacgcaattacgtactttcgggaaacagcaggctaacggagaacaaatggttacgataatgtcggaaaactttgcgcctatgcgcacgggaacatacccaagaaaggctactatgacacgcattcttatcgtcgaagacgaggaatcctatcgcgagccgctggtataccagctcacacgcgaggggtacgacgtgtccgccgccgccactggcgaggaaggtctggaactgttcaccaagggcggcatcgatttggtgctgcttgatttgatgctgccgggcattgacggcactgcactgtgccgccgcattcgtgagcagagccgtgtgccgattattatgctcaccgccaagagcgccgaaatcgataaggtcgttggccttgagattggtgcggacgattatgtgaccaagccgtactctttccgtgagctgctggcacgtattcgtgccgtgatgcgtcgcaatcaggccactgcccaggcttccggcactgtggatgacgatattccgctggtgtgtggcgatatcgccatgcaggttggccagcatcaggtcaccgtacgcggcgaaaccgtgttcttcccgctcaaggaattcgaactgctcgaatacctcatgcagaacaagggccgtgtgatgacgcgtcaccagctgatcgaccgcatctggggttcggattatgtgggcgacaccaagacgctcgacgtgcatgtcaagcgcgtgcgctccaagatcgaggaagatccggcgcaccccaagtatctgactaccgtgcgcggtctcggatacaagatcgatactcccgcggagtaaatggaaggcggccttcgggtcgcctttttttgttgtggattgtgggctcgctgtggactcgccgcaggcgagcccgctccaaaaactacgtagcctcaacgtagcccacaaacatccaagtgttcatcttctgtttactgatttcggttttgggcccttgaaaccaccaatacgcttgtagttgtcatgaattgaccgggcagcgctgagccgcccgcgaatagttgatagagggattaagtaataatcatgcagaagaacatcctcgttcgctccattgccgctctgtccggcattgtgatgctcgcttccgtggccgcctgcggcgataacaccgccaccacgaccgacaacagctcctcctccgattccacttccaagtccaccccgatctccggcaacttctcgggcgccggcgcctcctctcagcaggccgctgttgaagcttggatcgccggcttccagggcaccaaccctgaggccaagatcgcctacaacccgtccggttccggcgctggcgtgcagaccttcctgaccggtgccaccgcttgggccggctccgacaaggcccttgccgatgacgaagttgagcagtccaagtccgtgtgcactgaaggcaccgccttcgatgtcccggtctacatctccccgatcgccgtggtcttcaacctcaagggcgtttccgatgccggcaagcacatcaacatggacgctgccaccatcgccaagatcttcgacggcaagatcaccaagtggaacgatccggccatcgccgatcagaacaaggacctgaagctgcccgacaccgccatcaccgtggtgcaccgctccgataagtccggcaccacccagaacttcgtctcctacttcaaggacgtcacccctgacaactggacctacgacctctccgagaactggccgaacgaggttggccagggtgccaagggcacttccggcgtgatctccaccgtcaagcaggccgacggcaccatcggctacgctgacttctcccaggtcggcgacctgggcaccgtggccgtcaaggtcggcgacaagtacaacgagatttccgccgaggccggctccaaggtcattggggattccaagcaggacgacaccgttaagggtgacaaccgcatcgtcatcaagatcaaccacgccaccgaggccgagggcgcctacccgatcgtcctggtctcctacgacatcgtctgcccggcctacaaggacaccaagcagactgagttcgccaaggcttggctgacctacgtgacctccgacgagggccagaaggccgctcaggatgccgccggcaccgctccgctgccctcctccctgaagtccgagatcaccaagtccatcgaggccatcaagaccaagtgatgacgtcggcccgcaagggtcgtgtggactggacctgacaactgaacgatagactgtagtagtaagagcagtcgccgccaactttaagccgcagtcgtaaaccatacggctgcggcttaaagcgggtcaggacccgaacggtttggcaacgtcacagacgaaaaccgcaccacttgaatacttgataaccaccctatataaggagaatccgtgagttcgcaagacaaaacggctgtgcagccagttggtggcaagaccgccgacaaggtgtttcgcggtgtggcatacgcctgcggcatcctgatcctggttgtacttgccgctgtgttcctgttcctgttcttccgcgcctggccactcatcggtggcgatcaggccgccaacagccagaccgtgtccagctttaccggcggcaaggccagcagcttctggggctacgtgctcccgctgttgttcggtactgtgctcgtgtctttgctggcactgctgattgccttcttcgtgtccatcggcattgcgctgttcatttcgcattatgcacctaagaagctcgccaccgcgctgagctatgtggtcgatttgctggctgccatcccgtccgttatctacggtttgtggggcggcctgattctggtgccggccatctacccgttctggaactgggttgccaaccacctgggcttcattccactgttcgagggcccggccgccaacccgccgcgcaccgtcgccaccgtggctgtggtgctcgccgttatgattttgccgattatcacctccatgtcccgcgatatcttcatgcagaccccacgcctgcacgaagaggccgcgctggcgctcggcgccaccaagtgggagatgattcgtctggccgtgctgcccttcggcaagtccggtatcgtgtccgcctccatgctggctctcggccgcgcgcttggtgagacgatggccgtgttgatgatcctgtccccgggcctcaactactccatcaagctgctgcaggcctcgcagaaccagaccatcgccgcgaatattgccgcacagtaccctgaagccaacgatctgggcgtctccacgctgatcggaactggtctgattctgttcctgatcacgttcgtggtcaacttcatcgcccgtaagcttaccgagaaagcgactgcgtgatgactgctgctgagaacactgaaaagactccgatggacggcgcgcccgaaatcgacttcgatcgtttccgcccgacccgttccgccatccagcgccgtaatatcatggaccacttcatgtgggtcctgatcgcggtggcgtttgtgatcgcctgcatcccgctgatctccctgctgtggaccactatcgtcaacggcatcaagcgcctgaacctgaacttcctgagctacaacatgaccggtgtggtcggtggtaaccagaccccgtccggtggttacggcggtgtgctgcacgccatcatcggtactctcgaaatcaccgctggcgctatggttatctccattccgatcggtttgatgtgcgccgtgtacctggtcgaatactcgaaccgcggcaagctcgccaccacggtctccctgctcgtcgacgtgatgagcggcatcccgtccatcgtggccggcctgttcgccttctcgatgttcacgattctgctgggccccggtaccatcaacggtttcgaaggctccgtggctctctccctgctgatgttgcccaccgtggtcaagtccagcgaggaaatgctcaagatcgtgccgaacgatttgcgtgaggcttccttggctctgggcgttaccaagcagcgcacgattaccaagatcgtgctgcgcaccgctctgccgggcatcgtctccggtgccattctggccatcgcccgcgtgattggtgagaccgcaccgttgctgatgaccgccggctatatctccagcaccaacgtgaacctgttctccggccagatgaccaccctgccggtgttcgtctaccaggagtactcgaagctcagcgcgaactgcccgcccaacgccgacgccacctgcgtgaccacgattccgatggaacgtgcgtgggctgcggctctcgtgctgatcgtcatcgtgctgctgctgaacctcattggccgaatcgtggcgaaggtcttcgccgtcaagaccgagcgctaagccagtcgctaagcctaagccttaagaacacaaggaaatataaggaaacatcatgggacaacgtattgacgtcaaccacgagaacatctattacggcgactttctggccgtggaagatgtgaacatcaacatcgagccgaacaaggtcaccgccttcatcggcccgtccggctgcggcaagtccaccgtgctgcgcaccttggaccgtatgcacgagatcatccccggcgctcacgtcgagggcgaggtgctgctcgaaggcaagaacctgtacgacaaggacgtggatccggtggccgtgcgccgcgacgtcggcatggtcttccagcgcccgaacccgttcccgactatgtccatccgtgagaacgtgctggccggtgtgcgcctgaacaaccaccacctggccaagtccgacgccgacgatctggtcgagtgggctctgcgcggtgccaacctctgggaagaggtcaaggatcgtcttgacaaccctggcatcggcttgtccggtggccagcagcagcgtctgtgcatcgcccgcgccgtggccgtccacccgcaggtgctgctcatggatgagccctgctccgccttggacccgatttcgaccctggctatcgaggatctgatcaacgagctcaagagcgactacaccatcgtgatcgtgacccacaacatgcagcaggccgcccgtatcgccgactacaccgccttcttcaacctgaaggcagtgggtcagcccggtcacctcgagtacttcgcggacaccatcacgatgttcaacaacccgcaaaacgaagaagccgagcgctacatctctggaaggttcggctgatcgtttcctgcgcgcagcgtaatgatttgtgcgtaggagaaacggcaaagcccgccgcgaggcgggctttcgcatattcaacgcgagtattgccgagtattatcgttctcgcaacggagcgagctggaatactttgtcggactgggcggcgacttcccgcttcggtcgatcgacgggagaacggcgggtaaagcggtacaagacaagtccgcacgatgaatactctgtgatgaatcttctgtttacggtgcgagtgtggaagaatggtcgcagcaaggtccagcaaaggagcataggtgagtactggtctgatcgtcagcatcgtcgttgtcgttattatcgttgtcttgattggttggggcgtcagcgcctataacaacctggtgacgctgaagaaccgtgtgaagaacggttgggcgcaaatcgacgtgcagttgaagcagcgcgccgacctcatcccgaacctggtgaataccgtcaaggggtacgcatcccacgagtctgaagtcttcactcaggtgaccgccgcccgcgccggcgtagtggctgcggccagcaacccgagcacgaccactgctcagcgcgccgccgccgaaaaccagctgtcccgcgccctgttcaacctgcaagccacggctgaggcatatccgcagctgcaagccaaccagaacttcatggatctgcagaaccagctcaaggaactggagaacaagatcgcctacgcccgtcagttctacaacgacgtggtcctgaagctcaacaccgccatcgaaaccgtgccgacgaacatcatcgccggtctgttccactttgagcaggcgcaatacttcgaggccgatgacgcttcccgtcaggtgccacaggtccagttctgacccgcttcaggcccgtccggtaagccgccggccgggcctgtattgtcttaagagagggaagatatgcggatacgattcattcgcgccggaatcatcagcattgttgccacggtggtgttggcagttatcaccttggcgataatcgggacttccgcgttcggcgattcggccgacctcagctaccgcacgctggactatgacgtgaccgccaccgcgaacggtgatttgaaggtcacgcagcatatcgacgtcaagatgcgtgagcgtaccgacagtgacgacaacaccaagccgtggaagcagctgttccagcaatacacgctgaactccggcaccctgactgatatcagcgatatcagcgtgcgcaacgtcacagacggcatcgactatgcccaacagagcgagcccaagctgcccagtgacgtcttttccgacaaggaatggaacagtgactacgccaaccattggtatatcgccgatgtgagcgatggcagcgaccatccaaaggcatacacgcccggtaccgatggcctcaagcccagcgcctccgccaccgaagataacacgaccgtggagatcggctggaatattccggtcaccaccgaggccgacagtatgaagttcgacgtgagcttcaccatgcacgatgtggccaccaaatggaaagacgtggcctccttccaatgggagccgttcggcaagaagaaccaagtgcctatcggcacggtcaccggcaccgtccacttccccaacggcatcaccggcaaaacctcatgggcatggctgcacaccgagcgcacttcggaaaccaagcgcaacagcgacggcagctacacgttcacggcctacaacatccacaatggcgactacctcgatgtggtcgcggcgttcgatgccgccaaagccaagggcatcgcccgcaagggaaccggcaatcatctcaaggacctgaaacaggacgaatataagcaacagcagcgctggctcgacaagcaacgattcgctgccagagctcgtctcgtgttctggattgtcagcatcgtgctcggcatcgcgttgtgcgcgtggggtatctgggctgtgatctccagcaaccggcgtgcgcaataccgtggcagcgtcgaatactggcgcgaccagcccggcatcagtccggcttccgcagcccgtctgattcgcgtggtcgatccgtcgacgcgccaatccgatgaagaccgccagctgaccgccaccatgctgtcgctcgccgtcaagaaggccattgccgtctatccggggccgtcggacatgtatcgcggcatcgacatgagccaggccacgccggtgggcttgagccaaatgattgccgccgaccaaggcaagcagtatgcggcaggcatcaccagcaccatcgtgattctgccgctcgccattgatgaggcacccaacgcgcaacagttgggattgagcgaatcggaagatgcgctgctgaacctgctcatcgtcatttcgcagcgcgtgggcagcccggtattcgacctgaaccagatgaaggcgacctgccagaactggcaagacggctatattgagctcggcaaattcaccggtgcatgcagcatggaataccagcggctgggtgccacgcgctctgtgggctggcaatggattctccccggcgtactggccgtcgtgctgggatttggttcgctgctggccaacagctttatcggatacccggtggctggtcttatcgagctgccgatattcctggtcggcctgttctgctcgatggccggcgcggtgaccgtgctcaccgaccaaggccaggatatcgccggccggactctgggccttaagcgttatatggaagacttctccaacttcaccgaccgtggtaccgccgatttggccttgtgggattggtatatggtctacgccgccgcgtttggcatttccgatcgcgtgatgcgtgagctggccaaggcctatcctcaggtcaacgatccggcttggctggatgccaacgcctccaactcgttgttctactggaactaccgcccgtatggctggtacagccaccgccacaatgacgatgctgccgggcagatggacccgggcattagcggcccagctccggcttacggaggcacgtcgtttgccggcggattctccgacctcggctcgcagctgaactccggactcgctgacatcagctcgaccatcagcgcggcagcaccatccgctgattccggtggcgatttctccagcttcggctcgggcggcggctccggtttcggtggctcgttcgatggctcgggtggcggctcgttcggcgggcggtaaatccagcgttctgcttacgctggaatcggacacagaccgtctcattactgttgaagggaatcaccatggcattgttccgtaacctcggaccgttctccaccaccgccatcggccacggcgaaatgccgctgaccatcgaaaacaatcgtggccacgaggtcggcatcgaaaccctgcatgcctcgctggacgccggctgccgtcacatcgacaccgcttgggcctactactgctccggcggcgaagaacagaccggtgaaaagctggtgcgcgaggcccttgagacctggaaggggccgaaggacgaggtgctggtggccaccaaggtgggccacttccgcaacttcaccgacggccgccccacgtgggatgtggacggtcgcccggagaacctgattcggcgcggcaaggagagcgcactggcgctcggcgtggacaccattgacctgctgtacttccaccgccctgatccgaaggtgccgtacaacgagtccgtcgaagccatcaagcagctggtggacgagggcgtggcgcaggaggccggtatctccaacgcctccatcgagcaaatcgacattgcgcgcggtattctgggcgacaagctcgtggccgtgcaaaaccagtactcgccgattcacctggagacccaggacacgctcgactactgcgccaaggttggcttggccttcgtgtgctggagtccgctcggcggctaccgtcacccctatgatgagaccaagttcgacccgttccgcgaggtcgcggcggcccacggcgtgagctaccagcaggtcgtgctggcatgggagctcgccaagggcgaccacatgttcgtgattcccggcgcgcaccgtcccgaaaccatcctcgactccctgaaggccgaccagctcgaactcaccccgaagaactcgccaagctcggctgaactttctcagctccccttgtcaggggagctgtcttgcgtagcgagactgaggggtagtcgccggagtagtcccgggtagttccacaaggagataattgtgcgcaaaaaactcatcctcgacctcgataccggcatcgatgacgcgctcgccatcgcatatgccctaggcagtgccgacgagatcgatttgatcggtatcacggccacctacggcaatgtcgcggtgccgctggccgcgcgcaacgcgctggcggtactgcacttgttcggccgtgacgacgttccggtctatcccggagtcgaccatcccatcgccccggcaacattgccgaaaatgcgtggcaccacaccagacgagcgggcccaggcctacgcgcgctggcagaacggcggtgcggacggctggcaaacggacgcttcgtggtcaccaactcccggctcggtggcggtccaccatcccaacggcatcggcggcgcaatcatccccgactccccgcgcgctccggaagcaccaggctcggcggtcgatttcatcatcaccgccgcgcgcgaatacggcccggacctgaccatcgtgcctacgggcgcgatgaccaccatggccaccgtattccgcaacgctccggacctgaaggattccggtgtgaacgtgacgttgatgggcggtgcccttacattgcccggcaatgtaagcccggccgccgaagcgaacatctcccaagacccagaggcagcagactatctgttcaagtgtggcgcactcaccaccatgatcggcctcgacgtgacccaccagaccgcgctcactcgtgagaaagcccatgaatgggcgtctctggggacgccagccggcgacttcctcgtcaccatgaccgactactacatcgacttctacctgaagaaccagccggagattcgcggatgtggactgcacgacccgctggccgtggccgccgcgctcgacccatcgctggtcacgaccttcgggttcaacttgcaagtcgatctcgagggcccgttccgaggccgtaccatcggcgatcgttcacggcttcaggaccccgacaaacacacgcaggtcgccttgggcgtcgatgtgccggaattcctggatcgtttcatggggcgcgtcaccgcggcggcccggtgacgcggacggcggccgtccggtccgctccacgccgtggatggatatgacccatggcgtggagcgcccttttgggaaccgacagaacatagggggcgctgcatgcgcagcgccccctatgtgtcagatcatgccgcagcccggaatcaggccgccgggcggatcgagcgtgagatattgctcctccagatcgatgtcggggaccaaggcctccacgaacgggaccaacgcggtcttttcgaccacatcctcgcccttggaattctggccggttaccaccggctcggtcaaacgaatcttgagcagggattgggcgggggagtcgatcacatccaccactttgccgaccacttggccggcgggcagtcccagaccgttgccctcgactagacgggcctcaaggccaataagatccttgggataccattcgtcggcctcgagcatgtcctccgcatcgtcgacctcgccgtagagttcgacaccgtttagggcctcggcggcattgcggtcgtcgacgccctcaagcttgagaatccaacgatccttgaacgtgcgcgagccctcgacgatgtactcggtctcgccatcctggctgtagagcacggagtccggctcgaagcgccactcgggatcatcggtgtacaggcgcacggtgacttcgcccttcaggccctgtgcgcggccaatacgagcgaccctcagcaactcgagctgctgagggtcgtcgtgcatgtcttgctgtgccatgctgtgaatcgttccttatcagttatcgacggacgtccatgatgtcaacgcggaccttgtggtcagacagtgcctgaatcacggtgcgaatcgcgttggcggtgcggccgccacggccgatcacacggccgatgtcttccgggttcacgcgtacgcgaagcagttcgccgcgcgcgttctcatgagacttgacggaaacatcgtcgggaaaatcaacgatgttcttgatgaggtgttccacagcttgtgcaagcatagctagcctttcgtttccgctcaggcctcagccggagcttcttcggcggcctcttcagccggggcttcctcagcggcggcagcggcttcggcttcagccttggccttggcagcagcttcggacttggcggccttcagcttctgagcctggtcctcaacggccgcgatgcgggcctcggcgtccgggccagcctcaacggtcttcagggtgccttcggcaccttcaaggcccttgtacttctgccagtcgccggtgatgttcagcagcttgaagacgggctcggacggctgagcgccgacgccgagccagtactgagcgcgatcagacttgatctggatggtcgagggctgggtgttggggttgtaggtaccgatctcctcgatgaccttgccgtcacgcttcttgcgggaatcgacgaccaccacacggtagaaggcgtagaacttcttgccctgtcgcttcagacgaatcttggttgccaaaatggctctccttgtaatgctaggtgtgcgggttctcggtttgccatgtggggcatggccgtccggaatccacgtgtcctcgcggctcggggtgtagagggcgccacgcgcgcgcgaataactggcctattatagcgcacagggccggactgggcgtggcgcactgtggttgtggtgtggtgcgcgttccccgttgcgcaacattccggggaatgtatcgcgaaaatgccggctatcgcagtgcaagcgttgcggtcagggccagatgatcagtgccctcgacctcaaacgacttcacgccggacggtttgagcccgggagtgaacagcacgtgatccagctcgatgcgcggccacttgagccagctcgggaaggtgagattcgggccggcggcttgaatcagacttgcgtccttgaatccggacttgagcaacgcgcggaagctcggatggtcggtgctcgagttgagatcgcccataacgacgacgatattgcgattgctgacggattttgcacgggcgagttctcgcagacccagaatgccggccgaccaatccgcgcagccgcgcatcggcgatttcgggtgagccgaacaaagcgtcaccgtgcgattaccggaggttttgagggtgatggcgggaacgtcggcggcggggatggagaccacgttgggcaccgctgcgctcggctcgtagcgggaatagatcacgttgaatccgccattatcggtctctttggcgtctccgaactgatggtaggggagaagttcgttgatgtcggcttcggtaagacgtgtgatgaggtcgtcggtgacttcctgcaaggccaatacgctgatattgcgttcgcgaatattgcgaatgatttcagcggcgtcggcgcgtccgtatcgacaattcatcgtcataaccgagaactggggcgagagtgtttcacgcgttgtttcacagtgtccatcggagatggtttcgggcccttccttcggagtgtttgaggtacccgatgtattgctgttatggctttttgacagcgtcggcgaagttgtttcacgggctgtttcacggtgggattctttgcgtttcccggccgggtcgattgacgtaccccagtagttgatgcgctgtgagctggcaatcagcgcgaccacaataagcaacgacatcgcagtccattcatgttgccatgcggcgaccgcggccagaatcatcaaaggaacccacaacagcggcgtcagagcaatcatgtacggaagcggcatacgggcctcgagaccggcgggcagcgcgcttaaggtcgtccataacagtgcgatgattgccaccgcgctgaggattgtcgtcatggaagttcctttcgaaatataaattgaaccgagatataatttggctcccctctgcgaggggagccaagttgtgagatcagcgaccgaacagtccgccaaggcctccgccgaggttcggcggcagttcagtgccaccgtcgacgttgcccatcatctgctcaaggccagcgggcagggccgggttctgtggcttcttggcgaaggcggaaccgccggtcgaaccggaggacttgccggccagcttatcgcgcaatgccttctcctcggcctcgcgcttcatcggattgccggacttgccgcccttcttcttgttcttgcccttcttcttgccgccgcccatagccgggccgccgaagccggggatgccgccgcccatgccgccacgattggacatgcgcttcatcatctttgcggcctgctcgaaacgctgcagcaaagcgttcacctgagaaaccgtcacgccggaaccataggcgatacgggcgcggcgggaaccattgataatcgacggatcgcggcgctcggccggggtcatcgagcgaataatcgcctcggtgcggtcgatttccctctcatcgaactgctcgagttccttgcggtgctgggccatgcccggaatcatgccgagcagcgacttcattgagcccagcttgcgcacctgctgcagctgatcgaggaagtcgtccaggccgaaggaaccttcggagattttctcggcggccttgcgggcctcttcctcatcgaactgcttctgcgcctgctcgatgagcgtcatgatgtcgcccatgtcgaggatacgcgaggccatgcggtccgggtggaagacctcgaagtccttcaggccctcaccgttggaggcgaacaggatcggcttgccggtcacggacgccacggacagcgcggcaccaccgcgggcgtcgccatcgagcttggagagcaccacgccggtgaagtccacgccttcgtcaaaggccttggcggtcttgacggcgtcctggccgatcatcgcgtcgatgacgaacaggatttcgttgggacgcacggcatcgcgaatgtcgcgagcctgcttcatcagctcctcgtccacgcccagacgaccggcggtatcgatgatcaccgtgtcgtagagcttctgcttggcgagttcgatggaatcgcgggccaccttcaccgggtcgccggaggtctggcccggagctgcgacggcctcgccgccatcggattggacgcccttttcgggagcatagacgggcacgccggcgcgttcgccgaccacctgcagctgcgtcaccgcgttcggacgctgcaaatcggccgccaccagcagcggcgtgtggccggaatccttgagccagtagccgagcttgccggccagcgtggttttaccggcaccctgaaggccggcgagcatgatgatcgtcggcgggttcttcgcgaagttcagcggacggtcgacgccttggccgagcacgtcggtgagctcctcgttgacgattttcaccacctgctgggcggggttgagtgcgtcggacacctcggtgcccagtgcacgctcacgcaccttgccggtgaaggaacgcaccacgtcgagcgccacgtcggcgtcgagcagcgcgcggcggatttcacggatcgtgccgtcgatatccgcctcggaaagcttgcccttgctcttcagatgcttgaacgcattcgagagtctgtctgtcaaagatgaaaaagctgccataatgggcaacagtctagccgccacgcgggaaattgcggtgttggggacgacgcttttcggggaatgtgccgcgtagtagtcagggatgttgggcattcagacggcaaatgccgtgccgtccgctcgtggcgaagccaatcgagtgcttccgataccatggaaaccgtaaagaatcctgtgttttttggaatacttacgctgttttgaaaatcgctggacaccgcttatacgcagactgccgtgcgctccgaaccatgacgttcgggccaacgcagacatgccgtgcaataaggaaggcccactgatgcccacccaaaaactactcgaacgcaaagccctgatcgttggtatcgtcatcaacgtgctgcaggtcttagccggcatggccgtgttcttcatgaccggtctcaaggccatgttcctcgacttctccttcaccgcgatttccgtcctgtccggaatggtggcggtgtacctctcgtcgcgcacggtgcgaaccaccgagcgcttccccaatggcatgttcgcactggaacctatctacgcgatctgcaaggccattttcaccatgtcgttgttggtgtattcgctgattgacgtgtgccgagtagcgtacgactacttcgtgttcgggtccggcgaacgcattgaaaccggcccggtggtcatctacgagatcctgaccgtaatcgtgtgcttcagcctatacacgtattaccggcgctccaaccgatccatcggcgattccagcaccatgctcaccgccgagtgcaagagcacgttggtcgacggatcgatgtcgttcggcatcggcgtagttgccatcttcctgatgctgctaccggccggcggtccgcttgacttcctgcactacaccggcgatttcttcatcaccgtggctttggtggcattgaccatcaaggagccgttcagcgtgctcaaagaggcgttcgtggaattggtcggcggcgtgcatgacgacgatgaaaccaacgcctacgtggaggccgaggcacagcgccatctgcctgccaacaccgactacgagcagacgctgatcttcaagaccggtatgaactacaccgttgacgtgtatctgagcggcatcggcgaaaccattgatgtagctgacctcatcgaatgcaagcgctcgctggaaaaggagctcagcaagcgcctgcacatcgtggacgtggacttcgtgtttgactgattgatgggtttgaagcgactacttcagactccaagtggaaccctgcgggccgtcttcgatggcgatgccggcctcggtcagggcgtcgcgaatctgatcggccttggcgaaatccttggccttgcgagcttcggcacgggcgttgagctgttcggcgatcagtgcctccagcgctgcatgctcgggcgactcggccgtgccatcagcggcaccgccggcagcgccggcggacacccacggttcggccagcgggtccaggcccaaggtgtcgagcatggcacgcacggcgagcagcgcctcacgcacctcggccttggcggtttcggaatcggcgcggtcagccagctgtgaaagcaacgtattgccggaacggatggcggtgaagatcgcggcggttgcaccagacacattgacatcgtcattcatggcggccacgaaatcggcgggcaaatcgtcggcggagacggcagtgacttcctcgcgagaaggctgtccacccagcgccacaccggcacgctcgatgaagttcgagacgcggtcgtatgcggcctgcgcctcgaccagcgcctgatcggaccattcgagcatcgaccggtactgcacggagcccagggcgtaacgcaccacccaagcggaatgctcagccaacacgctcggcacggacaggccggtgcccagcgacttcgacatcttctcgcccttggcggtcacccatgccgaatgcatccagcgcgcagcggaggggtagccggccgcacgggtctgagccatttcgttttcgtggtgggggaagcgcagatccaagccgccgccgtgaatgtcgaagccatcgcccaggtaacggtgggacatggcggagcattcgatgtgccagccagggcggcccacgccaaacggcgtcgaccaacgggcgtcctcgggatcggtgtccttcggagccttccacagggcgaaatcacgcggatcatgcttgtcgggggaggcatcggccgggtcgaccggattgtacttgtcggcaccggtggcgtccacggacgggcccatgcggtcggccacggcggcggcctcatcgacttcggaggtctgcttctggtgagtgagttcgccgtaatgcggccaggatgccacatcgaagtacacgttgccggtgggcttgccgtccgcatccgtgaccacatagccgtgaccgttgtcgagaatgcgctgaatcaggtcgatcatgtccgacatgtggccggtggcgcgaggttccacagtgggcggcagtacgccgagcgtgttgtatgcctcggtgaattcgcgctcgtagtaataggcgcgggcccaccaacgctggcctgcggccgcggccttaacgagaatcttgtcgtcgatatcggtcacattacgcacaaaagtgactttgtagccgagcttcaaaaaccagcggcgcacgatgtcgaacgccacggcggcacggatatggccaatatgcggtgacgattgcacagtcgcgccacacacataaatgccgacttcgcccggcttgagcggcacgaaatggctgacctggtgcgaggcggtgtcatacagattcaggccttctgcggccttggcaacatgcaccggcgtcaggcttgaaggcatgacggaaatgttgaaatcctgcggttcttggctgtttcccataacactcaagcgtagggtccgaaccagacatgctgaatcgttactcgaagagtttgatgaacgcttcacaggtggggcccgaacgaggtgacagacggatgagaagcgggacaacagtctcgcgagaacacgtctttgaccgctgcggaaactgcgagattcatggatttgccctgctcgttacgcaaacggggaacgctcgtgccacaatagaagtcatggccacaccacaagtgctcattttgcaacatgtcccatgggaacgcccgggacgcatattgtcgaacctcgaggacatcggtcttgagacggtgacgatgaatatcgtcgacaaaaagaaaccggacttgcctgatttcggcgaactggctggcgtggtaatcatgggtgggcctatgggcgcgcttgattacgacaagtatccggggctgaaggcagaagccaagttggcgcgtgccgccgtggcttcaggcaagccgattctcggtgtatgcctggggcatcagattatcgccactgcgcttggtgcgcagctgcgcaagggcgatgcgccggagattgggttcgcgccgatcaagcgtgtggacaagcatgacttcttctccatgtgggataagcagctgacagtgctgcactggcataacgacgtggtgggcctgcccgcggaaggccagctgctgtcgcgttcgtcttccaccaaggtgcaggcattccgactgggatccgcgctgggcatgcagttccacctggaagtgtgcggctcgctgctggacgaatggctggatgagccgagcatggtcaaggatctcaaggccgcgggtggttccaagtcccaattgcgcgagcagttcgcccaatacgaccagctactgcaaccgctcgccgagcaagtgttctccggttttgcggcccgctgcaactcctacgctcagacgctgaacaaataacgtttgcgggccgccgctgggcaagcgtggcgctacattggtgagtcatgccgacttatgacattggactggaacacgtttcgctcgctttcgctaccaaaaccatcttcactgatgtaacgcagggtgtttttgaaggcgaccgcatcggcatcgtcggcaagaacggcgacggcaaatccacgttgctgcacctgttccgcggtgctcaggagccggattccggccgcgtgacaaagcgtggcggactcacgttcggcatgcttgaccagcgtgatccccttgatgacaacgccaccattcgcgaagccgcacttgaggggcgcgccgactacgaatgggcgtccgataacacttcccgtgaaatcgtcgaggcattgctcggcggcatgagcctggatgccaaggtcggctccttgtccggcggccagcgtcgccgcgccgatttggcccgactgctgctcaaggattgggatattcttgcacttgacgagcccaccaaccatctcgacgtggtcactatccactggcttgccgaacatttgaagaaccgctggtccaaaggccagggcgctctgttgctcgtgacccacgatcgctggttcttggacgaggtctgcgaatcgatgtgggaagtccacgatggcgtgatcgagccgttcgagggcggctattccgcatatatgctgcagcgcgtggaacgcgatcgccaagccgatgtgcgcgaaaccaagcgccgcaatctggctcgcaaggagctcgcatggctttcccgcggtgctcgtgcccgctccaccaagcagaagttccacgtcaaggccgcacgcgaattgattgccgatgtgccgccgatgcgtaacacacttgaactgaagcaaatggccacctcccgtctcggcaaacaggtggtcgatttggtcgacgtgacgcagattttcgaaaaaccgcagggcatggccgatatcgacccggatgtggcggcgctctccgcgtccgcttcccgcgtggatgtggtcaacgccatgtacgccgagccgcagctgcatggttccgttgaggtggcggtcaccgacatgactgacccgcgcctggtggacgccggcgtgccggaagccgtcgagtccgctgaggaagcgcgtaagaaggccgaggctgagagcggcaatccgcagcttgctgacgatcgcgaggttcgtcgcatgaacacgggtggtgaaaccatcggcggtggcactgctgcaacggattcggatgatgacactgctgcagccggtgtcacctcggctgcacgcaaggtgacggtttccggccgcgagattcttgacgatgtgacttggctgattggcccgggtgaccgcttcggcatcgtcggtgcgaatggtgccggcaagtccacgctgcttaagttgattgatggcacactcaccccgaccgcaggccatgtgaacattggcaagacggtgaagttcgcggtgctctcgcagcgcctcgatgagctggagaagctcggcaagtacaagatcaaggaagtgctttcccgctataagccgagctacattgtggatggcaaggaagtgacgccgggacagttgatggagcgtctcggcttcgaatccgcccagctgatgacgccgatccgcgatctctccggtggtcagaagcgccgcatgcaactgctgctgattctgcttgacgagccgaacgtgctcatcatggacgagcccggcaacgatctggacaccgatatgctcgccgtgatggaagacctgctcgatacttggccgggcacgttgattgtggtctcccacgaccggtacctgctggagcgcgtcaccgatcagcagttcgcgctgattggcggcaaagtacgtcacttgcccggcggcgtgcaggactacctcgatatggttgaggctattaagaacggcaagggattgccggctgacacgcctggcttcgcgggcaccggtagcagctcggcgaagtctggtaagggtaaggcggccgccgtcaacgctgccgcatctctccctcagtccgcttcgcggatagctccctcgtcagagggagccaataacggtgaggactccacctcgaagctcaccggcaaggccttccacgaggcatccaagcgcgtgaatgccatcgaacgtaagctcgctaagcttgaagagcagaaggccgatctcgaggcgcagatggccgcccatgacccgagcgactacgagggtctcaacaagctcaatgaacaactcaccgccgtcaatactgaaagcgatgatctcgaagccgaatggctcgaactctccgaacaattggagtagcgggagaaaccgtaacgttcacaaggcctcggcagtttgccggggcctcccgctatgcaaactcccacggattaatcaattccacgtcggtaccttcgaagtccttgatattgcgcgtggctatggccgcatcccaggaacaggcaattgccgcaatcatggcgtcttgaatactggtaggtgtgcccctgtgttcgcgttcgacaaggatatgggcataatccgcagctgcctgagtgtcaaatgcgaacgttctgtcctctaatgtcataagcgccagcttgacggtcgtatctgtgtactttcgtcgtttgccttcaggcatgcgacatattccggccaacaactcggcgacggtgatggcggtggttgccaaattgcttgtatcttggttcctcagccaattggcaacgtgttcgtctggctgtttcttgatgatttcgctgatgacgttggtgtccagaataatcatggccgattcctattcaaaagatactggcggtcgggaatcggcggaatttcgctcggatagtgggagttcccccttgtcgagtccctcaaaatccatgttcttcatgaattcgcggatctcgtcatagaaattggtctttcgcgtgatttcatgcgccaccgtgccagccagccattcttcaagaatggatcgcacctgagattccatggagcggttgtttttctcagccacttctttgagctgctgaatctgctcatcgggtatttttcggatggtcaatgttgccatgatgcacctccttgttgctgtcataatgctagcatgaggtgctgtcgttttgcttgcagtacgggtgatgaggtatgcacgcatgaaaaaaggcggatatgcatcatgcgcatccgccttttgagcttggactgggtcttcccgcagtcgccgaatcagcgcccggtaacctcggaaccgacgaccttttcgctcagggcgcgcgggccgcgggtcacggctacggcaccggagcgcaccagctcaatcacaccgtaatgctccaaaagccccagcagggcgtcgatcttgccttcggcaccggtggcctcaatggtcagcgattccggattcacgtccaccacgcgcacgcggaacagacgcacgatctccagcacgtcggaacggttggattcgttggcggccaccttgatgagcaccagttcgcgttccacggtggagttcgggtcgagttccacgattttgagcacatgcagcagcttgttgagctgcttgatgatctgctccagcggcacggcctccacgtcggcggtcaccgtgacgcgagagatgtccggacgctcggtgggggagacggacagcgagttgatgttgaacgcacggcgggcgaacaggccggcgatacgcgccagcacgcctgggcggttctccaccagcacggacagcgtatgacgctgggaaccaggctgggatgcaggatagttagccatgagtgttctcctctcctcagtgctcgctcgcagtggcagcggcggtctcgtgctcgaacacgccggtcgcatgctcgtccggaccggttcccggagccggggtgccgccagccagcggcttgatgccgggcttgtacgtcacctcgtcgttgggggcgccggcggctaccatcggccacaccatcgcatccttccacacgcggaagtcgatcagcaccgggcggtcgttgatctggttcgccttttcgatggcggcaatcgcctcttcctcggtgaacgcgcggatacccacgcagccgtatgcctcggccaacttgatgaaatcaggcacttcgagcggcgcatcgccgtcggccagtgccgccgcaccatcggcaccgtgcgcttcaccatcgagcaggttggtctgcgagtagtggtgctcgtagaacagcgtctgccactgacggaccatgccgtatacggagttgttcagaatcgcgatcttcaccggagcgcggtccaggaacgcggcggccagctcctcagaggtcatctggaaggaaccgtcaccatcgatcagccacaccggcttcttgccctcgaattcacgggccgagcccacggatgcgccgatggcagccggcagaccgtagcccatcgtgccgaggcctccggaggagatccaagcgtgctggttctcaaaatcgatgaactgcgaggcccacatctggtgctggcccacaccggtcacccagatggtggacggatcggccatctcagagagcttcttgatgacccactgcggggccagcgatccgtcggtcggctcatcccacgtcatcgggtattcctcgcgccagccgtcgatcgccttccaccagggggccagattcggcttgccctgaatggcctgcgcacgctgaatctcgggaatcaagtcgtcgagcacggtagccacatcgcccacgatcggcacgtcgggctgacggttcttgccgatttcagccgggtcgatgtcaatgtgaatcacgcgggcggtcggtgcgaaggcgtcgagcttgccggtcacgcggtcgtcgaaacgtgcaccgatggccacaagcaggtcagcgcgctgcacggcgccggttgcggcaatcgtaccgtgcatgcctagcatgccgaggttcttcgggtcggagtcgggaatgatgccgcgtgcgggcagggtcgtgaccacgggagcgccggtcaggtcggccagagccttgacctgtgcgccggcgttggagcgggcggcgccgccacccacatacagcaccgggcggtacgactgagagaacagcttcgccgcgtcggacagcacacggccgtgcgccttggtggtggggttgtagccgggcagaatcatgcgctgcggccatgagtagtacatgtcgccggtctgtgcggtcttggtcagatccacgaccaccgggccggggcggccggtgttggcgatgtagtacgcctcggaaagcacgcgaggaatgtcctgcgcgcgggtcacgaggaaggagtgcttggacaccgggtaggtgatgcccacgatatccgcctcctggaaggcatcagtgccgatggcttgcacgcccacctgaccggtaatcacgaccatgggcacggagtccatgttcgcgtccgcaatggccgtgaccacgtttgtggcacccgggccggaagtcacgatgcacacgcccaccttgccagtggccagtgcgtagccttcggcggcgtggccggcggcctgctcgtggcgcataagcacgaagcggaacttcgtgttgtctttgatctcgtggtagacgggcagaatcgcgccgccaggaatgccgaagacgtcctcgacgccgaggtcctccagcgaacgaatcagcgcctgggcgccagtcatcttctcgccatcgacgatggtctgcttatcgggggccgtgttgattttcggtacaccgctgaatgcctgcaaaggcgtgggtaaagccatgattcctctcacctcataggttttgtcgcgaacctgcccgaccttgggatggggccgggtgcccgcgtgtctgattccagtcgcttccccgagacttgtggccccggcgcgactcgtcgctcatgttggtattagtctattcgcaaatccgacagcgggcttacttagtccgcgtcttgaacgagtccagtgacttccagcccgcttcggctgccgccagctgcgccttacgcttgctggagcccttaccgatgccgatgatgtcgccgttctcgcccaatgagacgcgcgcggtgaagatctgcgcgtattccgggccggagacctccatatggtagacaggctcctccttgccgaggccgtgcgccttgacggtcagcgaggtcttccagtcaagtgccgggccctcggtggccacttcggcgagcgtgtcgtcaataagccggtgaatcaccttgcgtgcctcgtcgatgccgtgttccaggaaggtcgcgccgatgagcgattccacgatgtcgcataggatggagttcttctccgcgccgccctgctcggcttctccgtgacccagcagaatgtaggggcccaccttgagcttggttttggcgatggcgctcagcgcgtcttcggagacggccttggcgcgcatcttggccagttgcccctcggtcatatccgggtgaatggtgaacagcgtttcagtggagaccagttcgagcaccgcgtctcccaggaattcgaggcgttcgtaattggccacgccggggtgctcatgcgagaaggaacggtgggtgagtgcctgcacgagcagatccgggctgagagtggtgcccaacgcttcaagaagctcgttggccggcgtcggctgctgtggggtttcattactcatgattgttgtatggtccttcacgcgatggtgatgtgttgtgttgtgttgtgttgtttgcgatgcgatggtgtacgcaatggtgcacttatgcgaagaccccgccacccgtcgatggcagggccttcattcaagccgttatcgcaggactcacttggtgtgagccggctggatggcggagcggtaggtgcggccgcggtagttaccgcagctcgggcaagccatgtgcggcagggccggagcgccacagttcgggcagttcacggtcgcagcagcggtggccttccagttcgcgcgacgcgaatgcgtgttggcgcgcgaggtcttgtacttaggcagtgccatttgagtatcctctatttcgttcgaacaattgagcttaagcgtccgttatcttaacgcacggctcgtacaaacttcgttcaggcgcgcgtcactcggcctgctcgccgttctgctcggcctcgagctgggctttgagccccgccaatccggcaaaacggatatccgtcacatcgtgatgatggtcgggatcctcgttcagatcggcaccgcactgcgagcacagacccctgcaatccggtcggcacagtggttgcaacggcagcgattcgaccagcgtgtcgcggatcatcgcctcgatgtccgcgaatgcgccgttctccagcagcggatacgtgtcttccgactcgtcctcgccggcgatgatgtcgatttcgtcgtccttcttgctcttgccgcccttgccgttggccttgtcctggcccgactcgtacgggaagaacaccgtcacatcaaccggccagtcctcgtcaatcggcttcaggcagcgcgtgcactcgctgacgaatggcgcgaccaggcggccggtgaagatcaggccgtccacaatcgaatcgaactgcccgctcacgtgtacgggctcaccttccttgatgccgacaatgctgtcgccaatgccggaaggtgccgggaaatcggcgtcaatcggcttggattgaccggcgcgcgaagcaatctgcgctaccggaatggcccacggggaatcttcaactcgtgccatggtatgttcttggtgcctttcgtatgttggctggagttattcgttactggcgttattcgcgttactgatgttgccggcgttgctggcgttactgggcttcgggatagtcgttcagcgtcaggtgcggcatctgttcgcgggccgcgcgctggcgctcttccagcacgttaagaccggcctgcacatcctgactgagtttgccgagctgctgggacagcccttccatcaccgtagtgcagtactggtccgcgccttgggtcagatggtcggctttggtctgtgcctggtcaagaatcgcgcgcgctttctgccgtgcaagctcggtgacgttctcttggccggccaggaactgtgcctgttcgttggcgtccctgatcatgttggctgcgcggctttgtgcggaggcgacgatggcgttggactgggtctgtgccgattccagacggcgctcggcctcgcgcatgagggcggaggcgcgctccaactgcaccggcagcattttcttcaactcggaaagctggtcggtgaattcgtcgcggtcaaccttcaccatgccgggggcgaatatgctggacttcgcttcgcccagtgccgcctcgagctggtcgatgatgtcatacaccgtggtgaattcctcgtggctcttgaccgtggccgggtcgtcgtccgtggtttctcgcaggtcgggcatttcgttcatgaacgaggggcgaatgccggcggcctgagcggtctgagcctgtgcccgggtctgctgagctgcttgggcctgcgctttggcctgcatttgtgccggagtaggggtaggcgcggcgggcggcgatccggcgagaacatcggcctcttcggtgggtgccggcgcggcttgcgtagacgcgggcggttccggggcggacggctccggagtggacgatgcggcgtccgcattcggtttggtcagatcgacgtatccagtagggtggtcatcgctcatagtcattagtgcatcagtccttccgctgacgttcctcggccagggcatcggccagcatcggcacgacgcaatcgggcaccatgccggtcacgtcgcctccatggcgggccacgtccttgacgatggaactggagatgtgttcaagaatcggatcggccggcaaaaacagggtttcgatgccagcgagcttgcgattgaccagcgccatgccgagctcggcttcatagtcgccgttctggcgcagacccttgatgataacggtggcgccgaccttcttgcagtagtcggtgatcaggccgtcggtggaagaaacggtgacgttcttgcaaccggctttgtcaagggcgcggcggatcacgtcgactctggtggcttcggaaaacatcggtgttttcgcggcgttgacggccaccaccacatgcacctcgtcgaaaaaccgcgccgagcgctcgattacatccaagtgtccggcggtaacggggtcatacgagccggggcatactgcgatagtcatgctttatagcctaccgctagtggtgtgcttcgtgctgccgagcgtgcattgttgtcgcgtcggcgtatgaggcagtgtgtgcggtgccgtatgtggcgtcggtgtggcgtcgtgtgcggcattgtatgtggcattgtatgtggcggggtggcgtgatgcgcgacatgggtgtgtggaggtgtgcggattacgcgccaatgggtttcgcgggtaacgacgggaatctatgatggagtgcagtcgaatcgttgaatacgaggaaagaagtgcaccatgacttttgccgagatgttcgttgatgatgccgaaccgctgcgcaacccggaccaaggtgccggcacgtcggtgctggagcgtccggagaccaaggagtcgccggttcgtgacgatggtggcgacgccgatcgttttgcgcactacgtatccaaggaccgtatcgctgaatcgcgtgcgaccggccgcccggtggtggccctgtgcggtaaggtttgggtgcccaagcacgatccgtccaagtacccggtttgccccgactgcaagcggatttacgaggaaatgacgcgctaaaggtggtacttggctcccctcagcgaggggagccaaaatggtcaccgagccgaaatctcgtcgatcagcttgagctcctcgtcgctgaagtgggtgttcttcagtgcgccgatgttgtcgagaatctgctgcggcttggaggctccggtcagcacggaggtcaccttgccgtcgtgcagcagccatgccaggctcatctcggccagcgtctggccgcgttcggcggccagattgttcaggtccacaacctgcttgtgcagtttctcggtcagggcggaatcgttgaggaatcgcggatcgtgagccatgcggctgtcggccggaatgccgttgagatagcggttggtcagcaggccctgagccagcgggcagaaggtgataaggcctttgcccagcttgaaggcggtctctttcaggccgttcttttcaacggtgcggtcgaggatgttgtacttgttctggttgatgatgaacggcacgtgcagttctgccagaattgcggcggccttttccatcgtcggaccatcgtagttggacagacccacgtacagggccttgccggagttcacggcctgagccagcgcgcccatcgtctcctcaagcggggtttccggatccgggtggtggtggtagaagatgtccacataatccaagcccaagcgttccagcgactggtcgaggctggcgagcaggtacttgcggctgccgaggtcgccataggggcctgtccacatttcgtagccggccttggtggagatgacgagttcgtcgcggtgatgcttgaagtacttggcgagcagcagtccgcagttcttctctgcctggccgggctcggggccgtagttgttggctaggtcgaagtgggtgatgccgttgtcgaaggcggtgaagaccagggacttcatctggtcgaatggcgtgatgtcgccgaagttgtgccagaagccaagtgagacggccggcaacttgaggccggaggtgccggcacggttgtaggtcatcgtgtcgtaacggtgcgggttgggggcatagatggcggttggctcgaacattgagtctccttacaatgtcattcttgttcttacgaatgcttacctgcgatgggcaaaccgacgccgattgagcggtattcgtaagtgttcttggatactatggttccagttcaagtgaacttgaatgcaaacggctgcgacgcttcggcgtgttgccgcagtaaggagtcatgatgtcctacaccattcgtcaggtggccacgcagttccatatgcagccctctacgctgcgctattacgaggatcagggattgctgaccaacgtggagcgcaccgaaaccggccagcgcatatacgaagactgccatatcgaccgtctgcgcgcgatttgctgcttcaagaacgccggcatgaccattgacgatcttaaaaagttcttcgtgtatgagtccaatgagcccgagcatatcgatgaaatccttgatctgctggaatctcgccgcgaatccttggacgagcagcgccgagccctcaacgaggcggccatgcacgtgcagcgcaagctccattactatggcgacatcaagcgtgccatcgacgccggtgaagactggccggattggcgcgagtacaaaaaccgcgcctattccattgaatgttgagaccatcgaatgttgagaccatcgaatgttgaggccatcgagtgctgagctggatgccggctgggcactaagaccaatgcgcgtcgatcgtgggcgcgtctatccgagtaaggccttgctcggcagtgcgcggtcgagcagccagacaacgagcgatatcacgaagaacgctatggccagcttgccgcagctaatgccgaacccttgccagtcgagtgcgtcgaggttgatgaagtcgtacggatacggactgccgccggccgccggtccggaccccggccaaatcgccgcacgggccagcacgaagaccaagtatgcagggaagtacgccagccacgagaacatgtaatgccagcggaaacgccggtgcgggtcgaatagcacgaaatcgataaccgccataatcggggcgattttgtgcagcatcgtattggtcatgatgccaataacctgtggcacgtatgccgggtcgtccggaggcgtcaggaagaacgccaccagtgcggtgactatggcgtacacagtcaggcaccccttaagccatgcaggcggctgaatacctttgagcagtgtggccgcgccggaccacagcatcacgatgcccagcacgaaaccggtctggaacgtgaaatacacccagaactgcggtttggaccatgcctcatatgtgcccacgaagcagaaaccggcgatcgcaaagcgccacaacgccacgatgaatctcatgcatcgagtctaccgcttcgccagtgggccgtatggtgcggctggcgtattggctggtcgtgatgattatggtcggtgtgaccgaccgccatagtgccgatgaatatgacgatactgaacccggcaatatcgaatctggcgatacgagaataagacgagcccttcccgcacggctttgcccggactacacttaggtgcaacttcaccacttatgtaggaaaggccttgcaatggtcgattattcgccggctctgatgaccgacatgtatgaatacacgatgctcgacgccgctctgaaagacggtaccgccgaccgcaagtgcgtgttcgaggtgttcacgcgtcacttgcccgaaggccgtcgctatggcgtggtggccggcaccggccgcattctggatgcgctggaacatttccacttggatgaagcggatctgaagttcctggccgaccgtcacgtggtaagccccgagaccattaagtggctggagaacttccacttttccggtacgattcgcggttaccgcgaaggtgagatgttcttcccgaactccccgattttgcaggtcgaaggcacgttcggcgaatgcacgctactggagacgttgattctatccgtgctgaactacgattccgcagtggcctccgccgcctcacgtatggcgtcggcagccaaggatcgtccttgcatggatatgggcggacgccgcactaacgagtgggccgccgtggccgccgctcgagctgccgtagtgggcggattcaagggtaccgccaatctgctggccgcccagctgtatggtctgaaggccattggcaccgccgcgcattgcttcacgttggtgcatgattccgagcgtgacgcctttgaatcacagatcgaggcattgggcaagaacaccacgctgctggtggacacctacaacatcgaggaagccgtgaaaaccgccgtcgaagtggccggtcccgaactgggtggcgtgcgcatcgactccggcgacttggccgccatggcccagcgtgtgcgcaaccagctggacgccctgggtgccacgaacaccaccattaccgtgaccaacgatttggatgagtacgcgctcgccgcattgcagaccgcgccggtcgactcctatggcgtgggcaccatgctggtcaccggctccggcgctcccacttgtgcgatggtgtacaagctcaccgagcgtgaaggcgctgacggcacgatggttccggtcatgaagaagtccaaggataaggccacagtgcccggtcgcaagttggcattccgctcctacgaatacgcgctagccgaagccgaacacgtgatttccggctcggaagagaagctggccggtttcacgcccgaaccgacgtggaagaacctgctggtcgatttcgtggaccacggccatatcgatgcgcagtggcagggccatgacgccatcatggccgcccacgactaccacgccaaggcgttgtccgaactgcccatcaccgcgcagagcctcatgaagggcgagccagtgattcctacggagactcaggttctctgacgagaactttcgtctccataggaatccgtcgcagcatagctgctccccttacctacggacagcccactgggctgtccgcttaacggttcgaccacagagaccaaagtcctctgaccgtatctcactggccgcatccctctggttacattggctactcttccctctggatgagtgaaactctcaatggtgataacgcggcgggcaacgatgacgtatcagagcggcgcgatgtagttcgatgatggttgacgagttgctatccaggcatagagcggatggcgtatgctggggcgcatggttgaaatcaaagacatgcttggcaatcaccaaataattcgtgccgacggccgcaaggtcgacgaactgcgccctgtgcgcatcacccgccacttcaccgacgcccccgaaggctccgtgctcatcgaatgcggtaacacgcgcgtgatgtgcaccgccacttttactcccggtgtgccgcgttggcgcaaggactccggcctcggctgggtcaccgccgaatactcgatgctgccgcgtgccaccgccgaacgcaccgaccgtgaatccgtacgtggcaaaatcggtggccgtacccacgaaatcagccgactgattggccgctgcctgcgtggcgtcatcgatatgaaggcgctcggcgagaatcagattcagcttgactgcgatgtgcttcaggccgatggtggtactcgcacggcttccgtaaccggtgcgtacgtggctttggtcgacgcagtcaattgggcggagaagcaccgccatatcaagtccgccagccgcgtgcttaaggactatgtgtccgccgtatcggtgggcgtgatcaacggcactccgatgcttgacctgccatacattgaagacagtcaggccatgaccgacatgaacgtggccatgaccggttccggcaccttcatcgagattcagggcaccgcagaacaccgtccgttcaaccgtgccgaactcggcaccctgcttgacttggccgaaaagggcaacaaggaactgcaagccgcccagcgtgccgctctgtccctagactaagccagctcccctgacaaggggagccttcttaaaggagaacctcatgcaaatcgtcgtcgcaacccataacgaaggcaagcttgtggaaatccgccgcattctcgaagaggatcttggcgcggatgccgaaaacatcgaactggtgtccgctggcagccttcacctgccggatccggtggaaactggcgtcaccttccaggagaacgcgctactcaaggcccgcgctgtggccatccgtaccggtctgcccgctgtcgcggatgattcaggtctcatcgtcgatgtgatgggtaacgctccgggcattctgtctgctcgctgggcgggtgctcacggccacgacaaggccaataatgcgctgctgctcgcccaaatcgaagatattccggatgacaagcgtaccgcgcgcttccgttgcgccgccgcgctggtggtcccggacaccgagaccggtgccgacgtgaccggtggagtggctgccgacggcatcaccgttcacaccacggctgccgatgggagccctgccccggtgcatgctcgatacgccatcaagtcggagacagtggagctcggcgacatgccgggtcgcatcatccgcgaggctcgtggcgtacacggtttcggttacgatccgctgtttgtcccggacgatcagcctgccggtcgcgtcagcactgagcctgaccatgaaggcgagccgctgaccagcgccgagatgactccggccgagaagaatgcgatttcccaccgaggcaaggcgctgaaagccttggtccccgccatcgaggccctgctgcactaagtcgtctaggctgtctagctgcactgagccgcgactaagccacagttgagtcgcggctcagcactcagcccccgaatcgggcgagtgtctagcaagcgcctatgacctagcaagggcgatacgaaagaaggccggcgcttagtgcgtcggccttcttgatgaacaagagccacccgatagaatcgaactaccgaccttcccacgaacgagggggatgctctaccactgagctaaggtggcgtggcttcaagagccaagtagagaatatagcactgcgtttgattcactgcaagccggacattcatcatctttgggccattgttctttggaccatcgtggcggcaatagtgcgaacgatgtgcacacctcatctgctcggccgccattcgtcgtgtgcgcgctatgctagcatggtgagcctgattgactcggaggcaaagggaagcatgcgtgattttgtgctggtgaagttgacagacgaggagttcgatgatttctccgccaggcatccacaaggcaatttccaacaaacctcggcgatgggacgccttcgcgccgcgcaggggatcgacgtcgaatatttggccctcaaggagggcgagaagatcgtcgcggcggcactgttcgaaactcaccgctctcgattctctacatttgcggtcatccatgatggcccgatgtgcgactatcacgacaccgaagcattgaccttcttcatggatgcgctgaaacgccatgccaaggcaaagggtgcttcacagctggaaatcacccctgaatccccgtatcggcttcgcgacaccaatggagcttctttgccggatgaccagaatggcgctcccgacaataagctgatagaacagctcgaggcgatcggcttcactcatggcggtttcaccgtgggctacacggcggttccgcgttggcgctacctcaaggatctgaccggcattaccgatgagaaaagtctgctgaagtcctatgacaagcgcacccagtggagcgtgaagcgtgcccaatcgatgggtgtgcacgtgcgtgagctgtcggacgacgagctgggggtattcgcacgaatcgagcagcaaaccgctgaacgccgtagcttcgaataccgtggcgaagcatatttccaccgtttcaaggaagcgttcggcagcaaagcgcattttatggttgccgagatccacatcgacgaatacgtagcggacatgacgtccaagcgtgaagcgctttcggccaaggtggcggcattgaccgccaaaaacgccgaacaccccaccaccaaaaccgaacgtcagctgggggaggagacccgcaatctggcggcagccgaaaagcgcctgaacgaggcggccgagttcgccaaagacggggatgtactgccggctgcggcatcactattcgtggagcatccgcgcgaggtcatctacctgttctccggtagcgtcgagcagtacaagcccttctacgcctccgcgctgattcagcatgacgcgatgctgcatttctgcgtggaacacgggctgtctcgctacaacttctacggcatcgacggcgtctttgatgatcccgatgacgaggggcgtggtgtactggagttcaagcagggcttcaacggatatgtcgaggaacttccgggcgagttcgtgctgccggtcaaaccggtcgcctatgccatgaagcaatttgcgcacaagctgctgtcgcggtaaacggacgcagcacacaggccattccagagcccagagtaacgatcagagtaacgacaagtaagaaggttcgattatgacgcaatccgatgcaggcgtcgcctcgctcacccctaccaagatcactcctgccgagctggatgcgttctccgcagctcaagtgcaaggtagtttccagcagacctcgcagatggccgccatgggtgcgttcaacggtccggtggactatgtgggtgtcaagcgcggtgacaagctgattgccgcctgctacgtggtgtacacgcggtcccgtttcggtttggaaggctcggtctggtgcggaccgctgtgcgattatgacaatccacaggtggttgaggcgatgaccgaagccctgcgtcgttcggccaaggcccatcacgccatcagcgtatcctgctggccggccgcagtctaccgtctgcatgatctggacggcaagccgaccagcgacccggacaccacgatgatggacaacatggcccgcttcggttggaaacatggcggtttcaccgtgggctacgaatccgtggtgaaccgctggaacttcgtcaaggggcttgacggcattcataatgagaaggaactgctggcctcgttctccaagtaccgccgtaagaacatccgcattgcccaggattccggtctgcgcgtgcgccgactggaacgcggcgaactgagcactttcgtcaagctgtgcgatatgagcgccgcacgtcaaggcttcaagagccgcgatctggcctactatgagcgtctgttcgataccttcggcgacctgatcgagttcaaggtggtcgaaacccatttcgacgaatatctggacaccctgcaatccaagctgaatgcggcctccaaagacaagcgcaacctcgaacgcctgctccagcgcacgcaacagcagccggaaggcacggccaagaagggtgcttccgacccggcaacgctggaaaagcgcatcgccaccgcagacaagaagattgcggcgctggaaaagaccatcggcgaagtcaatggcatcatcgcttcggacggcccggtcattccggtggaagccggcgtctacttctggcatccgaacgaggtcgtctgcctgtccagcggcgaggacgatcgtttcatggattactacccgtcttccctaatccacttcgaggcgatgcttgactgcatcgcccgtggcgtggagcgcttcaacttctacggcatttccggtattttcgacgccaacgatccttcctacggcgtctggcagttcaagactcgcttcggcggattcgtggaagagcttccgggcaagttcacgctgccggtggacggactgcgcttcggtgtatccgaagcagcgcacaagctgctgcatcgctgacaaacagtggcgagcacggacacagaaataaggcacaggtgacgacgagatgagcgcgactgcgaatcgaacagatacgacgtatacgtttggcgtgattacgcccgaagagctcgaccggctttccgaagccacaagccagggcagcttccagcaatggtccgggcaggtccgtcttgccaagattcgtgggcatgaagccgaatgcgttggcgtgtgcgacgcatccggcaatctggtaaccggctgcgtaattctgtacctcaatggtcgtttcggtgcagatggctccgtatatttcggccccatcggcattagcgatgatccggctctgctgcgggccataaccgaggcgatttgcgaatcagcccgtcgccaccatgctgtttccgtagcatgctggcctaacgtcgcctaccgtctgtattcctcggacgggcagcccgacggcgagccgaacgatgcactactggccggattcgccgatgccggctggacgcatggcggattccataccggttatgacgtggtctgtcagtggatgtacgtcaaggatctcaccggcatcaccaacggcaaggaactgctggcgtcattcggcaaacgtgctcagtggagtgtcaagcgggcgcagtcgatgggtgtgcacgttcgtgagatcggccccgacgagttcgacgtgttcgccgatatcgaacggcggaccggtgaacgccgtgggttcgcgacgcgtggcgcggactatttccgccagttcaagcaggcgtatggcgcagatgcgcatttcatgctcgcggaaatccacatcgccgaatatgtggcggatatgaccgccaagcgcgaggcgttgcaggccaaggtagctcgattgcaggcgaaatacgatgaacgtccgaccacgcgtatcgaacgtcagctgggggaggaatcacgcaatctcgcggccgccgacaagcgtctggctgaggtggagggatatgccaggaagggcgatgtgctgccggcagcggcttcaatgttcgtcagtcaccccaatgaggtggtctatcagtattccggttcgttggaggagtacaagccgttctacgcctcggcgctgattcagtacgaagcaatgctgcatctatgtgtggagaagggcgtgagccgctacaacttctacggcatttccggcgtgttcgacgatccgaacgacgagggccgcggcgtgctggaattcaagcagggctttaacggctacgtcgagcagatggtaggaaaattcacgttgccggtggataagttccgcttcggcgtgagcaatctggcgcacaagctgctgcgccggtagcaactggcggtcggggacgagcctatgtgggctgcgtctcgtctgaccgtgcacccgccgtgtgcctacttgcgcatttgctcacacgcccatcagcgcgtgagccacagccatcatcaccagtgaaatcatcgcggtgattgccagcgagaagccggccagtttggcgttgccgagtactttgtcggtgaacagcgtggagaaaatggcgatcggagccaacgcgcagatcaccatcacggcgcgaatcgaagccgagaacggcagcaggagccacgcgatcaacgcgaaggcgacgctgaacggtatacgccaagcgatgacggccatgacttccttcacgtcatgcttggattggggcaggtccatgagcatgcccaccatcagcatcgacaccagcgcgttggcgccgctcaatggctgggttatagaggcgatccaatcgggaatcttcacgttggcgacggtcaacacgatcatgagcagatacgtgtcgaacggcaccgagccgaagaagctcttgccgatggtgcgcagcaatgcgcggcgggcaagccgtttggcgtcgcgatccttgggcttttcgtacggtagggtgggagccgaaccggcgtgttgttcggcaagtgttttgccgggctgaatatgcagcagttgctgggtgagcacattggtgccggcggccaccatcacgcagttgccgatatcgaacatcgcagccggcaccaccgcgcccgcaccccagaatgactggacgaccgggaaagaaaaacagccgagattgaagccggcaccgttgagcatcaggaaggcgcggtcggtcacattgcgcttgcgggtggccagaaagatgaacacgaccgggataaaagcaaacaggaatgcgaataccgaaataagcagcagcgagatgtcatgcggattggtggcgaacgagtatacgatggcaccgggcagcacgatgttgaattccgcggtttgcaacacgcgataatccttctgcccgaacaggccgaaccgcttgaacagatagccggcgagaatgatcagcaacagaccaaccggcgtaagaatggcggacatacacttctctccttgactcacacaggctcatggcgcacaggctcagacccacaatgctgtgaccattatatttgccgccttggcattgccatatgtagaggcgtccgcaagggcttgcaattgcctcacgcatatacgaaaagcctcccggaatcgttggcaatccaatgcttccaagaggctcaagccggtgcgcgagatgggacttgaacccacacgtcaaagacacaggaacctaaatcctgcgcgtctaccaattccgccactcgcgcgtgcatatccgcgtttccacaggtgtggaagatatacaaaaccctaggccggacagccattacagaccagccagcctagggcatccgagccacttgtcagaatcgaactgacgacctgctcattacgagtgagccgctctaccgactgagctaaagtggcttggttcgcggaaggcatttcgccagccgcgcacaagaaattaagtataagacatccccgcgaaaagtccaatcggcggcttggcagttgtgtcgcgaccgctcagtcgaagatgacggttgcgccgcgccatgaactgttcgataatgcaaacgatggcaatccgacatcgctgactcattttgttctgttcatgtccgaatttgtgagtattctgtttggtgatacggagcgcatccgagccgtgagcgaaggcgctccagtcactgatgaaaggaatggaatcctatggccatcaatccgcccgttgacgccacccagacccctgagtgggctgccctgcagaagcactatgacgagctccaggccgaaggcgtgagcctcaagaagtggttcgccgaggacgccgagcgtgtcgacaagctgtccttcgacgccggcgacctgcacttcgatctgtccaagaacctgatcaagccggaaaccctccagctgttcgccaaccttgccaaggccgtcaagctcgatgagcgcaccaaggctatgtacaccggcgtgcacatcaacaacaccgaagaccgcgccgtgctgcacaccgcgctgcgccgcccggtcgaagacgagggcaagtacatcgttgacggccaggacaccgtcaaggacgtgcgcgagacactcgacaagatctacgctttcgctgacgacgtgcgttccggcaagtggaccggtgtgaccggccgcaagatcgagaccgtggtcaacatcggcatcggcggctccgacctgggccccgtcatggtgtacgaagctctgaagccgtacgctgacgctggcatctccgcccgctacatctccaacatcgacccgaacgacctggccgagaagaccaagggcctcgacccggagaccaccctgttcatcatcgtctccaagaccttcaccaccctggagaccctgaccaacgctcgcgaagcccgcacctggctgctcgaagagctcaccgccaacggcgccatcgccgagggcgacgaggctcagaaggccgaggccatcaagaagcacttcgtcgccgtctccaccaacctagagaaggtcgaggagttcggcatcgacccgaacaacgcgttcggcttctggaactgggttggcggccgttactccgtcgattccgccgtcggcacctccctggccgtgatcttcggcccggcccgtttcgaggagttcctgcacggcttccacgagatcgacgagtacttcgccaacaccccgttcgagaagaacgtcgtggtgctgctcggcatgctgaacgtctggtaccgcaacttcttcaaggttgcttcccacgccgtgctgccgtacgaccagtacctgcaccgcttcccggcttacctgcagcagctgaccatggagtccaacggcaagtccgtgcgttgggacggcacccccgtcacctccgagaccggcgagatcttctggggcgagcctggcaccaacggccagcacgccttctaccagctgattcaccagggcacccagctcattccggccgacttcatcgcgttcgtcaacaccccgaacccgaccaaggacggcgaccaggacgtgcacgagctgttcctgggcaactacttcgctcagaccaaggctctggcattcggcaagaccgctgacgaggttcgcgccgagggtactccggaagagatcgttccggcccgcgtgttctccggcaaccgtccgaccacctccatcttcggtgtggctctgaccccgttcgcactcggcgagctcatcgccctgtacgagcacatcaccttcgtggaaggcaccgtctggggcctcgactcctacgaccagtggggcgtcgagctcggcaagcagcttgccaagcagatcaccccggccatctcccaggacgacgacgccctcgccgcccaggacgcctccacccagagcctgatcaagttctaccgcgcaaatcgcgaattctgattcgctttgctcggtcagaattcgtgattcgcgcgaccgcggctgtgctgtctggtgggcagtctggcgactgcccacgtcgcgaattctgattcgcttttctagctcccctcaatactgaggggagctgtcagcgaagctgactgagagggagttatggaacgctccgtatgctccccctcaactatgactgttgccggcggcgaaactactggaataatcaccgtccatcggactctcaccttcttcaagccgtgcgctgaaacgccaaatcaataccatcgtcggtatccatgcgaccagcaggagggacggaaagtattcgaatccgccatccgtgctgcctcggccaaactgatgcgttaataacggagagagacgacgacacgccgatactgtccgcaataatccgtaaaatggtcgattgctgtgtcgagaagtgggccgccgcataagcccacgtctccatgggtccagcccgaacggccgcaaggcctgactttcggcggatcggcaggcttcccaagggcaaactcgagggataacgagaacaggccaacgcgcgcgatgcgtaatcgcgtggatggccccagatctgtggctgatatgcggcagcactgaaggaaaacaatggttaacgctgttgaggcttttgacgccaagcacatgaagccggccgaggaaatcccggccttccgtcccggcgacaccgtcgacgtgaacgtgaagatccaggaaggcaacaactcccgtatccagaccttcaccggcgtggtgatcgctcgtaagggcgctggcgtgcgtgagaccttcgtggtccgcaagatcagcttcggcactggtgtggagcgtcgcttcccggtgcactccccgtccatcgactccatcaagctcgtgcgtaagggccgtgtgcgccgcgccaagctgtactacctgcgcgctctgcgcggtaaggccgctcgtattgccgagcgccgcgacaactctgctaagtgagtcgattcgcgggtgcaatcgtgagcctgatgatgcaggcgcgcgaataaaccgtgaaattcagcccggaaccgtttcggtttcgggctgttttcgtattttccacgtatgatggacgggcgccggcacccctcatatccggcagcatgaatcgcgaggagatggtatgcaggacgatcaggataacggcgaattcccgatttccgacaatccggagagcaaccagacctcgtatgatgacgaggccgatgcccgcgattcccgtacgttccaagtcgccgaccacggcatcgccctgtccccggttcccccggcaccggcgcgcccggcgcacgccgcttcttccgctggcgcgggtgcagccgctggcgcgaatgccgcggcagcatcatcgtcagatgatgaccacttcaccctacgcgactttttcctgtggtgcggcgttcccgtgcttatcgtgctgctgattcgcattttcgccgtcggcttttacgagattccttcgcgctcgatgatggacaccatggtgcccggcgatcgcgtggtgaccagcaagctcacccccaagatcttcgatttgcagcgcggcgacgtcgtggtattcaaagatcccaacaactggttgaacgaggagcagagcagcgctcccggtggcgggtacctcatcaagcgactgatcggcctgcccggtgacgtggtcgaatgcaagggcgcgggccagccggtgaccatcaacggcgtggccatcaatgagacctcctacattcgccccggcgtggacccgagcgccttcccgttctcggtaaccgtgaccgagggccgcgtgttcgtcatgggcgacaatcgcgccaattccgccgactcccgctatcatcaggatgacggcgatcgcggcttggttcccatctccgatgtggtcggagtcggaatcgcgaaatactggccgcttgaccggcttggtgcgattgatgaccaccacgaagtcttcaaggacgtgcctgacgcttccggctcgaattcctgagtctttttttgaaccgtgtgagtctttgaactgattgagttccgggccgtctgaaccctgaaccatatgaatcctggaccgtctgaatcctaaccattgtgagacgatgggagccgcgcatgattaccccgacacttgacttggaacgcagccttgcggcccagggctatgaccttatcgctggattcgatgaagtcggccgcggcgcgctcgccggcccggtgatggtcgggtgcgccgccatttgggcccgtgatttggagccgttggatggcgatgatgccgtcgaactgtccgggcggacctacctcggcgtgccggacggcgtggccgactccaaaatgctcaccgaacataggcgcgaggcgattttcgacgaactgcgcgactggtgcgcggcctacgccgtaggccaggccagcaacaccgagatcgacgaatggggcatcacctacgcgctcggcgtggccgccctgcgcgcgctcagccaagtcgaacgcgaacttggcttacgacttagaggggaatcgacgataaaaaaggcttcgggggagtctgcggggaagattgtggaaggtcgtccgggaggctccgtaggggaatccattggaaattgcgagggaagcgttcgcgctctgcccaaagtcgccggaattctcgacgggccgagcgattacatcaccaaggcgctcaacacgttcgacgcgccggacgtgccgattccagccgacataacgaccaaagtcaaaggcgaccagcattgcgccaccgtcgccaccgcggcggtcatcgccaaagtgacccgagaccggctgatggtcgacctcgcgcaaagcaacccacgttacgccgcctacgaatgggctcataacaagggctatggttccgccgcacaccgtaccgccatcgccgagcacgggccgactccgctccatcgtgtctcatggcacctgacctgagccgcgtgcgacacgacagtgtgagcgctaacgcaaaactgttgtggacgcgctaaagtcagtattgattaaggtacaagcctggccgtgcacggatgccggccgccagcggggaggttaggcaatatggtgaccagccgcaagccaagcaaacgtccgtccatgttcgaagtggccaagctcgccggagtcagccaccaaaccgtctcccgtgtgatcaatgactcgccggacgtttccgacgccacccgtgcgcgagtccagaccgccattgaccaactcggctaccgcccctccaactccgcgcgcgcactggcttcccgccgttcgcgcaccatagggctgatcgccggaggcctcaaattcttcggcccgatttcctccatctcctccatcgaatccatggcccgcgagcacggtctgttcatgagcgtgatgatggtccacgaggccttgtgcgcgcaggccgacttcgacaacctgtgcgacaccttcaacgagcagaacgtcgacgccttcatcttcctgaccccgaccgacgtgatgttcgccgccgcctgccgtgcacgagtcactcagccgcgcgtcatcgtcaccgccacccacggccaaatgaccgtgcgtgagggattgggccttatctccaccgaaaacaagcgtcgcactgcgctggtcggtatcgaccagtggggtgcaatggccaaagtggtggccttgctgggcgaatacgggcacaaatcggctctgtattttgccggtcccaacgaatggcgcgacgcccacacccgactggatgcgtggcgcaagctcgccgcctcccgatccatcgattcacagatcgtgcgctgccatacgtgggatgcctctgaggcatatgcgcacatgaatcatctcattgatgagtatgggcgtcgaggcgcggcgttgcccaccgcggtcgtcgccgcgaacgacaatcaggccgtcggcatcatgcgcgcgttgcatgagcatgggcttcggattccgcaagacatcagcgtggtcggattcgacgacatgtctggcgtggataacatgtacccaccgctgaccaccgtgcatcccgatttcgaggggctcggcgtggccgccatgcgagagacgctgcgcttgctgggggagggcggcgagccgaccttcctgaccacccagcacggcatggggctgattcccgccgaggtgcgtgctcggcggtccttggggccggctcctcggcggtaaattggccctgttatcaaaccgttatgatgcgtgacacggtataagttgtgtcgaatgcaggttatcggtacaatgttttttgggaaattgtgagcgctaacaccctccccaaggaaggggataacaacgccggcgctccaaggcaaaggaaagatatggcagcaaccgacaacgcggccgagcaggtcgcccacatcgccgagaagattcgcgctggcaagaccacgctgggcatcgaattcggctccacccgcatcaaggccgtcctcatcgacgacaacttccagaccatcgcctccggcgactacagctgggcctctcacttggaggatggtctgtggagctacaccaccgaggagatctggggcggtttgcagtccgcttacgcctccatggccaacgacgtcgagaccgtctatggcgagaagctcacgcacgtcggccacatcggcttctccgccatgatgcacggttacctcgcattcgacgaggccggcgaactgctggtgccgttccgcacctggcagaacaccaacacctccgaagctcacaagaagctctccgagctgttccagtacaacatccccgagcgttggtccatcgctcacctgtaccaggccgtgctcaacaaggaagagcacgtctccaaggtggcttacttcaccacactcgccggttacgtgcactggaagctcaccggtaagaaggtcctcggcgtgggcgatgcctccggcatgttcccgattgacccgaccactcacacttacgaaaccgcattcattgagaagttcgacgctctacctgaggtcgcagcccagccgtggaagctggagaacctgcttcctgagccgcttgtggccggcactccggctggcgagctgaccgaggaaggcgccaagctgctcgatccgtccggcgccctgaagcccggcatcgtgctcgccccgcctgagggcgacgccggtactggcatggtggccaccaactccgtgcgcgtacgcactggtaacgtctccgccggcacctccatcttcgccatggtggttctggagcacaagctcaaggccctccaccctgaggttgacttggtcaccaccccggccggcgatctggccggtatgagccacgccaacaacttcacctccgacctcaacgcttgggtcggcctgttcggccagttcgccaaggctatcggccagccggttgacgcaggtatgctgtacggcaccctgttccgcgcggccatcgccgacgacgtggacgccaactgcggcggcctgctgaactacccgttccgttccggcgaattcctggccggtctgcctgaaggtcgcccgctgttcgcccgcagccccgaagccaacatgaccctcggcaacttcatgcgcgcccagctgttctccgcgttctccccggtcaagatcggcatggacgtgatgaccaagcaggagcgcgtgcaggtcgactctctcgtgggccacggcggcatcttcgccactccgaaggtggctcagaagattctcgctgctgccttcaacaccccgatcaaggtcatgtccaccgccgccgaaggtggcgcctggggcatggccgtgctcgccaactacctgtggaacaccaacgaggatcacagcaacctcgctgacttccttgacggttgcgtgttcaaggacgcccagtccaccactgagaagccggtggcttccgatgtggttggtttcgaggacttcttcgcccgcttcaccaagggcctgcccatcgagcacgccgccatcgaaaccatcaacctcgaagataagtaagcctttctgacctccctctattgagggaggtccttgagattttgaaaaaacgtccatccatcacagtggaaaggaaaaccaataatggcaactttggctgattacggccccgaggttcgcgccgaggtcaagcaggttcgtgaggtcgtctccaacctgcaccagcagctgatcaagtggaacctggtcgtgtggaccgcgggcaacgtttcccagcgtctgcacaccgccgacctgttcgtcatcaagccctccggcctgcgctacgagtacctgaccccgtcctccatggtcgtgtgcgaccttgacggcaacgtggtcgacggcaccgaagccccgtcctcggacaccgcttcccacgcctacatctaccgcaacatgcccgacgtctacggtgtcgtgcacacccactccacctacgccaccgcttgggctgccactggtcagaacatcccgtgcggcctgacgatgatgggtgacgagttcggcggcccggtgccggtcggcccgttccgtctgatcggctccgaggcgatcggcaagggtgtcgtcgagaccctcaagaagtacccgaagtccccggccgtcctcatgcagaaccatggccccttcaccatcggcaaggatgctgaaggcgccgtcaaggccgctgccatgaccgaggaagtcgctcacaccatgtgggccgcccgtcagctcggtgacatcatcgagatcgaccaggccgacatcgataagctcaacgaccgctaccagaacgtctacggtcagcactgatttgatggagtgtccgccgcgttacggaaggcccgacgtaccttcgtacgccttcgccttccgcgccttgcggacacacacatcaaatcagcgctgactccgccagcacggtggtgtcttggctcccctctctgaggggagctgtcagcgatagctgactgaggggagcctcggtcggcgaatgaaacttaaacaaacccccataaacaaagaagtaaaggaagtaaccctatggttatggaaaatcccttcgagggcaaggaaatctggttcggcgttggttcgcaggacctgtacggcgaagaagccctgcgccaggtcgccattcactccgctgaaatggtcgactacctgaacaacaccggcaagattccggccaagatcgtcctcaagcccaccctgaagtcctccgacggtgtcaaggagttcatggtcgaggcttccgccaacccgaacgtcatcggcgtcatcacctggtgccacaccttctccccggccaagatgtggattcgcggcctcgaagtgctgaccaagccgctgctgcagctggccacccagcaccacaaggaaatcccgtgggagaccatcgacatggacttcatgaacctgaaccaggccgcccacggcgaccgtgagttcggttacatcgtctcccgcctcggcatcaagcgcaaggttgtcgtcggccactacaccgatcccgaggtcgccgagaagctcggcacctgggcccgcgcctgcgccggctgggatgcctccaacaacatgaaggtcatgcgctggggcgacaacatgcgtaacgtcgccgtcaccgagggcgacaagaccgaggctgagcgcgtgttcggcgcctccatcaacacttgggccgtcaacgagctcgtcgctgcgtacgacgccgtcaaggacgaccaggtcaaggagatcatcgaggactacaaggccaagtacgacgtcgacccggctctgctggacgccaagtacgactccctgttcatcgccgccaaggaagaggccgcgatggtcaacatgatgcgcgccaacggctgcaccgccggcgtcgacaacttcgaggacctcggcgctctgccgcagctgccgggcgttggcccgcagcgcttcccgtccgagtacggctggggcttctccgctgaaggcgactggaagaccgccgtcctcgtgcgcatcggtgccgtcatgggctacggccttgagggtggcgcctccctcatggaggactactcctacaacttcaccgagggtgacgagctcgacatgggctcccacatgctcgaggtttccccgtccatcggcaccatcgccaagccgaagctggagatccacccgctgggcatcggcggcaaggccgacccggtccgcctggtcttctccggcaagcccgccaaggacgccgtcgtggtctccatgtccgacgttcgcgaacgcttccgcctgctcatggacgtcgtcgacgtcgttgagccgcagggctccctcaaggagcttccgtgcgcccgcgccgtctgggagccgaagccgagcctgaagaccgctgttgagtgctggatcaccgccggtggttctcaccacacctgcatgaccacctccgttggtcgtgaggcttgggaagacttcgcccgcatcgccggtgttgagctcgccgtcatcgacgagaacaccaccgctcgccagttcgagaaggaactggagctgtccgagatgtaccaccgtctcaacaaccagcactgattggcggagcgtataccgcctttcctcaggttcgacgtaccttcgtacgccttcgccttcggacggcggtctccgcacgcgccaatcagcgctggcaagccagcactgatgactaaatcagtctgctgactgctaccgctgaaaaggggctgttccgggaaaccggagcagccccttttgctgttatcggcaactccccacaaacgcatcaaaaatcgcctgcgagcgtggatctaccttgtagagaaactcgggatgccactgcacggcccacaggaagtggcttgccggccggtacagggcctcgatcacgccgtcgggcgcgacggccatgacctcgagtccagcagcaggctcacgaaccgcctgatggtgatagctattcaccgcaatctcagtctgccctgcgaacaatgaagccaggggagtgccgggcaccaaggaaacgttatgtccgaacgcatcgtacggcggattcatatggtgttcgatatcgctcggatgctggcttggcagatcctgccacaacgtgccgcgcagcgctgcgttgatgaactgaatgccacggcagatgcccagaatcggcttgtcccaagccattacagctggcagcagaatcgattccattcggtcgcgctcaggagagagcacctcgctacggccggtggcggaggccgctgcaccaaccatcggtcccacatccggcccgcccgtaaacagaaacgcgtcaaaccgttcggcgcattgcgcaagaatgtcggtgtcatcggtcagcggcaacatgacgggcgtaccgccggcccgcattatcgcctccatatatccgggcagcatccacagactatcgcgcccgtaatccatcagcggagtcaccgcaatgagcggtcgattcgtagtcatgcctgcctcttttcgcccaagtgttgttttcgtcgttctgccgcaaatcgcttgattcagtggccaataatgccgccactgtaccgaaccaatgtaaccggtcggccaacattatttcgtcagccagccgcgacgagatcgcacaatgtgccaatgatgggggcattcggtgcgaccttgtcaatgttcgggccattgcactttcagcggggaaagcatgccccgtccgcgcatcatgatgaacgagtaaggttgacggggagggagaatcacatgaaccaggcatgcgtacgcaacgacaccatcgacgcgggcaaccatcatggccgaccgcaataccggtcgttcctgcgatttctgacatcgcaggaacgcaacgtcatttggctgttgctggccattgcttttcttccggtggacggcaccacgcttggcctgtacgcgccgttctggtctccaatcagtccggcgctgttcgccgtgtactgcctatgcaattggcggcaactgcgcatcgcagccaaccggtacctgccaatgttcctcctaccggtggcctgcataatcctgtccatcccgggatggctgaagttcggcatccacctcaacgccgcgttcatgagcatcaccggattgctgggcgtgctcgccactttgggtgcgatcgcccttgcgttcgacatcaaacgcattccgtggcgtacgccattgcggattctcatcgcatcatactgggtttccttcggagtgggcgtcgtgcaatggctgtccatccgtctgcacgccaaaccgttgaccgactatttctcgcacctcatgtaccggcaatacatcagcgacaactcggtgtggggcggcggccgtccgcagttcctgttcgccgagcccagctatatcggcatgcacctgttcggcatactgcttccgctcatgtggctcatgcgcgggcgcgaccgcatctacgccaaacggctgcgtgacctcatcgtcacgtatgccgtcggcgcggtgctcatgcaagccggcaccagaatcgtcatcgattccgtcgtggcgttgctgatcgcccttgtggcgcgcaccgattggcatgacggcgcacgccgcgtccggggcatgctgcagattctcggcgcatgcgcactgggcctgctgggtgtgctggcggattccagactctccgccatcgcggaaaacggggccgagggagacggctcgttcttcgcgcggatctaccaaagcctcgatccgatatgcggattgctcacccatccgtggacgctgctcaccggttatggcgcgggcaacatcatcaatgcggtgtgggccggcgcggccaaagccggacggctgctggacggtcttggcatgaacggcggcgcggccacgggattcgcggccggcgtgaacgcggacacggtgtggacgatgtgcgcgtataccagcgtcatcgccgaatacgggctgatcgggctggccatgctggtcggagcctcgatggtctgcatgacgcgcgggaggacggtatgccgtggcggtgcggatggcgcatcgtccgacgagctggcgcacggtgtttgtgtcgccgacgttgccgacgttgctgatgttgccgggggtaatagtggtggcggcgttgccggcgcgggttcgggcgaatccggcgtctggcacaagaccgtcatctgctggctcgtcctggtcgcatacctgtacatccaatgcgagaactatgcgttcgccgctctgccgcttcttgtgttcgccgcctcgaaggtgaggcgcgagcctgatttctcgcgggccgacgcatcgacgcggcccgagatggaccaaaatccagaataaccgacattcgccgctgttccgtttttcgctcaaggcgtatatctcccgtatcttgaggtgcatcatgtatcgtcgcggctaactaatcggcgaaacgcggcatgtttcgcattttgggcgaaaagcccaagtcccacaggaggtattgatgacgttcgttgcacggtcggtgcgctatgtgctcagaaaacgagtgcgaaccatagtgctccttataatactgaccatcataacggcgagcatgctatccacgatcgcggtttctcgggcagctcaacaggccgccggacgaatcgagaaggaagcggtcggtggattcgtgctgtccagcaacatgcagggcagcatgctcacgcctcgcggaggcggcatggtgcgccccgccgacgtgcgcaggatcgcccaactgcccggggtcgattcgtatatggtccgtcagaacgccaccgccgatctcgtgggggcgaatgtggcgaaggtccccggcggcgatgattacgatgcgacccaggagcagcagtttggcaacgccgccaacgtcatgggcacgaatgattcgtcgaaactcaacgtgttcacgtcgcgcacgctcggcatggccgaaggacgacatctgaaggcctccgacaagtacacgtcgatgatccatgaggatctcgccaaagccaacgggctcaaagtcggagacacgctcacgctcaaggccaacgcctatgacgccgacaacgaatcacattcgacggcgaccgtcaagaccaccatcgtgggcatattcaagggcgacagcgccagaaaggtatccagccgagcggaactcaccgccaacaccatctacaccgatctggataccacacgcgacctgtaccagtacaaggacggcaaggaaatataccaggacgccaccttcgtgctgtccaagggcgttgacgtggagaagaccatggatgccgcgaagaaactcccggtggattggaacaactatcagatcacgcgcaacgaccagtattcatcgagcatgctgcatgccgcccgcggcgtgcgctccatgatgcgcggcgccctgatcggcgtgaccgtctcggccgtgctcgtgctcagtctcatgctgctgctgtggatgaacgaccgccgtcaagagatgggcatactggtgtcccttggcgtcggcaagccctccctggtcgcccaatacctcaccgagatggtgctgatcggtctgccgtccctcgccctcggctggctgtgcgcgcagggaatggcccaatggctcggcgccacggcgctccattccgtgaacgcctccgcggcgaaggagctgagcagcatggggcaggtcggcggcgatcttgaatccagcatgtcggtgcgcaccctggattcgctcacggtgtcggtcgacgggaccgccatgctgtacgtggcgctcggattgttggcggtgatgctggtgtgcgtcgcggtggcgtgcatgccgatgctgcgcaaatcgccgcgagacctgtcggagattcgatgatgagcatgaatgtgtggaagcgtgccacgttggcgatcgtacgcaagccggtacgtagcggcatcatcggtctgctgatgctgatggtcttcacgagcctggtggcgcaggtcggagtctcgacggccctgcgtaccatgtccgacggcatcggcgcgggcatgggcatagggtttaccgtcagcgccggcgagaatcccattagcgccgaggaggcgagccggttctcgcgtatccccggtgtgacgaagaccgcctatgcgacgaagaccttggcgcaggtggatggcgcgcgcccggtcatgccccggcagggcccccgattggactccgatctggccatgcaggtcagcgtgctgggcaccaccgattcctcattgtccgaggaattccagagcggcctgtaccgcctggagcagggccgccatatctcgggcgacggcgacaatgtgctggtccaccgcgacttcgcgatgcagaacggcctatcggtcggctcgacattccgtctccggcaggaggggcgcaacgccacggtgcgtgtggccgggatcttctccggcaacgtgcaggcccaaagccccctgccctcggacacttccgagaacctcatctattcgggtaggcgagtagcttccgctctgaccggaaacgaccggatcgacatgatccgatgcctgtcggataatccgcaggacctgtccgcggctattggacgggccaagaccatggccggcggcaagtacgacgtcaccgacgattcggcccggctctccggcgtcctgcaatccgtgcagacggtgcgtaatctggtgcgcatggtgctgctgtccgtctgcctcgcggacgtactggtgctggcgatggcgctggtcttctggattcgctcacgcatccatgagataggcacgcttctggccctcggcatcgacaagatgcggatcgtcgcacaactcgccatcgaaaccggactcatggcggcggtcgccgccctgtgttcgctgggcaccggcgccatgctgtcgggatacgtgtcttcccgactgttgcgcgattcgggcgtcgcgccgttggaatcgttgcacgtggaggccttgccgcctgagcagacgatgctcatcctgctgctcggatgcgcggtcatcgccgtggctcttgccgtgtcatgcgccgccgtgctgtccaaatccccgaaatccattctttcctctatgcgttaggagtcaccaatcatgtctaactgtctgcaactggaccatgtcgattacgcctacggcgcggcgaagatccgtgttctttcggatgtcagcgcggatttcgaatccgggaagatgtatgcgatcaccggcccgtccggcgccggcaagagcacgctgctgtcgctgctggccggcctggacgccccctcccggggagtggtccgcttcgaaggggaggacatcgccgcatcgggctatgcgaagcaccgccgggagcacgtgtccctggtgttccaggaccataacctgatcgactacctcacccccgaagagaacctgcggctggtcagcgccaaggccgatatgaagatcctcgaggaactgggtttgagccgtgaggaatccaagcgcaacatcatgcacctgtcgggcggccagcgtcaacgggtggcggtcggccgcgcgctggtcgccccgggccgcgcgatcctcgcggacgagccgacgggcagcctcgacccggagatgaccgacgaggtgattcatctgctgcagcacgccgcccatcagctcggcaaatgcgtgatcgtggtgacgcattccaagcgcgtcgccaactccgccgatgtcgtgctgcgtctcaggagcaagaaactgacccgggcatgacccacctgggccgggcggcaccccggcgacgacccgcatggaatcatcgtcataatgacgcctgcgatccctggacatgagaaaccgcacctccgatcatcgaatctggattactccagtccaacaatcggggtgcggttcaaaaggccctttttttgtgtcggattacgaaccgcgcgtctcaccgcttgccgttgtagatctcgttgtcgatcacatcggcgaacacgcgattgacggccgggcgcaccactttcagcgacggtgtcaggcacttgttctcctgcgtgaactgcgtgtccagcacggcgaacttgcgtacggattcggcgcgcgagaccgtcgcattcgccttgtccacgtactgctgaatctcctcgcgcaccgcggcgttcgtggcgagccggtcgaccggcgtctccgtggacaggccgtgcgcgggcagccacaatgccagcgactccggatcgagcgtcaccaacgcgccgatgaacgggcgctggtcgcccaccaccacgcagtgctccacgatcgggcacttggcgatctcttcctccagcggaatgggggagacgttcttgccgccggcagtaataataatgtccttgatgcggccggtgatgacgatgtggccctcatcatcgatctcggccaagtcgccggtcctgagccagccgtcggcggtgaacgcctcagccgtcttctccggcagattgtggtagccgcggaacacgttcgggcccttgacctgcagttcgccttcgtcggaaatgcgaatcgaggagccgggcgcgggctggcctacggtgccgatcacattgtcggtcacgcgcgtggcggcgaacggggcggcggtttcggtcatgccataaccctgaatcatcggcagtccgatgccgttgtagaaatgcgccagatcgagcgacagtggtgcgccgccgcaggccacgtacttgatcttcgggcccagagcaccgcgcaccgtgcggtagacgagcgtttcgtacttggcgcgctcggcgatttcggcaaacgtgtgctgctcgccggcctgctccttgcggctccagacgcgcgcggcctcggcggccttgacaaacaggcggcccttccagccggcaccggccttgtgcgaggcggcgttgtataccttctcgaacacgcgcggcacgcccagcaggtaggtcggttcaaacgaacgcaggtccggcagcagggttttggtgtccggcagataaccgaccacgccgtcatcggaggcgatggaggcgtactggatgaatcgcgcgaagcagtgggccagcggcaggaagagcagcaggcgcggatggtcgtcaagcaccacttcatgcaacgcctgcgaggcggagatggtgatggacacgaagttcttgtgggtcagttcggcacccttcgggttgccggtggagcccgaagtgtagacgatggtggccagatcgtcggcgcgcacggtggccacgcgctcgttcagttcctcgtccgaaacagccacgcccagaccttcgagcgcgcccagcgcgttgccctcgatcatgagaatctgcttcaaggcaggacagtggtccttgaccgagtcaagccggtcgaagcgctcgcggttgtcggcaaaggccagcttgaccgccgaatcgttcatgatgcgctgggcttgcggggcggagtcggtgtcgtagatcggcacgcttaccgcgcccactgcggccagtgcgaaatcgagaatgccccattcgagacgggtggaggaaaagatggtcaccgcgtcgcccttggcgatgccgagcgcgatcaggcccttggcggctgagaccacgcgctcgtggaattcgccggtggtgacgttctgccagcggccggggccgattttcttggcggcgattaccgtgtccgcgccggtgcgggccagtcgttcggtgagcagtgaatagatagtttggtcatcgcggatctcgatggattcgccgggcgtggtgtattcggtaagcatacggccgtttattccttacaaacatgatggcaagttgacaacccgagccattctgacgagttagattacgctggcgtaaggttgcgcgcgttgtgggcaatggagaagttgtctgtctggttttgtggattgtatacaacgccgtgtctaaccgatttgctctacggttatgaccgtgtccatttcgggagccatcgacttcctgcaggacaagtacgtgctgagcccggccctgcagggtccggtcatcagctccagcatcatcggcggcgtcggcattggggagtctgtggcttcttatttgggaacgaagctcagcgtgacagtcgtctcagctgaaggtctggcgtgtatgtgcgctttcgcctaaggtaaataggattgcgcagtgcacgccatcggtatgtgcaggtatgcgattggtggcacccgcgactgatgcatgacgagacctactgcagtaccacggcaaccaacaccgcaacaacacggcaaggggaagcgaaccatgttcgacaaacgactgttccaattggcaccaggtctcggcaagctcatagccggcaaagtggctctgatgtgggttgggctgcttgccaatatcggcttcatgctttcgctggtcatgctgctgcaaggactgctcgccgcagccgacccacacactttctcctgtaacgccgcctcggcctccgagtgccccgccaatctgttcggcgttccgggcaccaccgtcgccccgatggccggcgacctcatggtttacgtggccttggcgatcgtctgcatgctggttcgctacctggccaccacacacgccacacgcctcggcaccgaagccgccgaacgggtcaagctcgctttgcgttccaagctgtaccgcaaaatggtggccctcggcccgtcctacaggtcgcgcgtcaagacctcggatgtggtccagtccgccggcgaaggcgtcgagcagattcaaagcttcttcgaactgttcctgccgcagctcttctatgcgattcttgcgccgatcaccctgttcgccgtgattgcgccgatcaacatgccggccgccgtgaccatgctcgtctgcgcgccgctcattattattgtcaccggcatcgtatccatgaccgccgcccgcgccttcaaaaaatactggggccgatacaccgacatgggtgccgcattcctcgacaacctgcaaggcctcgaaaccctgaagaacttcgacgccgacgaccgtgccgccgccgaaatggacaagaaggccgaaggcttccgcgtcatgaccatgcgcgtgctgcagatccagctgcgctcgctgaccgccatggatatcgtggcctacggcggtgcggcggccggcattggtgtggctctatggcagtatgcgcataccgccgcggccgccgcaggagccagcgccgccggctggtctccgattatgctcgccgcccacctgcccggtgcgttcgcctacctggcctacggcctgcaatacctgatgccgttcggtgcgggcttcccgctcaccctcgccggactgttgctgatcgtgctgctgtccgctgaattcttcatccccatgcgccagctcggctcctacttccacgtggcgatgaacggcatgacctccaccaagcgcatcttcgccctgctggacacccccgagcccgcccacggcactgccacgctgccggccaccgctggtaccgatgccgggactgatgccggtaccaaggccggtaccaaggccgatggcggaatcaccgtcagcttcgaccacgtcggctattcctatgacagcgccgattccggtgccgccgttcaacaaacgaattccgcgccggcacctgcgctcaccgacctcaccttcactgcctaccccggtcaactcaccgccatcgtcggcatctccggttccggcaaatccacggctgccgcgctgcttgccggtacgctgaccggataccaaggctcgcttacgctgaacggcgtcaaggtatccgacctgtccggagagacgctcgcccgaaccatcaccctgatcggtgccagtagccatctgtttgccggtactctgcgtgagaaccttctgatggctttgcccgatgacggccagaacggtgaagccgcgtccgacgccgtggattcccgtctctgggacgcgctcgaacaggcccgtatcgccgacttcgtgcgttcgcagccggacggccttgacatgacgattgagcccgacgccgccaacctgtccggtggccagcgccagcgtatcgccatcgcccgtgcgcttctgcatgattcgccggtattcgtattcgacgaggccaccagcagtgtggatgtggaatccgaggaactgattctcgcgaccatccgcgaactggtgcaatcccgcagcaagacggtgatcatgatcacccatcgcatggccaacgccgagcacgccgaccaagtggtggtgctcgaacacggcaagtcggtggaaaccggcacgcatgccgaactcatggcggccggcggcgtgtacgccaagttgttcactactcaggcggatatcgagaactttggggctgaccaccctcagccagcttcgctgacagcttccgccagcgggagcggggcggctgtgggcgcagctccggctgcagctccggccgagatgagcacgttccaggtcatcaagcgactactcggggaggccaagccactggccgggcttatggtcgcggcttccacggccggcaccatcggtcaccttgccgcaaccttcctaccggtgttcggcatcatcgccggattcgcgctcgccggcaaccccgtgtggggcatgagtgcggccggtgcaatcaccgccatgattgtttgcgcggtgttgcgcggcctgacgcgctacgttgagcaatatctgaaccacaacgtggccttccacctgctcgcgctcttccgctccaaggctttcgccgcccttcgccgcctcgctccggccaagctcgccggcaagggcaagggcgacctcatcgccatgctcaccaccgacgtggaactgctcgaaatcttcttcgcgcataccatcagccccgtggccatagccgtgaccaccaccatcgtctacgccatcgtggcggccacgctgagcccctggatggcgttggcgctgatcgtctcccatctgatcatcggcatcattgtgccgcgcttcttcgccaccggcgtgcgcaatctgggccccgccatccgtggcgcggccggcgaactcgacaacgtgatgctcgacgacatgcgcggtctcgacgagatcatccgattcggtcggggtgaagatcgtgcgcaggccatcgaagaccgcacgcgcgcgctatggcgtgaccatgccaaactcagccgtgtcaacggccggttcgccggtgtcggcggattgctggttgcattgcttacctcggcggctgccggcatcgccatcaatcttgccggcgtgaacctctacgatatcccggcgctggtcgccgccttcgcgctgctcgccagctcgttcgggccgacgctggcgctcgccgccctgcccgcgaacctcacccagaccttcgcctccgcccgtcgtctgttcggtctgatggacgaagcgccggccgtggtggaaactggcactgcgaactcggattatgagggcatgcgccttgaccgcgtcatcttcgcgtacccgggggaggagagcgaggcgattctcgccgacttctcgctcgatgtgccgcagcacggcatcctcggtatccaaggcccgtccggccggggcaagtccactatgctgaagctgctgatgcgctattgggatccgcagcgcggccaagtgacgctgtccggcacgccgctaccgcaaatcgatgtgcatgcccgccgccgtattcaggccatgatgagtcaggagacccacctgttcgacggcatgattcgcgataacctgcttatcgccttgcccgaggcagagattcgcgatgggggagcggccggtgttcttgacgcccgactccgcgaagccctcgccaaggcatccgtgctcgacctgatcgattccctgccggatgggctcgacacccaggtgggcgagctgggcgaccgactgtctgaaggcgaacgccagcgcatcggcttggcccgtgtattcctgcgcaatgccgacttggtgctcttcgacgagccgaccagtcgtctggatgccttgaatgaagccatcattctgcgttccattcatgagctgtccaagagcgagcagaatgcggataaggggcaagacgtggctgtggtgctggtctctcaccgtgaatccgccatgcgcgttgccgatgcggtgctgaatctgtaaagtcgcacagtcacaggccgcaatactctgcaatacaggatttccttatatatcagcctctgataagggcatccagagagtcgagggccgcgtcgatggcctgagcctcgcggtcgtcatccgtctcggcgaaggaatgctcgctgtaggaatcctcgtcggcactgggcaacaacactccgcgaggcgtatcggcactgtgcgcgtgctcaatagaggccatatgtgccggctgcacggcatttgtctgcttgcggtttcgattcgcgtcattcgcggaatcaacggcatctgcggcatcaacgctatctgtatcatccgcaccactgcgcgtagtcggccgattcgccagcgtgaatggatcgtcgggcagtgaatcggccaaggccgcgactgctgcgctggccgctgcctcggccgccgcgccgtccagcatcgcaccatccgcagagtcagtcacggagccatccacagagccatccgcagggccgttcgcagagccgtccgtatactcaccgtcgtgccgtctactggatgacttaccaaccagaacagcgcccctcgtacgccgcataagcgacggcacgttctcatccgtcgtaacttccgagacggtcgctgccgtgtcttcttctgcagccatattcgccgctgccttggcggcttcctcggcagcgcgctgcgcctccagccgttctgcctcgacccttttggcggtctctatggcgaaaatcttctgctgtgccgcagcgcgagcccgctcagccgcatccataatgcccaatgcctgctgacgttcgttttcaatacgacgcagcgtggcttccgcgtggcggatattcgcatcagccgtgctcagcgcgtattttgcgtaggccaaatcggttttcggctgccatagatgctcgatttcctccagcgtgcgtcccattgtctccggcaccaacgccacgatgccgaacaggcaaatcagatccagaaccgcgaaaatcgcgaacgatatgccgccgcccaatccatcgatcatcatcggcgtgaattgtgcgatgatccagttggcgaacagcagacacatcacacacaatccggtggcgcgaccgcgcagatacgtggggaagagctcgggaatcacaatccagggaatcggtcccatcgaaaaggcgaacgatatggtgaacgccatgacgaatataagcgtcagcagcgaattgcccatgaaatacgagcccgaaatgcatagcgcgaacacgcacatcatgccggtgcctatttccataagacgtttacggccgaacgtgtcgatcaggtacatgcctaccacggtggccaccagctccatgccgcctacgctggcggccgcgaggaactgagtgtccccggcgaacccgagatccgagaacatcaccggcccatagtaggaaatggcgttcatgccgatgaactggttgaacacggcgagaaagatgccgatgacgagtgcccgtcgcaggcctggacggaacaaatcatggaattcgtgcgacatctcggtttccagtttgaccgaggcttggatgtcatcggtgcgcaggcgtgcgcgttcggtgccgaggatgtgctcgagcaccgcgaaaccttcatcggttctgcctatctgaatgaggaatcgtgggctttccggtgccctccgcatagccagcaggaaggtggcggccggaatcgcgcctaatcccagcatccagcgccatccagtggcgatatcccagtcgtttgatccgtgggaggcgatgatgtagttgatgacgttggtcaggaagataccgcaaaccgcaagcagctgataagagaaggcgagcagaccacggatgttggccggagccgattcggtgatgtatgtgacggccagcgcggcggtcaggccgatgccgtagccgccggccacgcgcgccacgataagcgctatgggacctatcgtcagcgcactccatacagccgcaacgaggaagaacgcgccgccgataataaggatacgtttcctgccgaatcggtcggaaaggaatccggcggtggccgctccgatgacggcaccgagcatgatggaggaaacgacgaggccctccatgagagtactgagcccgtatctggcgcgcaggaattcgatggcaccggagatggagacggtgtcgtagccgtacagtaatccggcaagacccgcactcaaagccagtccgaatgtatattttcctgatccgcgggtgcgtatggctgttcctaaaggattgggctgcttggaagcagtccgaaacagtcccgccatgtgctcttcctctcaatacagctatggtggtgcctattcatactagccgaactggctccgtctggcgctggacatccacgaatgtgaacgctctcggaattgtggatgtcggaggctgaagattcttctgtgtgcccgaggtggcgagttttggcgggaaatcaggcgtgtcgcttgattttgacaaattggtacacgggtgtatcatcatagatattggtacacgggtgtaccaaagaaaacaccccaaaaaagaccgtcagcggagcatatcgcaggcgaggaacccaggcccaaggtaagtccaaagtcccgaagccacgaccaatcccaacggctcaggaggagataacatgcgcaacaccaagaaggtcatcgcagcaacggccgccgccagcaacatagcatcggccatgagccggtacaataaaggacttgattgatatgactactcgtagaacgttcaggtggccgtccctgctgactgaatccggtcgtggcatcgcgttcggcggcgactacaatccggaccagtggcccgaggagacactggacgaggacattcgcctgatggtccaagccggcgtcaacaccgtggccctcgccatcttcagctgggacaagatcgaaccgcgcgagggcgagttcacgttcgagtggcttgaccacgtgatcgacaagctcggcgcggcgagcatcgccgtggacctggcatcggccactgccacggccccgttgtggctgtacgagcgtcatcctgaggtgctgccaatcgatcggtacggccatgtggtcaatgcgggctcacgccagtcgtggcagcccacaagcccggtgctcaaggaatacgcgctgcgcctgtgccgcaaacttgccgaacactacaaggacaatccatacgtgacggcctggcacatgggcaacgaatacggctggaacaaccgctacgactactccgacaacgccttggccgcgttccgcacgtggtgcgaggccaaatacgggaccgtcgacgcgttgaacgaagcgtggggcacggccttctggtcccagcacgtgaacagcttcgacgaggtgttgctgcctcgccacatgggcggcgacagcatggtcaacccgccccagcagttggattacgagcggttcggcaacgacatgctgctcgacttctacaaggccgaacgcgacgccatcgaagaaatctgccccggcaagccgttcaccacgaacttcatggtctccaccgaccaatgcaccatggactacgcgcaatgggcaaacgaagtggacttcgtgtccaacgatcactacttccatgagggcgaatcccatctggacgaactcgcctgctcggacgcgctcatggactcgctcgcgctcggcaagccgtggtacgtgatggagcactccacctccgccgtccaatggaagccgcttaacacgcgcaagcgcgccggcgagctcatgcgcgactccttggcccacgtggccatgggtgccgacgccatcaacttcttccaatggagacaatccgcatcgggtgccgaggcgttccactccgcgatggtgccccacgcgggctccgatacgaaactgtttcgaggagtgtgcgaactcggcgccgcgctgaagacgctgtccgacgcgggtgtgcaagacacggaactgaagcgcgcggacacggcgattctgtttagtgcggaatccgaatgggccactcgctccgagaccctgcccagcatgaaactcaatcactggcatgacgtacgcgactggtatcgcggatatctcgatgccggagcgcgcgcggacgtggtcccgctcgcctacgattggagcggctaccagactatcgtgctgcccaccgtgatcgccctgtccgacgaggatacccgtcgcatcgcggactttgccgaaaacggcggtacggtcatcgtcggctatgccaccggcctgatcgacgaacacttccacatcggtctcggcggataccccggcgccggcaacggacttctgcgcgacatgctcggcatccgctccgaagaattcaacatcctcggagaagaagccgaagacgaaccggccgaaatcggtttgtcgaatggactcacgacacgtctgtggcagaatgacgtgacctcggtcgctccagacactcgcgtgcttgccacgtacgtgggtacagccgctgctgactgggagctcgacggcgtccccgccatcaccagtcacccccacggccaaggcgccgccatctacgtgggctgcgatcttggccgccacgacatcacccacttgctcaaggaactcaacacaacagccccctccgacgaaagggctcccgaccaaaggccgggtgggggagagatcaacgccgcaactacgaccgcagcagccacgactcatgacccccgcatcctgcacaccatccgccaatcctcagacggtaccatccgcttcgatttctatctgaaccgttcgaagcagcccgttgccgtcaacggtgtggaaggtgatcccatcatcgcccaccgttgcgagactgacgccgttggatatacgctgaaccgcaacgccattcttatcgctaaaacgtcctgctaaaccgcgctagaatggcaatgttgtccggatagaggagtgtggcatgagcgacgagaaaacagccaagcgtcgagtgacgctacgcgatgtcgctcaggccgccggtgtatcgctcaaaactgcgtcgaacgtgatcaatggctccgggcgtatgaccgatgaaacccgtgcaaaggttgaaacagtcattaaggacctcggctaccgagtcaacgtggccgcccgtaacctcaaccgcgatcacaccggtttcatcacccttgccgtgccttcgctgattccgccatatctggccgagttggccaaccgcaccatcgaggccgcccgtcagcgcgactactccgtatacgtcaccacgtatgcagagggctcggccaaaggagcgcgtgacctgctcaagaacttcaactccaccgtgtcagacggcatgattctctccatgagcgaggtggaggatatttcgcccgaagacctgaaggtcgatttcccgctggttattgtcggtgcccgaaccacatggggtgttgccgaccacgtgactccggacgatgttgccgccgcagcaacagcggcaggctacctatacgatcgaggttcttctcgcctcgctgtagtgggcgcacgagacgactataacgcggccgctttgttgcaggctgtggaaggcaacgcacaactgcgtttgcgtggtgtcattgaagaaacgcgccgccgtgggcttgagctggatcctcatctgattggcaacaccgatcaggattggaccatcggcgctggcgctcgcgtgactcagcgactgattgattccggcgtgccattcgacggtgtgatcgcactgaacgatcagttggccatcggcgcattgaccgctctgcgcaccgctggttatgaggtgcccgcgcaggtgcaggtcatcggcttcgacaacaacgaggaagccccctacctgcagattccgctgaccaccatggattcccgccttgactggacagctcccacggcagtgaatcgcatcctcggacgcatcgatggcagcatcaccaaacccgaactgctcaccaccgaatcccaagtcatcgcccgcgcctccacacgctgacgctaatctggctcccctccctggggggagctgtcaccgaaggtgactgaggggagccttgcggaacattgtcatctcccgtcgtaactcgtaattgtcactcgtttgagtggccccatgtgtcatcggaggtagccgttcactccgctccgagttcgtgcatctctctcccccccacgataagagacgccgttggcgggttctagtgatcgttgcaacacctgacctaccgcaaggagggtcaggtgaccagaagccaccgaaacgaagaccgtggcggggaacaccgttggacgttcaacggcgtcgaatatccgacgaggaagctgatgtgcgaggcgagacgcgccgagtacgtgcgcctgctggacgaggaaggcatgaacttcacccaggccgcgcacgcggtcggcgtctcgaaacgcaccggcaaggcgtggcgcaacggcaggacgcgcgccacgggaaggaacgagaaacccctggtggactggtatcgttccaccatggacaaacccaagaccctccatccgcgctacctgagccaggaggagcgcatccagatcgcggaccgtctgcgtctgggcgattcgatccgcgccatcgcccgcctgctgggccgcgaccccggcacggtcagccgcgaggtcgagcgcaacaggaatcccgagtccggcggttacgagccttaccgcgcccagcagaaggccgcggaccggctcaaacgccccaaaccgcgcaaggcggccgagggcacgcgactgtgggacgagatcgccgccgggttgcgcaggcattggagcccggagcagatagccaaccggctgaggctggacttcccggataatggggatatgcacgcgagcgtcgagacgatctaccaggccatctacctgcaggccaggggcgaactcaagcaggagctgaaacgcgccatgaggcaggggcgaaccgcccgcagaccccaaggcggccaaggccgcaaaccccgtttccgcgaacccatggccatgatctcggagcgacccccggagatcgaggaccgggcggtcccgggccactgggagggcgatctcatcaccggcagccgcaacaaaagcgccatcggcacgctcgtcgagcgcaccaccaggttcacgatcctgctgcacctgcccgacgggcacgacgccgaacacgtccagcaggccatcatcgacaagatgcagcacctgcccaaactcctgcgcaacagcctgacctgggaccagggagcggaactcgccctgcacaaacggatcggcgcctcgctggacatggccgtctacttctgcgacccgcactccccgtggcagcgcggcaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaaaccaagcgagaagatcatcgaactgctcgacgccgcgtgataacctcaacaaccgacaacgtgaccatggaaggccgctcaaacctcaggtgttgcaaccaccactagaatctgccgttcaatcgtttagtgactttttgttaatttctgtgcttaagtagcaactttatgtgtgttttctctacgatctggtgtatattattttttggtttaccggtgtattgcacgcgcgatgtgtgaattgccgcaacatcgctgatatgcgtacatggaatctggaggaatgtatctgatgacggcatcaactgaatcgtctacgcaatcccatcatgatgagaaagaggccattgctcccgcgcgacttgtggcctacgcgctcggcaacttcggccagtcggcgttctacaacgcgctaagcacctacttcgtggtctatgtgaccaactcgctgttctccggagtggacaaggccgtggcgggcaagctcatcggcatcatcacctcgctgatcgtgatcattcgtatcgcggaaatcttcgtggacccgctgctgggcaacctggtggataacaccaccaccaaactcgggcgattccgcccttggcagctcatcggcggtctggtgtccgccgtgctgatcgtcatggtctacactggcctgttcggcttggtcaacgtcaacaccacgctgttcatcgtcctgttcgtggtggtgttcgtggtgctcgatgtgttctactccctgcgcgatatctcctactggggaatgatcccctccatctcttccgactcccatcagcgcggcatctacaccgcagccggcaccttcaccggatcgctcgggtacaacggtctgactatcgccgtgatgcccatcgtcaccttcttcagcttcgatgccggccagcagaaccagaatggttggaccgcgttcatcatcatcgtggccctgctcggcgctctcacggctctgagtgtagtgttcggtgtcaaggaaaaacagagcacgctgcgcaccaaggcccaggagaacggtaacccgattgaagcgttccgcgccctgattcacaacgaccagctcatgtggaccgctttgtcttatgtgttctacgccgtcgccaacgtggccaccggtggcgtgatggtctacctgttcaaatacgtgattggtcgcatggaccttttcccggtcaccggcgtcatccctattgcgtgcggtctgattatgtcggtactgttcccggtcatcactaggtgggtgccccgccgttatctgttcctcatcggcatgtccgtgatggtcgtggcctacctgctgctgattgtcgcctccacgaatataccgctgctgctggtggcactagtgctgttctacctgccgcagacccagattcagatgaccgtgatcgtgtgccttgaggactccattgaatacggccagctgaaaacaggcaaacgcaacgaagccgtgacgctgtccgtgcgtccgatgctcgacaagatcgccggcgcattctccaacggcttcgtcggcttcgtggccgtggccgccggcatgatcggttccgccaccgccgccgacatgacggccaaggacatcaccatcttcaagaccttcgccttcatgattccgctggtgtgcattgtgcttggcctgattgtgttcgcgattttcgtgaagatcgacgaaaaggcccatgcgcgtctggtcgccaagctcactgagaatcttgcgacggctggcgatggtggtggtaacgacgatggtgttggtgttggtgttggtgacaatggtgagcataatggtggccacgccagcatcgcgtcggaagattccgcattggcggaatacggtcccgaactcgccaagcgggtgttgctcggcaaatagtgttgctgtgcgaatgagctgtttcatggggtggtgattggcccatggggcggtgaattcctcatggggcggtggctgaaaatggctttattctgcggaaggtaaaattttaccgaccgccccatgggcaagttaccgccccatgggattttcgccgccccatggatgtacgggtaaaggcggccgaattgcctcgtgccgcccccgtggatatgcaagttaaagagcatcggcagcatgactgaatgcacatagagcgtcccccgcatggttgtgccacgttccatggcggggtcgccgtggtgactgtcgccagtacacgccatgccacgcgagcacgttgttgccggtgttccatggcggaaacgtcgtgggcatacaccttggatgatggcgacgacgattccaacacagtacccagtaaagtaaccgccgataacctcaagaaatacgacatcagcccgcaaggccaggccgatgagattcgcatggtcgccgaggccgtgaacaatatcggcgacaacgatggcgatggcgataagaccaacggtgcgaatggcaacaaggctactggcgtgctgagcaagaccggtagcgcggtgactgccgtgggtcttgcggtcgtcgttctcggtgcagccggcggggtctcgtttgctttgcgtcgtaagcgctcctgataaggactgactcggcattatgatgcggttgccagttgctggctgtcggctgtcgtctgccagatgcggctgtctcggcgtagcgatgcgattctgtcccggttcgcgcatcaatcgattgatgttaataccgggacagaaatcattgtcccggtttgaaaaaacgggcgtttttcgcgtaccgggacaattctcgttgccccgatacgagcgtcaatcgttttatgtgcgaaccgggacaacatgtcgatctcgggattgacggtattccgccgattctgcttgtcggggtatgtggactttgaaaattggtttgtcccggttctcaaaaatgggccgaaattgcgtaccgggacaacgatttctgtcccggtagaaacgtcaatcgattgacgttttcaccgggacaaattcgtgcccagaggaggggaagaggggctccgcaatggcgctgggcatcattgtggttggaggcaaattcgcgtccgggaacaatgggacgaggccccggtcgcaggagtagagcgtgatgttgtcatgattatgaccggctttcccacatggaaggccagtcataatcatgccgtttacccgcacgctccctgcacaccggccgcacatcacccacataaccgtgtacagtggcgtgtagtcgcagcaataaaggagcatcgcacatcatgaccaacggacacatcaaccccgccaacgtgccggacatcgccttgaaagacggtcattccattccgcaagtcggtctcggcgtgctacgtatcgacgatgagggtgtggtccccgtcgtcgaatccgcgttggaagccggctaccgccatatcgatggtgcggccggctacaacaacgaggccggcgtgggccgcgcgctcgccgcttccggatacaacaagggagccaagcgcgagaccctgtgggtcaccaccaagctgcgcgactcccagcagggctacgattccgcgctcaaagctttcgacaactcgctgaaactcctccagctcgattacgtggacatgtacatgatccattggcccacgccgttcgactggcgcagcaccgacacctggaaggcgttcgtcaagctgcgcgacgaaggcatggcacgcacgctcggcgtatgcaacttcatgcccgccgatctgaagcgtctgcacgaggagaccggcgcatggccggccgtcaatcagattgagctgcaccccacgtggcagcagcgcgaagtggtggcgttctgcaaggagcacggcatcgccgtggaggcctactcgccgatggcgcgtggcgccgacctcaacgccggcgacggcaccatcgagaagatcgccgccgcccatgaggtcagcccggcccaggtgattctgcgttggcacatcgaaaacggcacgatcatcatccccaagtccgtgcatgctgaccgccagaaggagaatctcaacctgttcggcttcgccctgaccgccgatgaacacgctgccatcgacgccctcgacggccccacccgcgccggccacgaccccctcaccttcacctatgcgtgattgatggcacgtcgtaacgcccacttccgccgtcgtttcaacgcttctggtccgctggagcgcgtgctgattctcatcgttctcgccgcagcaatcggcgtgaccatcggcctgctactgccgcaggtcagctccgacgcggccaaaatcacaggtggctacactgccaccggttcagccgccgacactttgaacgcgctcgccgtagacgacaaccaaagctcctccggctacgaccgcgattccttcggtttccgcaccaccgacgtcgacggcaatggctgcgacgtacgcgacgacgtgctcgcccgtgatctcacggacatcacctacaaatacgccggttcctgtgtggtcgagtccggcacactggccgatccgtacaccgctcagaccatccattttgtacgtggccgcgccaccagcgccaaagtgcagatcgaccatgtggtggcccttgaaaacgcttggcaatccggtgcgcgcgactggtccactgccaaacgccatgaattcggcaatgacccctacaacctgctggccgtcgacggcccggccaatcaggagaaggggtcggcttccgccgcctactggctacccaccaacgccgactaccgttgcgactacgtggcccgccagattggcgtcaaagacaagtaccagctcaccgtcacctcccaagaaaaggacgccatgctcgccgtcctccacacctgcccgggccaggccgtgcccgcagacgaataggggctaccgctcaggattgttgagcataggtgcctgcccctcgtcataagcgcgcaggagccgtcggagcaaaaatgtggtgaagtatggtgcggtgaacacgtgttcgctactaccgatattgccggcggatagtttcacgccgaactgaatttccggataagaatccgaagcgattagcgtccgcatggatttggcggtgccttttttcgatttcacctccaccggcaccagccattcgcgcgtgcggacgaagaaatcctgttccagtgtggaatcctcttttttgtagtagtacaggtcatagccggatttccgtagcgcttcagagacgatgctctcgtacatagcacccttatagacaccaagattacgattggcccgcagatcatcactggcctcgtcgtcaagcatcgctacgaacagaccggtatcgccgaaatatatcttgaacttgttttcgtcataattgcctttcaacggcagttcaggataggacatacatcggcagatattcaccattcccgaggtttcaagccattccacgcatcctcgatagtctttgaaacgcgctccgctggcaaccttgctgatttggaacttcttgttttccttggcgagttgcacgggaatatggttgaacacgttgagaattcgtgcctgatcgagtccttgcgcgtatttgcggatatcctcctggtagtccaaaataagctggcgctgcaattgcagtgttccctcgaacgtgccagtgcgtatatgggaggcgacaaccgcaggcatgccgccaagcacgcagtaatccataaatgccgtggagaagacgttcatttccacttcagagaatggcgtagcatcacacaggtgggtgaacatgctttcgatgacggcctcatcgtatccgcgagcccacagaaattcctcgaagtccaacgatcgcatttcgtagtcggtcttatatcccacgctattgctttcgatttgcttatagctgatgcccagcattgaaccgctgcaaatcacatcatatttgccgtcgattttaaagaacttcagtgcagtgacgatatcaggatgggcctggatttcgtcgaaaaagatgagcgtatcgcccggaatgaactttttagctgggttgatcagggaaatattgcggacgatggtatccgcgccataaccgtccgcagtgattgcgcgatatttcggttcctcaacgaagttgatttccactaccgaacggtagttgtgtgcggcaaagtaatcgatagtctctgtcttgcctacttgacgagggcccttgatgattagcggggagcgattcgggtcggatttccatgcattgagataggcatcggctttgcgtttgagatacatgaggagcccctttccgaattactgctatatcaatgattttacactttcatgagcgagttttctaccgtctggcacatttcatgagcgagttttctagtaatttcctcatttcatgagcgagttttcggcggtttgtcacatttcatgagcgagatggcggggaatgccagctgccagtccgccagtcatccatcaatcgtccgcagattgtccgtctgttgacgcgggaaacatgcccgcgctataactgagcccggtatgaagggagaagggaataggaacagacgatatggcagtaacacacaccgcagcagatgccattgcggcaaccactatgacgaacgccgtggcagacatcgaacaggaaacaccggaaatcgagaaggaacgccagcttgccggagtcggagccggagctggaaccgtggcaaacggcaagaaaaagccgcatgaccatgcgctggccagcatcctcggccccgcgttcgtggcggccgtggcctacgtcgatcctggcaacgtggcggccaacatcacctccggtgcgaggtacggctacctgttggtatgggtgctggtgctcgccaatgccatgagcgtgcttatccagtatcagtccgccaaactcggcatcgtgaccaacaaatccttgccggaactgctgggtgagcgtatgagcgatgccggccgtttcatgttctttatgcaggctgaagtcatcgccatcgccaccgatctggccgaggtgatcggcggtgccatcgccctgaacctgctgttcggatttccactgttcatcggcggtttggtgattggcacaatctccacggtgatgctgtggttccaaggcggcaagacacagaccacgttcgagcgcatcatcatcgtgatgctgctggtgattacgttcggcttcatcgcgggtctgttcgtagccccgccgaaccccggcgaagtggtcaaaggcatgattccacgcttccaaggcgccgactcggtgttgatggccgcctcgattctgggcgccaccgtgatgccgcacgccatctacctgcactccacgctggtgaacgaccattacgcaggcggcgaaaagccgtcgatcaaaacgcagctgagaggctcgaaaatcgatgtggcctgggcgctgttgctggccggcaccgtgaatctggcgatgctggtgctcgccgccaactcgctgcatggcatgtctggcacggattccatcgacggcgcacagcgggcgatcacgcaggtgctcggcccggtgatcggcacgatcttttccgtcggcctgctggcttcgtcgctgagctccacgtcggttggcacgtacgccggctcggaaatcatgcacggtctgctgcacgttaacgccccgatgtgggcctgccgcgtggtcacgctggtgccggcactgattgtgctgtggttcgccaaggacccgactcaggcgctggtcatcggccaggtggtgctttccatcggcatcccgttcgccgtgattccgctgatgcgatacacgcatgacaaggaactcatgggcaagtgggctgatggaaccgtcaagcacgtgatcttcatgatcgtcgtggcgctgattgtggcgttgaacgtgctgctgattgttctgacgctaatgggcagggcgtaatagactccagctgaaatcctgcgatagcacaacataataagaagccccggtgttggaaaccggggtttcttattatgttaagaatggttgaatctgccgtcagttcgcagccatacgccgcgcacgccgttcgcgcagcgcacgcaaggaaataatgtctcgcgtacgaccggcgccgtcgcccttgacgccgaagaacaccatcaacaccattgccagacagatcattgcggagatgcgcagcgcccattgaatgccaaaaatcgaagcggcgacggcggaggcgccgccctgcttatgcaaagcggcaaacgtttccatcagaatcaccaacacgggtgcgcccacagcgcccgcaatctgacgcgcggtattcgtcaccgatgatccggcggacacttcgctcggcccgttcaggcaattcagggaccacgtggtaatcggcatcagcaggaaacccatgccgatctgacggatgaactggcagatcgatacccaccagatccacgtatccatcgccaccagcgacatgcccaaggtgccaagggtcaacacaatcgaaccgaacaaagccacgggtcgtgcgccgaatcgatccatcgcacggccgccgaagaactgggagacgcactggccgatagcgcccggcaacatgatcaggccactcatcgtggcagaatacccacggtcggtctggatgtagagcggcatgatgaccagaatcgaactgaaggcgaaaaatgccagcgacgcggtaatggtgccgacggtgaacgaacggttcttcagcacttccaagtccagcagcggcggctgggggagtgccgacttgtcctcggctacggcctcacgatagcgcttgccggcgcgcaggttacgcagcacgaaccatacgatgccgatcagacccacaaccataggtccccacgtgaccggtgccgcgaatccataggtctctgaattggtgaagccgaacataagcccgccaaagccgatcaccgacaggcatgccgagaagaagtccgcgcgggccgaagggtcgtgtgaaccgaaattatgcagtccgaacatggccgccagcagcgagattacgccaatgatggtcatggtcaggaagatcgagcgccagccgttggcatcggtctgccagccgcccaaggtggggccgatggctggcgccacgctcatggccatgcccaccgtgcccatggcaaacccgcggcgagacagcgggtaaatggagaacacggtgatttgcagcaccggccacatcacgcccgtgccggcagcttcgagcacgcgcccgaccagcacccatacgaagtttggccccaaccatgccagcacggagccgagtgtgaacaccgccatcgagcagatgacgatctggcgggtggagaagcgtcgggtcagaaacgcggtcagcggcaccatcacgcccatgaccagctggaacacggaggtgagccactgcccggtggttacggagatgtggaattcggaaacgataatcggcagcgcggaactcagctgcaactgcgtgaagttgcccacgaaggtgatgaaggtcaatatcgcgatggagatgaacgccgcccggctgagtttgccgtctacatatgattcctcgcggctcagcacccgctgcagttcgccgcgatgattcttgattccctgagctccgttcattccactcacgtgcatactccactctcgctgatcgaccgcaacaacgcatcaggcggtctctcaaagcaaccccaacacgctacacccaggggtagtccgtggggtagtccgtcgagatgcaatgccgagatgactggccgcccggttgcagagcaaattagtcccgttattcgagacgtcaaaatgaacgtagttactatccgatcacgttcgctatgttggttttccaacaccccccccctagcggttaggggtgtgggcgggttctagtgatcgttgcaacacctgacctaccgcaaggagggtcaggtgaccagaagccaccgaaacgaagaccgtggcggggaacaccgttggacgttcaacggcgtcgaatatccgacgaggaagctgatgtgcgaggcgagacgcgccgagtacgtgcgcctgctggacgaggaaggcatgaacttcacccaggccgcgcacgcggtcggcgtctcgaaacgcaccggcaaggcgtggcgcaacggcaggacgcgcgccacgggaaggaacgagaaacccctggtggactggtatcgttccaccatggacaaacccaagaccctccatccgcgctacctgagccaggaggagcgcatccagatcgcggaccgtctgcgtctgggcgattcgatccgcgccatcgcccgcctgctgggccgcgaccccggcacggtcagccgcgaggtcgagcgcaacaggaatcccgagtccggcggttacgagccttaccgcgcccagcagaaggccgcggaccggctcaaacgccccaaaccgcgcaaggcggccgagggcacgcgactgtgggacgagatcgccgccgggttgcgcaggcattggagcccggagcagatagccaaccggctgaggctggacttcccggataatggggatatgcacgcgagcgtcgagacgatctaccaggccatctacctgcaggccaggggcgaactcaagcaggagctgaaacgcgccatgaggcaggggcgaaccgcccgcagaccccaaggcggccaaggccgcaaaccccgtttccgcgaacccatggccatgatctcggagcgacccccggagatcgaggaccgggcggtcccgggccactgggagggcgatctcatcaccggcagccgcaacaaaagcgccatcggcacgctcgtcgagcgcaccaccaggttcacgatcctgctgcacctgcccgacgggcacgacgccgaacacgtccagcaggccatcatcgacaagatgcagcacctgcccaaactcctgcgcaacagcctgacctgggaccagggagcggaactcgccctgcacaaacggatcggcgcctcgctggacatggccgtctacttctgcgacccgcactccccgtggcagcgcggcaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaaaccaagcgagaagatcatcgaactgctcgacgccgcgtgataacctcaacaaccgacaacgtgaccatggaaggccgctcaaacctcaggtgttgcaaccaccactagaatctgccgtgatgtctgtaccatgttgaaggggtaaccccgtatacacccgtacacaggggaatccagagaagtgagagccgcgagacctgcagtatacggtcgaaaaggaaggactggtgtctgaggtgtcgtatctgagcagtaacggtcagccgtctacgcgcagcagacaggccaatagcggtgaccgaaccaccgctcagctcagagatatccgccaaaagcagctcagccacgtgctgtactggcgattcttcgtcaatctcgccctcatgcttatcgacgccgccatgtacatcatcgccggagccacggtgctcaatctgcgccatgaggcaacgccgctctattcgagcagattcaatttcacgattgactccaccgtttaccttattattgtggcctgcttctgggtgtggtcgctctatgttgccggcatttatcaccgccatgttatgggtgacggttaccagctcaatgtgctgctggtcaaaggcatggtcgtgtgctgggtggtgcagtgcgcgttcaactacttctttaatctgggtctgaccctcacgtcgctctgcttggtggtgattgccggatggttgctcaccatggtggaacgcatcgccagccgtgcattcattacgcgtagtcgtcgcaagggcacctacgcttatggcacggtgatcatcggttccccgcacggcattggtcgcacgctacaattcctcggtcagcgtcggcaactcaactaccgcccggtggcagtatgcccgattcatctcaatcccgataccggattgattgaacagagcaccgaccatgagacactccgtgaggagatgcaaaagaacgaaggctgccagctgcccgtactcgagtacagcgatcataatcttgctgaacagattattgacatgaacgcgcagaccgttatggtggctgacgagctgcgtcgctattcggataattacgatatcttctccgtgcgcatggaatcgttcggtctggagattgccatgctggcttccgccgctgacacttctaaccatgagattcaggttcgatccatacagggcaccacgattatcacgcagcgtcttgcgcaatacacgccagcccgccgtttgaccaaacgcttgtttgatttggtgatttcttcgctagcgatcatctgttcgtcgattatcaccatcccggtggcgatcgccatcaaagtcacggacggcggaccggtgttctacaagcagacccgtatgggcctgcgcggcaagccgttccagatgtacaagttccgttcgatggtagtgaacgccgacgcgctcaagaaggagctcgcaaaagagaccggccagaccgaccgcttcatcttcaagatgaagaacgacccacgcatcaccaaggtggggcacttcattcgccgcttctccattgacgagttgccccagttcctcaacgtgtggatgggggatatgtccgtagtggggccgcgcccgccgctgcctgaggaatatgcccgttacaaccgtctgtacgccacccgcatgctggtcaagcccggcatcaccggtccgtggcaggtgtccggccgctccgatctgtccgccgaggaaagcgaggcccttgatgtggcttacgtgcagaactggtcgattatgggagacattgtgctgctgttccgcacggtgggtgcagtgctgagccataagggagcgtactgattccttcccgtttcgctgtcacagttttgccgcgcccttgccgcaccgcccttgaacgtgattacagaaagataagtcgatatatctatgactgattcgaacataccagaaatacctcagccgccggcaccctccgagcggtcggaaaacgcggatgatcgccaagtgatacagccgtatgttgaccctgaggtacttgctgaagacgcccgagcggcggaacggcgtaagcaccgccggcgtatgagccatgaacatatcaggcggatcaagcgcaaaaagcgcattcggatggtgctgattgtaatcggcgcactgctgttgattattgccgcgctcgcggcgtggcttggcctttccgcgctcaaagcgaaaaatgaagtggaagcagcgattcaggccgcaagccgcatccaatcacaagttcaagccggcgacaccgacaaagcgcaagccagcattgaagcattctcccagcatatcgacgctacgtatgtgcagaccaagcagccggtatggaaactggccacattggtgccctattacggttctgacgtgaaggccgcgcgagacatggtgcacattttggaagacgtgtcgaacaacgcattgccgaagcttgccaaggcggcacaggccttggatttcaacagcatcggtatcaaagacggaacgattcagctgggggatatggccagcgtggctcaggatcttgccgccgccaatggagtagtggcggatgccagcgtagacatgggcaagattggcgatacgcatattccgcagattaccgaggcggtgcagcaggggcgtagcaggttcaaggagcttgccagcctgacggatgcggccagtcggctggcggatgtgctgcccaagatgttcgacttggatagcagcgagggtagtagcagtggcccgcgaacctacctggtgctggcacagaacaatgctgagctgcgtgccacgggaggtattccaactgcgtgggccacgctcaccgtcgatgcaggcaaaatcagcatgagcacgttcggcgatccgcctcgggatggtctgttcagccaggatgaagccgcgagcgtactgacggcggaagaacgcaatctcttctccaccaagatggccacggactacccggacatcaatttcactcccgatttccccgcgtcgctgatatcgcgagtcagatctggcatcgagccggtcatgacgatgtggatggcgtcatcagcgtggacccggtgttcctgcagcggttattgaaggttgccggccccgtgacgctctccgatggcacggtgatgagcggcgacaatgccgagcagcggattctgaaccagatttatattgataccgatacgcaggcggagcaaaccgacttcttcacgatggcggccagtgagatcttcacgcatgtgctcaagaatgtggacggcaagaatcagcagctggtgcaaacgttccaggagtccgtatccgacggccatctgtatgtatggagtgctcatgaagatgagcagcggcgtatctcgggtacgaccatcgccggcgaattgcggtcgaaaccggctcattcggttacgggggtgtacttcaacgatgccactatgggcaagatggactggtacctgaagcgtgaagtgaccagtacatatgacaaaacctatcccagtggcgccaagcaatacaccgttcacatcaaactgacgaatacggccgatgccgccaaggtgaatgccgctccggatctattgcgcggctatgaccataacggcaacccccgtacaggggagatcgaaacggtgctgtacgtctacgccccaatgaagggcgcattgtggattggacccaggatttcgatcagttcgctgtgcacgatggactgacggtgggtgtgaaaaccgtgacattgcggccgggggaaagtttcgagaccacggtgcatgtgctggccagtcccgcggccaatgaaaatgaaatgattttgagacagaccccttggttgattaaaggggcaacccctatacattaaggtggaaccgtgaataaggaagaacggagcatagctgtggatgaagctgaacaggtgcaggatggtaatggagtcaccattctcgatttattcaatgcggtaagaaagcatgtgattaccgcagtggtcacgctggttattgtgatggtggcaatctgcgcgtacacctttacccgcactccgcaatacaccgcgacttccgaactcttggccacttatcgcagttcagcggctgcgtcgggcgcatccagcaatgcagtcgagctgagctctggcgccaattacatcaatagccagattcaaacgtatccgcaattgataaaaaccgagtccgtattgcagccggttattgacgatctgggtcttgacaccacggtaaaggaattggctgcgagcgttaccgcttccaacccggacggcaccatgctggtggatatttcggttaatgatccagacccgaagcaggcgtccagcattgccaattcggttgccgaaaacctgagaaaacaggttacttccacgatttacagcgatgagggcgataagatcatctctcccgtcaacctgactgtggtgcagcaggcgtacgctccggcttccccagctcacccaacgtcaagctgaatatggcgataggccttgtgtccggcattgttctcggcgtcatggtggcccttatcaaggatttgctggacacccgtgttcgccgcgattcggatgttactactgttatcgatgctcccgtactggggtcgctgagccgcaatgaggcttatgtcggtacgtcgccggtgattatctcccgcccggcctcccgcgaggcagaagagattcgacgtctgcgcaccaatgtgatgttcgtgctgcccgatgagccgttatccaatgtgattgtggtgacttccgccggcccgtctgaaggcaagaccacgctgagcgtgaacctggcgactgcatttgccgaaaacggcagcaaggtactgctgatcgacgccgatgtgcgcaacccctcggtgagcaaggccctaggcattgagggcgcagtgggcttgacccatctgattaccaaccgtgtatcgtcgcatgatgcgattcaacgctactggaagccgaacttccacgtgcttcctgctggaaaacaaaccatgaaccccagcattctgctgaattcccgcgctatgaaggcactggttgagcaggtttccggagcctatgactatgtgattatcgataccgcccccatgcaggtggccaatgatgccgccgtattcgccaaggaagggccggaactgctgctggtggccggcttgggagtgacggaaaagaaactgctccggcagaccgggcgcgaactgagcacactgagcatcgatcccgtgggcttggccatgaattacggcgagacggagaagccccagaagggtggctattactactacggcgacgagtccgatgacaacggcaggaagcgccaaatccagcacaaaaagagcgagaaaatgaagaaggactgaggccatgaggatcgcgttcatcggccacaaacgcattccgtctcgcgaaggtggcatcgagattgttgtggacgaactggctacacgtatggctgcacgcggagaacaggtcatagcgtttaaccgcaaaggccataatgttgccggtgcggtgttcgataatgcgtcgaatcagaatagcaagccgttcatgtatcgcggagtgaaggtaatacctgtcaccactatcgatgcaaaaggtctggccgcgctcacctcgtcattctttgccacagtaaaggctattatggcccgccctgatgtgattcattaccacgcggaagggccgtgcgtgccgttgcgttttgcgcactggttcggtattcgtacagtggccacgattcatggtctagattggcagcgcgccaaatggggtaaattcgcctctacgtatctgaaattaggggagcgtaccgccgctacctgtgccgatgaagtgattgtgctgagccgcaacgtgcagcgctatttcaaagacacctatgggcgtgatgtgcgattcattcccaatggcattgaacgcaatgagtctgttccagccaatgagattactcggaaatatggtttggtgaaagacgggtatgtgctgtttctaggccgtatcgtgccggaaaaaggcgtgcattatcttatcgaggcattcaagcaattggatactgataagaagctggtcatcgccggcggatcttccgattccgctgaatactatgaacagattcaatctgctgcggctaccgatcctcgcatcgtgttgactggttttatcgagggtcaggaacttgcggagttgtacagcaatgcttatatctatgtgttgcctagtgatctcgaaggcatgcctatgagtctgctggaagccatgagctatggcaattgttgccttacttccgacatccccgaatgcgccgaggtagtagaagaccacgccgttaccttccgcaagggtgatgttgcagatctcactgccaaactgagcaacttgctcactgacccttcccgcgtggcgcagctacaagcgaccgccgccaactacatcactcaaaaatacaattgggacaaagtagtggaccaaaccttggcgttgtaccaaggaaaagacccctctgacgagggggctcccggcggagccgggtggggagagcccaccacgaccatcaggaggcttcccaatgaaaatcctcctagtcaataaatacttctaccgcaaaggcggtgccgaaacctactttttcgcactcgccgaaggcctgaaatcattaggccacgaagttgccttcttctccatgcagcacccgaacaacgagccaagctattggagcaagtatttcgtatctgaaaaagactacgtcggtaaaatttccgcattccaacaggcaaaggaagcggcaacgctgatctattcgttggaatccaagcgcaagtttgaggcgctgctggaggagttccagccggatgtgatccacatgaacaacgtgcaccgtcagctgacactgtcgattctggatgcgccgtacctgaagaagcatcgtgtgccagtggtgtacaccgcacatgactacattctgctgtgccctgcatacaccatggtggacggcaacggcaaggtgtgcgacgactgccttgatcgacgtttcatccatgctgtgaagaagacttgcgtgaagggttccaaagccaaaagcggactcgcgttcctggaggcggagttcctgaaacaccatcacagctacgacaagatcgacaagatcatcgcgccgagcgagttcatgaagagcaagctcgacgagggcggctatgcgggccgtaccgtggccatgcagaacttcctgaccaccagccagatggatatggctcataaagtaacgaatacggacaaattcaacaccgtggacccgtattttctgttcttcggtcgtctctccaaggaaaagggcatccttaccttggtcaaggctttccttcaggccgcaggtctgctcccgctggcgggagctgtcgagcaaagcgagactgagggtggtcaccttgtagctaactgtctcccctccaattggaccctccacatcgtcggcgacggcccagaacgccaaaccatcgaaatgctcatcaaatctgccggctccgaagccgaaaatcgcattaaactcctcggctacaaaaccggcgaaaatctccagcgcgaagtcggcaacgcccgcttctctgttctatgctccgaatggcgtgagaacatgccgtactccggcttggaatccttggcagcgcagaccccggtgatcggcgcgaacatcggaggcatccccgaactcgtggtggaaggcgaaactggcttcaaattcgaaagcgggaaccaggacgatctggcccggacattgaccaaggcggcacaggtggacgccggacgctacgcctccatgcaggagtcctgcggccgctatgtcgaggaacggtgccgacaggatatgtatgtgcggcagctggaggatgtctaccgaggcactcgcaatgccgacggcatgtccgtggtttccggcgttgccgggaataggtaagttgacacgggccgtctgatagacgcgtggaagcagaggagagcaagaaaatatggtcgcaggtcattcaagtatcaaacgaatcgtccatcgtatcggtgaggagtgccgttccacggcggagatcgcccggctgacgtcatggccggaggcgttggagaccttcatggcgaaggtggacatccagatgatgaatcgcaacggattcaaagaaccgccggcggtgcgcaaccgtctggtacacaagcatgagattctcatgaagtacttcgagcagcgttatggccgcttcgccgatgagtatgacttccatgcccccatgcaggcgagcgaccccgctcttgaaggcaagatctggacgtgctggtggcagggcctcgatcaggctcccgaaatcgtcaaatggtgcgtggaatccatcaagcggaacgccggtggccgcgaggtcatcatcatcaccgatgagaactacgaacgctacgtgcacatcccccagtgggtgaaggagaagcagaaggccggcatcatcacgcggacccatctttcggatctgcttcgtttcatgctgctgtcgcaatacggtgggctgtggctggattccacgttcttctgcaccggttccttggaggatgtcgcgtttgcttcttccctgtggtcgatcaagcggccggattatttccatgcctctgtggctcagggctatttcgcgaactactcttttgcgtgccattccgataaacgttgggtattcgccgctattcgtgattttgttctggaatactggcgtaccaatgattccatggtggattatctgttcgtcgattacctgattacattggcgatacggcatgatacggcaatgaaggaagcattcgcggcgattccttccaataaccccaattgcgatgaattgttcaaagtattgggcaagccatatgacgaacgactctggggaaagataggtaaggagacctccttgttcaagcttacatggaaacaagtttttcctgtcgagcatgatggtgaaaaaacattttatggaatgttgaaaggcataggagattaataatatgcctatcctttcagttgtcataccctgttataatgcctcgtcgacaatcgaagaatgtgttctgtcggtcatggatcaatcgttaactgatttggaaataattgtggttgatgatggatctacggacgattctttagctatttgtcgcaggttagccgaggaagatgaacggatttccgtttatacaaaaaagaatgccggtcaaggcattgctcggaattttggcatgtcgcatgcaacaggggaatacatagcttttgttgatgctgatgatacatgtaatgttgagatgtacagggcgttgattgattcagctaaagaattcgacgcagatcttgttttctcgggatatagagacattaaagacgggaaagtggtagaagagcatccaaacaatagagaagtactccaagacgatgctgctattcgacaacacatggccgatcttatagcttcttctgcagggaatgttggttcgtgctgtgttgcggtctgggatggcatatttaggttatccatgctaagaaaatatggcatagaattcccttcagaaaggactgtttattccgaagatcttgtattcaagctaagagcacttgcattgtccaatacggtatctttccttccggatagttattatgaataccatataagcgaatcttcgtattcaagatgtattgatgtacatgttattgacaagcttatttcgatgtataaaataattgagtgtgaattttcggaaacactggatgagttctgtttctcatcaagaaacgcagcgaggctgtttgcctcgctccgttttgctttgcgtagcgcaccgttggataatggacgtttgtcgtttttcagagcagttgtctcaaatcaggatttacgagtttgtttagcgttatttaagccgaattctgccttggataagcttatatatagaacgtttttgaaggaagaatacatcattctttctctcctatttttatgtttccagctgaaagggtatctgaaatgaaaattggtgtcatcacgtttcaccgtgccatcaactacggtgctgcactgcagacttacgcactgcagagggccatatctgacctcggttttgataccgaggtaattgattaccggtgtgaacatatggaaaatctgtataaactgattggtggtttcaagcagaagacatttaagcagaatatcagagggtttattaatcttattccatcttggaagaagatgaatagtttccgctctatgattgctgggaatactaaattaagtcctgttgcgtatgattcaaagtcaatcgccacagcaaatcaacgctatgatgtattcatcaccggaagtgatcaagtttttaactatgcttgttcagattttgataagaattattatctttcgtttgtagaagatactaggaaaataaattcttatgcagcatcttttgggattagtgaaattcctcaagagtaccagagtgagtacacgaggttgcttaatagatttaatcatctctcagtccgagaagaatccggacgccgtatcgttcgtgaattgacgggaagagattgcgcattacatgtcgatccggttttccttttaaatgccgctgaatggtcgaaactcgcgaaagatcctggtattgataattacattcttatttatcgtttgaataagtcaaatattattgatgattttgctagaaaacttgcaaaaaaaacaggaaaaagggtcattaatattggtcaggacttgattgacaaagtcaagaatccagattttgaaggtaatcttagcacttccgttgaagaattccttggtctattcaagcatgccgattatgttgtgactaattctttccatggtacggctttttctgtaatctttaatcgtaagctatatgtagagacaaaacagaaagatttcaagaagaacgatagagcagagaatttacttaaactaactggtctcacagactcgattatcgagactttggatgattgtaatcttgatattgttcgtgattttgagcatgctcaatctgtactttctagcgagagagagtctgccttagattatctccggggaatttgttccaatgaatagtctgatatataagttaagaatctggctgagaacaactccaattgaagattatttcattccatgcatattgcttatattagttttttctactgataataagctaatattcatcacgagacagttagccattgtgcttacggctgctattttctgtttcgcattgatgtcgaaaaggaagtcaggtttatcctctgtcgtagagaaagtctacgtagcttttttcttgcttatctgcataagctttctctacacaggtgatcgcttaacttatagtaagtattttccttacgtccttgccatcttttctatgacgctttttgaattcgatagtaaattttttagttgtctcatcaggcagtttgaatttctgttctggatatttatcttttcgatgtatctagagttattggctcccaatctattttctttattcttcggttttcttgatcatggaagtagccgatctgcagttatggttaacactggtggcgctatttcgggattagcttatgaaaaaggttatgcagcgttcctatgcaacatgggattaggcgtgctatttgcaaagtttttcgtcagaggatttaccttagctagattgttccaaatcattggtgtctttgctgctttaatgatgacaggtaaaaggactttgtttcttattccagtgatgggacttatcgtatttgcgttgttcttctccaagaagcataagatttcaattgctcttggtctatcctttgtgctcgttgtgtcattaacaatagctgattcgcttattcctcaagtgtctcttgtattcgacagattgtttgcagataacggcgatcccttgagcggtagacaggttttttggacatatgccatgcagatgtttgaggcatctccgcttatcggcagaggctttctttcatttaatgcgtatataaatgctcaaggtttccgttattatgggttgctttggagctatcaagcccataacgtttatttacagcttcttgctgagcttggtattgctggttttttgctattcgttgccttgcttgccacgcttacctttggtctagttcgtagttttttgagttggaaagacagccaaggcttggaacctgttattcttcttactgcagtatactggattattctcatagccgtgtatagcttgaccggcaatacaatctactattcgtgtcaacttgtggtgctcggtatttgtatagctatatatcagactttcaaatttaagaaagcgttgcagaaaaatggaaccacttgttagtattattactccggcttttaacgcctctaagtatcttgtttctttcttcgaatctgtgttagaccaggaatattccaactatgaactaattttcataaatgatggttcaactgatgatacagaggaaattgcactacaatacaagaagatttttgaagaaaaaggtcatcgattcgtttatcttgtaaaagagaatggcggacaggctgctgcccttaataccggtttcccatacatgaagggaaagtactttatctggcctgactctgatgatactctatgctccgataatctgtcagtcaaagttgacttcatggaaaaaaatccgagtatcgatcttggtatcgcgtgggcgatacatgtggatgagagtggcaatgatttaggtgttctaaaaagaatacctgcggaaaatgataatctattccgtgatttacttgtcagtaataatgtgcagttctgtccaggtatatatattattagaacttccactttcaaaaagtgttaccctgagctgcatattgatgagagtcgagccgggcaaaattatcagcttcttcttcctatggcgtataagtatcgttacggttatattaatagagttttgtatacatatatcttgcatcctgccagtcactcaaatttcaagccgcatgatgagcaagcccagatggaacgttttgagagacaagagcatcttttgctgaggctcgtagaacatatatgtgtccaagatgataaggttgagatgattgctctggtcaggagacattttcaaggcatttatctgaggattgccaatgaacatattgacagaagaaaagctgcagcctccatgtattcgttatgtcgcatgcatcaggtgaattgtaaggatatcatctacgcattcgcaacttttgctggaatcaagcttaaatgaggggtgagcatcttgggaaggacaagcaaattcgttctcaatgcgatatcaactgcgcttcttcagatagtaactatggtagcagggtttattacaccccgttttcttttagtcgcttatgggtcagatattaatggtcttatctcatccatcaatcagttcattgtttactttaatcttgtagaggctgggttgtcaagtgccgctgtttattcattatataaaccaatagctgagcataattataaccaaatcaatcgtgttgtagttgctgcgcgaaatttttatgttaagtctggcttcatctttgtcggtcttgtttttctgcttgcatttgtatatccttggataacgcatacagaggtactggataagggaactgttttttgtctagtccttgtacttggcgtaaatggtgctcttgaatttttcactctggcaaaatatagagctttattgacagcggatcaaaaaacttatgtgatctccacggcatcaatcgtttatacaatccttaatactctcattgtcgttattctatcgactttgagagttgacatattactccttcggatcgtcgcccttatttccatatttgctagaagtctgatcttatatatttatataaagatacactataagtttattgattataaagtagcaccagataattctgccatggataagcgttggagtgcgttgtacctgcaggttgtgcagactgtacaaaatgcttctcccgctgtattgactacgttattctctacacttaagatggtcagtgtttattccgtctataatatggtgctcgctggaatcaatggtgtaatgtcggtgttttctactggagtatctgctgggttcggagagctcctagtaaagaaagacatgaaagcgttcagcaaagcatataaagactttgaatacctatattatatggcgatgagcatagtatacggtgttacgatggcaacgattcttccattcattcaggtgtatacaaaaggtgttaatgatgttcagtacgtgaatattgtttttgccgtattgtttgtcctcaatggggttttttataatctaaagacacctcaaggaatgctagtgattgcagctggtctctacaaggagacgcggattcagagcaccattcaggcgggtatcctggttgttggaggtgttgtcctcggctattcatttggtcttacgggtgttttggttgcctcttgcttgtctaatttctatagatgtgttgatttgcttttcttcattccgaagaatgttacgcatcttccgattctcccttcattacggcgaatggtggagacgctggtggtcattgtcctgatatgtgccgcttcatggctctgccttccgttccatccgaacactttgatgacttgggttggttatgctttctgtaatcttgtgttggcggttctgttggtaatgctgttccatgttctttttgagcgatcaaatattcatattgttgttgacagagttcgttcgattttcaagagaaaatagtacatgtctttgtggatcatattctatgaatgcatattccttaatttaaaactggctcgcttccttttttatagtgtgattaacgaatgttggttgaacagcattgtatagggtccggatttcaatattgctgacaatatgggcatatactctgaattgaatagaaaggatgttctaatgaatatcaaagatgaagtaaaaaagttaactccagtttttttgttggaaagaaaacagtggctgcatttaaaacatgaatcgctttatcaactgaaacgtttctataatgccattacgaatggtagcaataataatgtaaatcactgcatcgccaaggtaacgttctatagtcatcaaatcgaaaaaggattaagccatagtaattttcgctatggatttgggaagtcagctttaatgaatctttcctcagccttagaagatctgaaacgatgtgattctgactatccggaatgtgcggcttatcagagtgctgtggcagcattgcaggaataccgctataagcatgaaaatgctggttatcacatagatgatatgattgcgctttttccctcggacatctgggatgatgcttctgcatctgcttccgctaacggtggaagtgttccggttaaagcctcattgaaagatggaaatgccaccattccctttgagaacctgttcctaaaccgtaggtctgtacgcgaattttctgatagccctcttaccgaaaccgagattcaacatgtgattgaagtagctacgaaagcaccgtcggtttgtaaccgtcagccggttcgtgtgtacgcgattacgaataaatctgtaattgagaaagcgttgaagctacaaggaggctttaatgggtataaggttcccccggctttgttcttgatcacagcagacaatgaagcttttctttcgataagcgaacacaatgaaggttttgttgacggcggtcttttctccatggccttactaatggctatggaagctaataagatcgctgcgtgtcctttaaacactatgttctcaaaacagattgatcaacagacgcgtaatttaatcggagttcctgaaaacgagttcttgattatgtatattgctgctggacattttcctgatgaaacacatacatgtatttctaaacgatatcctgttcaggatattcttactatcgtcagatagtgtattctgaaatacagtacaaggttcatttctatgtttcataacagttcatcgccagaattgtgataattaagtactatctaccacttttttcattactggcatgtcgaagagaaaggttgataaatgaacggagtcaaagatgatgagctccataccatcgaacgtgtgatagcgtctcctgacgaggatgcgattggaggcacggctacatactgcataggatgtggttcgtgtgcggtaatagatccagcgtttcgcattgcaaaaaatgcagatggctgctatcgagctagtgttgtcggtgagcctcgtgattggattgcggcggagcgtgtttgcccattcgcgtcctcggtagacgagaaccagctcggggaggagctgtttagcaaacagtccggcgttaagtatgaccagcatctaggttattacctgagtgcttatgccggatatgtgtctgtggacggttggcgttcccggggcacttccggtggcatgatcagttggctggctgctaaaatgcttcaggatgggcttgtagatgcggtcattcatgccaaagatggtcctgatcctaagaatatgtatactatccagatctcccgtactgtcgatgagatcaaagcgggtgcaaaagcgaagtattatcctattgaactcagcgaggccattaaacaggtacgtgagcacgaagggcgttacctatttatcggccttccgtgctttgttaaggccgttcggcttttacgtcgtgaggatcctgtgctgatgaagcgcatcccctattgcatcggcttgatatgcggacatttgaaatctgatttctttggacaagccgaagcatgggagtcaggcgtgcctcttgacaagattgcacgtgtggacttccggcacaagacttccggtacacgtgcctcggattatgcaattgaggtgcgtcgcacggataaggatgagcctatcgtcaagcgcattgccgaattgtctactgcaaactggggactcggctatttcaaatacaatgcgtgtgattactgcgatgatgtgcttgccgagaccgctgacgcgactttcggagatgcatggattcccaaatatgtgtcggatgacaaaggttgcaatgttatcatcattcggaatcaagccattcaggatttgtttaaccggtataggaatgaactcgtcctgcatgattcggatgccacggaagtctatcaatcacagtccagcggattccgccatcgtcgccaaggtctagctgagcgtctgtacatccatcaacagcgtggcgaatggacacctaccaaacgtattaagccgtcccttgatggaattcctgaacggcgtcagcgggtttacgcaatgcgcaccattttgaaaaatgagagctttgtagcattccgtgaggccgtcaaagccggggatttcaccgtgttcaacaaacacatgaaacccctcgaacgtaagtactggcgcgttagtatccctttcaagaagcgtatgatgaacctcgtcaaacgagccattaacaaactaggccgaatccttaaaaagctctaatttccgccgcgaatatgttccgatgttctaatgccgataatcggaatggattcatatcgataggactaccattttggtgcaggggctgcgggcgtctttttaagatagccatgcagcccctattactgtgatgcgtacaatgataaggggggtgaagaccaaagtgcgcaaaactttgggccctaggggacacttgcaggtcgggtgcgacgttgtacaacgccatgcgcatctgcccgtagctcatatgggcagacaagggtaagagagatgccggttccacggccgtccttatcgggaggcttctgttttctctatgctcggtcgtcataggtctgttcctccgacggtgcggctctgcgaatgaaatcacccatgccgggaacggtgaatgccaagagcccacgttctggcgaatatgccagcccggaatcgatgatgccttttctgacccgtacgacatccgcaggtggccgtcccagtcgttccgcgatctccgccgagctgcacacgcttttttcgagcgaggccatggccctcatgtattcccgttccagtgggcgggcccgttgccagcgtgattcgtataggccgctgtccagtgatgcctgcgctatgggttcgcccttgatgacggcggacaatgggattggtgatgattcggattcatcgaaggctgcagaaccatatgcctggatgaaatacggataccccttggagagctctatgagacggttcagggcatcgtcgtcgaatcgcacattgattttgccgatggtcttttcgaagcattccctggtctcgtcttcggggagccgtccgattcgcttgtactggaacaggcgttcggcgtaggagcgtgatttggtaagcacgccgggaaggttgggcagtcccgccgcgatgacgtagaagggcagatcctcctgtcccatgctgtgctgcagtccgatgatggtgcccatcaggtcgctggacatcacttggaactcgtcgatgaacaggaacaggcccgatccttcctttttgagttcgcggcatagttcctcgaccatcatttcgagtcgcagcgagtcgctggatatgcctttgtcctcgttgccgagcccgattgacgttttgattaacccgagttcgagggaaacctcgttgacgtgtttgagggagtcgagcattttctgtcggagcgttcctcttctctcgcgcagtatcgctttggagatgccgtcgaagaggagttcgtagtcgtgggtctcgtttcccgtggcttccatgcggacggtaatgagtccttggccggcggccatgtctttcattctcagcaggagcacggtcttgccgacgcctctcagcccgctgtagaccagtccgcggtcggagtatcccgcttttgttctggcgatgattctgtccatgatttcgagttcctgctcgcgtcctacgagttccttgggttgtcttcccgctccgggcgcgaatggattgagggcgtgcatcgcttctttgcgtctggctaaatccacggtgttcatgtgcggttcctttggccttccataagttctaggtaaaaatatacacttatatacacatatatacatgaatatgtgagttcaagcgaactgatgctacgccggctcgtccccgtccccatcaaacttgtgctcatcctcgtaggcaacgatgtccatatcgcctcgatggagtttcttgagtgtttcagctactcgcgcctgctcatcatcaacaatagggcgctcgccggctaagcatgtgagaccatcggatactgcggaaaacactgccgaacccgcccaacaaacattgaagcaatacattttttatttgcttcgttactgcgtattctgcactccacatgtgcgaaacgttggaattccgccaaaattttatttgcctggtatttgcttgggtgggtcgcaaagcgcggttgcggcacgattcttagtggtggtgccttatggcgtcgggctttcctcgcaaatcgaggtaaggaaactggcccttaacccggaatttgaaaaagtaaaaggtccctggctgttcaccagccagagacctttttggtaacaactgaggttgaggaaacctcggcagttgggtccaacggggcgaaagtctgtggcgccgccgagaagattgccccgaagctagcgcgacctttctgctacaacacagcataccagcatccatcgaaccttatcttttacgggttccggcccctcgtcttcaatcagggcaccgtttcaaggcagaagaatcaggcggccttcttgcgaccgcggcgcttcatggtgccggcggtggcattggccgcatcgaagatcacggtcttgctttcggggtaggcggtaccgttgacggactggtaggcgatttcgccttccggagcctcgggcagagtgaagtatgccttcactgcttcaatgagcgtggcttccttgacgcttaccgaagcagcctgcttgccttcgggcttgctgaacttaatggcgttgtcggccttggcggtggtcggggtcacggcgatctgcctggtcttgtcgttaatcagcaccttgacgtacgccgggaatccgagcacttcagcggtggctttgttgaaacgaatggcggaatcggtgacggtcagaacggtcttgcccaccggcttgaccagctgaacctcttcgaatccctgaagcaatgaagccataattgctctccttattgcattggtcacgttttttttatttacgtcactaattgtaaccagctaatttcgcattatacaaaccatatgcatgcatgattgcataattgaagaacatttgacctacgtattgcgctccccgaatagcactgatttaaccaataccaagaaaagcggaaacaagaacccgcaatatcagccgtattgaatatagaaatatgcaatttcaacatcgcaataactgacggtctttttgctggctctattcgccgatatcgcattcaggccacagcgccgagcataatatcgacgccgtgcttgatttccgcatacacgcgttcaaacacctcgcgtgattgacgatgagggtcttcggtttcgagtgccgtaggcaaaaacggccgcagcataggtacgcaatccatgatttcgatgagcctgtctgcggcggtatcgccggcaatcggaccctcggcatgcatatatttgcaagcgttcacgaagtcattgaacagaaatactttgcgaatagccagtggattctgttcaagcaaatcggaaatttgctcacgctcaaaacacagaatcaggtcggcttgccggctgatatcggtggtgagaggggtggaagaatgggaattcgcgtcaatgccgtcgttcttcagcaaatcgataaccatcggatcagcgggatgcgggggatagtgcagagtacccgcgctgcgcacggtgatattgccgctctgcaagccaattcctcggtcggcaagcttggctcgggtgtagtattcggccatcacggaacggcattgattgccggtgcatacatacatgatttgcataacaacgtcccttctcaagtgttgtgagcattccctcatatattccagtgagcattcctcgcgaatatgcgtgcgttatgtaccgtagcaataacatgaaaaaaccgggaatcatcgactcccggttcagtggtattcgcgaactatgcttcagcgtctactgtttattatgtcagtcacgtcagcgacgagtggtgttcttgcggacggcgaacagggcgatgcccgcggcggcaagcagcacaacggccacaccgtacggtgcgatggccgcaccggtgttggcggtggtagcagtcgtggtaccggactggtcaccggttccggttgccggaacctgaatggtggcggtcttggtaccggatacagcgccaacagccttgaccgcgatggtcttgccagcctggctggccttgaacgtgtacagcaaagtcaaggaaccatctgccttggcagtgaacgtcttggatacttcagcgatctgctggacgtcggcgacgatggcatcatcgtagtacacggtgacggattcattcggttggaatgtgcctgcagggaacgtcacggtagcggtggtgccgctgtaagtaaccgttgcaccgtaatcatcagccatggcggtattcgttgcgaaaccaaagcccagaactgcggcgataacggccagcacggccataatcttcttcttcataacttcgaacctccacaatagaaccggttactaccgatgagaaatcggttcttatcaatagaaaatcggtcttccttcaattacaacccccaaccatacacccccctttgtcggtatataaggggtaattatgttaacggataaggggggtgacaacgtggtcacatcatgtgacaacgttcgaacatattgtcgccgcattaccgttgcggcggggtctcctgacgttctgaaaacgttgctattccaacgattgcggtgattggcgatacgtgcatggtaaacaacagggaaatttttttctgcgacacgccgacgggctactcggattctgattcgtactcgtcgtcaaaactgaacaggtcctctacggtggtgccgaacacccgcgccaaatccatggccagacgcaatgatgggcagtattgcccctgttccagccttcctatggtctcacgtcgcacgttgaccagatcggcgaggtcggattgcttcataccgcgttggagtcggtgaagtttcagactagtcttcatcgtcgcctccggtgccggtatcgtgttccagccatagatatcgaatatcggaaatggccaaggcacacatggccaatgcgggcagtagcattggcggaataatgtgaactatcgagcggtcaatcagattcagtgtggtgtagatgaaaccgacaattaccagaatgcccaccaaactgaccagcgcgaattgcatggccgcgctttgatgcatatcggaaagctcgtcgcgtcgcgggttctgccgtcggaatacagtcatgccccatacttcgccgccgatccacaacagcgccgcgatcgctgccacgattactccgagcaggttattgccaataagagccatcagcatgcaggcaatggcacctatggattcaaggatggcacgaaagcaaatataccgattaaaggtcatggccgtctccgtgaattatgcgagcgatattgaattgcatacgcaattataaagttagggggtaaccccttgtgtggtggttaggccaaccggcggaggctctttgcgtagaccgagaataatcgcaatcagtaattgttatgggcgatccagtagttgtacgctgcgacgatgccgccgtagcgctgctcgcagtagctgatgaaccacttgaactgggtcttgtagttggtctgccagtccgcaccggcggaagccatcttgctaccggggtaggcctgacccaagccataagcaccagacgtggggttggtggcggtggggctccaaccggactcgtggttgatgatgtagttcgcagcggtgaagtccgcttcgctatacccgttgtccaacagatactgatgcgcccaggactgcacttctccagccggaacagtggtgccgagatcggccgacgacggcgacttggtggaaccagtgcccactaggatcaccttatccaccggggccttcttgacccatgaggcgaatacgttggaagagacgaccttgtcgccggctcgcttgaccagcgaggtggtctccataatgcccttctggccctcggtctcgaccttttcctgacccttgggcaggctgctggtctccttgcgcacttcattgaaggcgatctcggtatcgttggtctccacatcggcatccgcgcgattaatggtgaccacggtggcctcggtgaccttggatttcagcgagggagatatggcatcatccgggtcaagcgtgatatcacccgtctccagcacgtccttgacggtggtcatgttggctttttcgccaagtactacgcgcgaatcgccattaatcttcaccgtaacgaacgtggtgttcttgtcggcgctgttgattgcgccacgagtggcagaacgggatgcggccgaatcggtggcggagaacgaagtgatggtggaaatcggcttcacatcatcagcatggtagaaactgcgcgacaccaatcccgccgtgccgagcagacctgccgcggccaccacagccgcgatcttcatccactggcgcttgttcaacggcctgagcataagggttggcttggcatgtctcgtcattgcgctccttgatcggatttcacactgcccaccatgataggcggcgcagtggatgaaggaaaatcaggctcaggcctgctggtcggcaccggactgggcggccttggcggcggccagatcgagtgccttggcctgggcgatcagatcgtcgagatcggcggcctgcagcgcgccggcctgctggaagatgacctcgccctgcttggcgatcatcagcgtgggcaccgcctggatgccggcggcctgggccagatcctggttggcgtcgatatcaaccttgacgaaggcgatgttcgcgttctccggctcgttggaggccgcctcgaaaatcgggccgaacgcgcggcacgggccgcaccaggtggcccagaagtcaacgaacacgatttcgttgtcggtgatggtcttctcgaaatcggcggaggtgatggcggtggttgccatgatgttcccttcttttgtgttttccttggcgtcgccgtacggccctcgtgcgtggccgccgggcgattgccttattcatgcaatacgtcttggcgcttggagccgtgcggttcgtggccgtcggctccctgctggctaccagcttcccagcaccacccaacatttgtgtcgtattttccgccgccggccaaacgtttcccaagatttcgctggaaggtgacgcgcggcgcgctgtgacgcgcaataatgggatgcatgccagtcatgaatgatgaagtgcccgacgagggcgattatgatgccggccgtggccgcggcgaattcgacaacatcacgcccgaggacttcatccacggaggcggttctggccatggcaacccgccgggctggctggggccgtccgacatcaaccgggcgcgccatcagatgcccatcgcgtatgtggagatcgtgcccgtacgcaccgatgagatgggccgcatctcccaggtgggctcgctgctgcgcgtatccgatgacgggtcgatcgaacgcacgctgatcaccggccgtgtgctgtaccacgagacgctgcgcgaggccatcgcccgcaatgtggccaaggacctgggcgacatcgccctgccgctgctgccggtcggactccagccattcaccgtggccgaattcttccccacgccgggactgagcgaatactacgatccgcgccagcacgccatcgccctgtgctacatggtgcccatcgccggcgactgcaagccgcaggacgagacgctggatgtggaatgggtggatcccaagagcgacgtaatgaacacgttcgtggcgcagatggtcaacggccacgggcgcatcgtgcggcaggcgttggcctgggccggaatctgacagttgttttgccttccgttggcggggatggcgcgtagcgacggagggcggtccgctttgagaccgctcccagccgactgtgtcgacagctccgccagtggggcgcgaatgtgaaggagtaacgacaatggcaatcgaattggccaatcatatctaccgcgacggcgaaggcgtgccggtggtgctgatgaacgcctacccggtggaccaccgcatgtgggacgtgtgcgcgaaggcgctcgccgatttcgccgacctgaacgatgtgccggacttcccgatttgggctccggacatggccggctccggcgcatccccggtgccgagcgacgccgattcgggcccccgcatggcgaacggcgcgtacagcgaggcgttggatcgcctggccggagcctacgtggacctgatcaaggccgccggctatgagcaggcgatttgggtcgggctgtcgatgggcggctacgtggcgatggacatccagcgcctgtaccccgaaacggtggccggactggccttgtgtgacacgatggccgcgtccgacggcgtgggcggagagaaccgactgaagatggcggacgccgccgaacagacgaactcggtcgaaccggtgatgcacttcgcgcagccggccgatggcgattccaccgtcaagaagactcctgaattcatcgcgaccatgaccggctggatcaacgaacagaacccggctggtctggcctggcgtcagcgcatgacctacggacgtcctgaactggggcggtgccggaaacgatcagcgcaccgagcctggtggtatccggcgaactggacccctccagcaatccgagtgtgatgcggccgctcgccgaacgaatcaccggcgctgaattcatcgatattccggactgcggccatttcagtgccgtcgaacatccggataccgtggcgcgagcactgctctcgctcgtcaagcgcgtgcagagcgcgcagaagaacgcataggagacttcgatgaccgctgacattcatttctcgcctctggcactgacccatgcgctgccgttcctgccgctcgcacaaggtgacatcgactatcaggtggaccggcgcagcgaacccggcctgatcgacgagctgttggccgagccgaccaccaaagtcgtgcttacgcgcggcggacttgtcgccgtaccgcgcggccaaggcgagcttgtggactatgagaacgtgaaaatgcggctcgccacgttgccgggcgcctatgtgtccgccgaactggcacgctaccccgaagcggtcgccatgttccttggctcctatgtcggggcgcgcggcgaatccgtggtcgccgtggatatcacgcgcgtgccggaagccggcgttcccggtgttggcgggattgccggtgttggcggtgccgtcggcggcgtgctcggcacccaggattccggcactgtggacggcgcgctgggcaagaacggcatcagcggaggtgctgccgccggaatacggcagccgggaaacgccaagggtaatggcggcgtagccgcagccaaaatcgccgggccgctcggtgtaccggattcggccgggcaaggtgcggacgatgccttcgatgattcggtcggcgcgcccgtacagcccttggccccgaagcccacgctgctgcaacaggccgtgacccggttcgactgggtggacctgcgcggatttgcccctcactccaacgcgcgcgaggccgggcaagccaccagtgccatcaccttaagcatctggcacagccgccagcggttctgtcccacctgtggcgcggcggtccggccggcgctcgccggatgggcgcagcgatgcaccaacgaggcggacggcaaccgtgtgctgttcccgcgcgtggagccggcggtcattaccgccatcgtggacgggcacgaccgtctgctgctgcaacacaacgcggcatggaaggattcgaggctgtattcggtgtccgccggatttgtggaggcgggggagaaccttgaacacgcctgccgccgcgaggccatggaagagaccggcatcaagcttggcgaggtgcggtacctgggttcgcagccgtggccgttcccggcttcgctgatgatggcgttcaaggcacatgcgatcaccaccgacgtgcgtgtggacggcgaggagaccatgaccgcgcgatgggtcacacgcgacgaatacacggccgagctcatcgccggccgtatggtggcgccgggccgcgccaccatcgcccgctacatgattgaggaatggctcggtcgcgagctgtgacggaccgcgaagataggttaggcttatgactatgagtgatgacaacgaaaacgaacagccgctgaatctcgacattcccgaccacctcgaatactccgaggagcatgcgtgggtggaccgttcggtcgaccccgcaatcatcggcatcaccgaatacgccgccgaccagcttggcgaacttgtgttcgtggatctgcctgagcctggcgcccgtgtggaggccggcgacgagatcgtggagcttgaatcctccaaggccgtccagccgctgatcagccccgtggcgggtacggtcaagtatgtgaaccgtgacgtggcggacgacccgtccgtggtcaacggcgatccgtacggcgaaggctggctgctgaaggtcgagcttgacgacgatgagccggagctgctgagcgccgacgaatacgcgaaggtcgtgcggtagttccttttgagctcccctctctgaggggagccaagaaaatgaggcgtatggcctatattggtgtctatgagaagcccacgcgaggattttgaggcggcaggcaagcgactgccttgggatgctgctgcttgcaatgcagcgctgtccgccaccgcgccagtctctgacgtcaaggcatccgccaatggtgccgacaatgccagcaacgctgaacattccgatgacatgcccaccgtgccgattcccgcacgcaaggctgccacgacgttcgacaccccctccaagcgtgagcgcatcgaagtcaagccgccgatcacccgattcatacgtcgtgccgtcacccgcgtgttcggtgtatggtcacgcatctccactcaggtggtgcgccaatgggactggtatccgcgagtggaaccctatgtgggttatggtaccggcgattactcgcgtctgatctgccgcacggtatacgcccccaggcacgcgcaatccggcgaactgatccgtggcatccgcggcatgcttgccatacccgcgccgcgcacccacgtgcaggccagcattgatgacatgccgctcaacaccgtgcagatcggtgtctccgaggtctatgacaaggtggaccgcacgcgcgatctcggcagcgaatacgccatctccgattccgccggatatctcgacctcgtggccgagcatcgtctggtgcccggcatccatcgcgtctcctacagcgtggccaaccgcaaacccgtgagcgccaacctgtacaccatccccgccagtgccaaagtcggcatcatctccgatgtggacgacaccatcatgatcacgcaggccccggtgccatggaaggccgcgtacaacctgctgttcctcgaccccaagaagaaagcctccgtgccgggcatgagcgtgctgttcacccgcatcgccgacctgttccccggcgcaccgttcttctatctttcgacatcgccctggaatgtggagagttcgattcgcaacttcatcactgaccatggttttcccgaaggcccgctgctgctgcgcgacctcgacccgaggcccaagaccttcgtacccaccggcccccagcacaaacttgagtttgccgaacaacttatggccgacttcccagacatgaagttcattctggtgggcgatgacgggcagaaagacccgaccacgtacgccaccatcgcccgcagatatcccggacgtgtactggcgatcgtcattcgtgagttgagcccgcgcgaatcaaccggattggcgtcggtgacggggctcacctcgacccagccgactccggtaaccgatgtgccagtattcaccggcaccacaggctcgaacattctgaagaccatgctgccgtatctgaagacggtgttgcgataggcgcggcgtgatgaacactgaatgcgtcccggtgcggtgcctcgcctataatcgcgtggtatgactgacgagagcacaaacgccgcggccgcgatgccgccttacgccaagcgcgagccgaagcgccgcgaattccacggtgacgttttcgaagacgattacgagtggatgcgagacaaagactccgatgatgtgcgcagctacgtagctgccgaaaaccagtactgcgagcgtcgcatggcgcatctggcggatttccggcatacgttgtttgaagagctgaaatcgcatgtggaagagactgatatgtcggttcccacgcgcgtcaatgattactggtacttcacccgcacgcagcagggcaaacagtatggcgtgcaatgccgcatccccgtgcgcgatgccgatgactgggacccgccggtcgtggatccgcaaggcgcgcccggctccatgcccggtgaacaggtcgtttttgatgcgaacaaggaatccgaggggcatgacttcttccggctcggcggcttggatctgagcaaggacggccgttggatgctgtacggcgtggatgttgcgggagacgagcgatatgatttccgcattcgcgaccttgccgggctggagaccggggagccggtcagcgaactgcccgaacagttcaccggcattggcagcgcatgcttcacgccggacggccaatgggtgttctgggtggaattggacgattcctggcggccgctcgctgtgtggcggcatcgtgttggcacggcggtcgaatcggatgtgtgcgtgtaccgagaaaccgatgaacggttctgggtgggcgttggcatcagttttgatgagcgcaatatcgtgatcggcaccggttccaaaaccaccaccgaagtgctgatgctgccggtggccacgcctgaaggcgaattccaagctttcattccgcgtcagaacgatattgaatatgatgtgagctttgcctgttttgaaggcgcgggggagaacggtgcggatgtgccactcgccgtggtctatcacaacgctgccaatccgaatttcgaaatcgacgtcattgacatgcgtggccatgagccgccgtaccgactcggcgaaggcgtgtgcattgccgccgggtcgccgtacggctgtgaacatggtgagccggataagccgattaccgaggcatacttcaacgccgtcaatccggcgatattgcagggtgcccacggtctgggcatcgaaggcatcgcgttgcatcgcaactttgtgtccctgagctaccgtgccgacggccagccgcacgtggcatacatgaccaagagcgcggctgccgccgacttcctggccggacggccgtggcggtttacggaattgctgccgcctgccctggaggacgactgggacatggttgccgacgatcgcgaaaacttcaccggcgatcatggcgaaatcttgtggaccgaagatgaggcccccacggatcacacgtcatcttccgatggtgctagcgacgaccacctgcccggtgagacccggcgcttgtacaccatcggcgtcggcggcaacccctcgtatgaggcgccgcgcatgcgctactcgttcgccagctacacccgcccgggcgagttgcacgaaatcgatcccgccaccggtgaagatgcgctgctgaagcgagccaccgtgttgggcaacttcaatccacgcgattacatggaacgccgtgtgtggattaccgcgcgcgacggcgaacgcattcctgtttccctcgtctggcaccgcgattgcccggcgcaggattcgccgatgttcattaccggatatggtgcatacgagatttcctccgatccggggttctcggtctctcgtctgagcatgttggatcgcggtgtgctgtacgccgtgccgcatattcgtggcggcggcgaaatgggacgcgcctggtatgagcaggggcgcagactgaacaagaagcattcctttgaggacttcgtggacgccacacgcgcgctgcagaaggcgcatttggctgatgcttggcgcaccgtggccaacggcggatccgctggcggcctgctgatgggcgcgattgccaatatggcgcccgaatgctacgccggtgttgaggcggatgtgccgttcgtggacgcgttgacctccattcttgacccggacttgccgttgaccgtcaccgaatgggacgaatggggagacccgttgcatgaccctgaggtgtatcagtacatgaagtcgtacacgccatacgagaatgtgccggtcgccgtgctcgagggcggcaacgacgaggctgccggtgacggcagtgctgatggggcggccaccggcgcggtcgccgccgcgcaattcccgagaatcttcattaccacctcgatgaacgacacccgcgtgctgtacgtcgagccgctcaaatggctggcccgtttgcagtccgccggcgtggacgcggtggccaagattgaggtcgaggccggtcacggcggtctatccgggcgttacaagcaatgggaagaggtttcctatgagaacgcttggtgcatggatgtgatggggctcgctcattaggccatgtccactagctgagcgggttcgggccggcaggtgatagcgcgagtaggctccttgaactatggcaaagacatataaaatcgccgttattcccggcgacggtattggcaaggaagtcactccgtgggctcagaaggctttggaaaaggccgctgaaggcgtagctgacttcgagtacgagaacttcgacttgggtgccgagcgttatctgcgcgatggtgcgattctgcccgaggacgaagaggagcgcatcaaggccaacgacgcgattctgctcggtgccgtgggcgatccgcgcatcaaggccggcattctggaacgcggcctgctgctcaagctccgcttcgacctcgaccagtacgtgaacctgcgcccctccaagctgtacaagggcgtcacctcgccgctcgccaaccccggcgacatcgacttcgtggtggtacgtgaaggcaccgaaggtctgtactgcggtgccggcggcgcggtgcgccgcaacaccccgcaggaggtggccaccgaggtgtccatcaataccgcatacggtgtggagcgtgtggtgcgttacgccttcaagctcgctatgaagcgcaagaagcacgtcaccctggtgcacaagaagaacgtgctcgtcaacgccggtgatatgtggcagcgcatcgtcgacaaggtcggcgaggaataccctgaggtcacccacgactaccagcacattgatgcggccaccatcttcctggtctccgacccgagccgtttcgatgtgattctcaccgacaacctctttggcgacattctgaccgatgaggccggctccgtggtgggcggcgtgggctactccgcctccggctgcatcaacgcctccgacgagttcccgtccatgttcgagccgattcacggttccgctccggacatcgccggtcagaacaaggccaacccgaccgccgccatcctctccgccgccatgctgctcgagcatctcggctttgatgatgcggccaagaagatccataccgccgtcgaagcggacatcgaggagctcggctccaccgtgcgctccaccgaccaggtcggcaaggacattctggcccgcatgtgacctcaaacctggctcccctcgctgaggggagccagaaaactctctatactgagttgcatgcaaatgcgacatggggaatgcaaaaccgttggcagcaaactagtcgccgtgaccgtatccgtcgatgatgacggcaccgcacagtcatgccatatcagcggtgatttctttattgaatcagtttcggatgccgaatcccatgctttgttgcatgacctggaacgagctctaattagcgatgattcattgcggtccgtattggacgctcatcctagttgccaaattatcggcacagatgaagttgccatcaaaaccgcatacagccgagccgtaagcagcaacttacccccgctggcgggggctccagcgcagcgggtggggtgggcagccccgatgcgccgaacatcccagcatccatcaatacacaaaccaagcagcccgacaaaagctctgaataccgggagcgctggaacgccctcaagcctcaactcaccgtgatccacgaccatccgcgtactccggacgagcaaatggccattgacgagacctgggcgcgtgaagtcgcagcaggaacacgacagccgaccatccgattatgggagtgggcgggcccggctgtggtcatcggccgtttccaatcggcccaggacgaggtgaatctggacattgccaagcagctcggcttcgacgtggtacgccgttgcacgggtggcggagcgatgtttatcgaaccgggcaacaccattacctattctctgtatgcgccgctcgatttcgttcagggcgtaagcatcgaagaatcctaccggctctgtgactggtggctggtcgaagcgctgcgcgaacttggcttggatgtgcggttcgcgggcctcaatgatatcgcctcgcagtacggcaagatcgggggagcggcgcagcggcgcttccccgtaggctcaggcggcgcggtgctgcaccatgtgaccatggcgtatgacatcgatgcggccaagatgagccgtgtgctcaacaccagtcgcgagaagatgtcagacaaagcggtgaaatcagcggtcaaacgcgtggacccgatgaaaagccagacgggtctcagccgcgaacacatcgtcgagcaccttattgactggtttgcggcgtgatttcaccgatggccgtatacgattttgccggtggccgtgcgcggttttgtcatgggcgagcgcggtagccgcgacagtgccgtttttcgcggtaacgcattcgtcagcatgtcgtacggctatcggatcgtgccacacatgaagtgacgaatgagggcatgctcctgacgaaacctgtggggcgcgttacaatatgacggatgggcgacgacggtcataggacaataaggatggtgcgatgagcttggaaacgccaaacgcttttgctgacgaggaaaacatcctgttgcatacggcattgttcaagcaggtatcgccagccgaagccgaggagctgttgccgcatttgaagcatgcgacgttcgataaaggcgactatatcttctccgaaggcgataccgatcagcgcatgtatttactggagcaggggcgcgtcaagctgattcgcacttcttccgatgaccgcgtgcagctgctgtccatccacgcgccgggcgaagtgcttggcgagattccggtattcgaccctcatggtggcccgcgcaccgcgtccgcggtgtccatgagccatggcacgcgcgtggtctggctggagcatgatgccctgttcgcatggcttgatgagcatccgcgtgtggccatcgacatgttgcaggtcatggccagccgccagcgcggcaacaacgaacgcatctccgacttggtattcatggatgtgccggcgcgtctggccaagacattgctcaacttgggctcacgtttcggcgagccggtggaacagggcctcaaagtgccgcatgacctgactcaggaagagctggcccaactggtgggctccagtcgtgagaccgtgaacaaggcgttgatggacttttccaaccgcggatggatcgcacgtgacggccgatcgatcatcatcttccagcccggtatgctgattcgacgctcgcggcgctgaccgttcggctgacttccagccaatgttacgctagtgcgattcttgtgatgatatgttcacgggagctgaccgtaagcccggttggtagggcaccccatttagaatggggcccatgcccaaaaagaagtccctcactctccaacgtgtgcttgttctcctcttggcctatatcatgcttgccgtctgcggcggcgtggcggccagcgtgttgtttgtaccgggtgtgatcggtgccaataaagccgccaaagcggtgattccgtcgctcaaggtagaaaacgtggacttcgacgtgactagtctgccccagaagtcgacgatgtacgcgcgagacggttccaccgttatcgcgacgttctacaaccaaaaccgtatcgtcgtgccgctgaagaagatttccaaaaccatgcagcaggcagtggtggcgcgcgaagaccgtcgattctggactcacgccggcgtcgacgtgcaaggcgtgatgcgtgcgttcgtgcagacctacctcgtcaaaggctcccagcagggtggttcgtcgctgacccagcagtacgtcaagaacgtgctgctgatgcaggcgatcgaggatgacgattcgatcgcccagtaccatgccactgaagacaccatcgcccgtaagattcgcgagatgctgatttccgtgcagatggaaaagaagtattccaaggccgagattctgcagggctatttgaacatcgcccagttcggcaacaacctgtatggcgtggaaaccgcggcccagcgctacttcagcgtgtccgccgccgatttgaacgtggtgcagtccgccaccatcgcggctatcaccaagaacccaagcctgtatgatccgctggtcgaagagaaccagaaggaaagcgaaaaccaacgcaatatcgtgctcaagctgatgctgcaggaaggatacatcacccagaagcagtacaccgaagctgtgaacacgccgttgaaggacacgctgaaagcacaggacgtgaatgtcggctgtcaggacaccggcgattacgcgtacttctgcgattttgtggtgcatcgcatccagaactccgaagaattcggcaagactcgtgccgagcgtaacaagctgctgcaggagggtggcctgaaaatcgtcaccacgctggatgtggaagcgaattccacgatgatggagaccgcgcgtaataccattccaccggacgatcccagcggcatggagatagccatggccgcagtcaaaccgggaaccggcgaagtgctgagctttggcctgaatcgttactatgacgccactccggcagccgcgaacgatcccaccaagacgagccagaactatgccgtcgatttggcggatggcggtggttctggttggaccatcggttcgtcctggaagccgatcaacctgattgcgtggatggaagcgggccattccatcaacgacaacctccagacctcgacgtcataccccactacggacttcgcctgcagtaactattcgggcggtgccgattcgtggaacgtgtcgaacgccatgggcgcaggtacagtgaacccagaaagcccattcctcggtctggtccgttcgcataacactactcaggcttccatgggtgccatcctcaaactgtgcaaggtggcggacaccgcgactgaactgggataccatgacgccgccacgggtgagaccatcgacaaaacccaggtgtatacaccatccatgatgatcggctcggtgaatgtgtccccgctgaccatggcgagcatcttcgccgtatacgcctcgaatggtgtgcaatgcaacccgattgccatcagcaaggtgaccgataaggacggcaacgatctcaaggttccatccgcgaactgccatcaggcggtggataaggacatcatccaaacactcgcttataccctgaaccaaggtacggtgcggccggatggtgccggttggtcattcagattggctgacgggcgtaagtcgtttggtaagaccggtaccagtgaggatcttgcggtgtccggtggatcgttcattcctaatcagattgcggcgttcgctgtggtcggcgatgcacagaacccgtacaccaaccgtatttccaacattgccatcaacggccggtacaacagctattgggatggttcgacaatcgcggctccggccgttaccaacttcttcaatagctacatttccaagaagaaaataccgattgacaacgattacggccagcccgtctcgaagtacaccacgactggcaagtatctgggcattggcggacgaacgttcagcgtgccgcagaccactacgaatggcaacagccaatcgcagagcagcaacaatcagtctcagtcgcagaacactgggcaaaacaacacccaaacccagggcaccaattcagagcagtcgaatgatggccagtgattggtgattggcgtttgacatttggtgattgcatgccggctgagtctgcgtaacatggccgactgcgatacccaaattacgtagtttgcgggcgttacctgtttcaggtgacgcccgttttacaatacttaatgacaacgccatcgcgttcatcgaatatttgccatgaacgtgcatcggaaaggggaacgatgagcaacgacgatctgacgcatgagaattttgattttcgtggattcgacgtgccggatctcaaagcggtgacgctggcttcgtcttcggacggcgatcagtccaagcagccgaagaccaagcacgaggatgcatcgaagaaccgtaagcacggtaagaagaagtcaaaatccgatgcacggtccaagaagcgggccggcgcgggcaagacgagcgaatcgttcgatgattatgaggattatgaggaaagggaagctgtgagcaaggcagataagaaagtcagcaaggaccgtccggggctgtttgcgccaatgacgctgcgcgaggtgaccgtgcgtaatcgtatttggttgccgccgatgtgcacgtattcgtcgttcgcccgcgatggtaggcccacgccgttccactaccagcattacgtgtctcgcgcgttcggcggattcggcatggtgattgtcgaatccaccgccgtggctcctgaggggcgtatcacgccgtgcgatctgggcctgtgggaagacgggcagattgatgcttggcgctggatcgtggacggtattcgcgaggcgggtgcggtgcctgccatccagctcaaccatgcggggcgtaaggcttcgactggttgctttgccgttggttacgacggtcagaacgtgccggaggaggcgggcggctggcctaccatggcaccgtctgaaatcgcgttcggtgggttgcgtacgccgcgcgcgctgtccgtggatgagattcatggtctggtcggcgcgttcgccgtggcggcgggccgtgcggtggccgccggcttccaagcgattcagattcatgccgcgcatggctatctgatttctcagttccttgacccgctgagcaatgagcgtgatgacgaatatggtggcgatttgaccggtcgctctcggttcctggtcgaggttgtggatgccgtgcgtggggccgtccctgagggcgtgccggttctggtgcgcatttcggccacggattgggccgccggcggttgggatttggaccagaccatcgcactatccaaggtgctgaaggagcatggcgtcgatgtgatggacgtgtctaccggcggcatcatgtcgggagtgtcgattccggtcaagccgaactatcaggtgccgttctccgagcaggtcaaggccaaggccgatattccggtgaccgcggtgggtcttatcaccaagccgaagcaggcggccaagattctggcccatggcgaagccgatgccgtggagattggccgcgccgcattgcgtgatccatactggccgttgcgtgcagccaacaagctgggcataccgtccaccgagatcccctacgccccgcaatacgtggccggtgcgtactaaatcctcatggggcggtaactttcccatggggcggtaaaaccctcatggggcggtaacccaaaacggcggtattctgcggaatgtgaaatttggctaaccgccccatgggacaatcaccgccccatgagggttttaccgccccatgggtaatagggcaatatgtgagttcactccacgtccacgccgacggcgtcggagacgtgctcgaatccgtcgcggcgcagcagctgggccagaccgcgcttcaacacggtaatctgctgcgggcctcggtacatcagcgaactgatgaacatgaccaagctggagccggaacgaatcttcgcataggcttgctcgggggtaaagacgccaccgatgccggcgatagcgaaccggtcgccatactctttatacaccttgcgaatcagctcggtgctggcgttggtgcacgggccgccggacaggccgccctcccaatcgcgcggaatctcgaggccggtgcggtccttctgcagattggcgatggacagcccctgcacattgtgatcggccagcacatcgagcagctccttgtactcgccccacggcttgttcaacggcatcttgaccagcgtgggctgcgggcggtcgatcttgtcgagcgccgtaaacagacggtcgagcgcttccggagtcgcggtgaacggttcgccgacgtgcgtgttcgggcaggagacgttgacctccaccatcgcggtgcggccggcggcgcggcgcatcgaaatgcagtaatcctcaatgccttcgtccaaatcgccgcactggtcgtcgttggtgcgggcgatcgacacagacagctgcatctggcgggcctgagtccaagccttctcggcgcgctcgatgaccttgtccgaaccgatgttggcgaggccgacgtgcaccatcatcgaatcgtattcaggcagacggtggaaccacggcttggcgttgcccgggcagggacgcgaggtggtggagcctacggtttcaaaaccgaagccggcatggtccagcaccacgggcatgtcgcagttcttgtcgaggccggcggacaggccgaacgggttggtgaaatcgacgcccatcacattcgtttccagaatggggtcggtgtagtcgagcatcagctgctcggcgagcagcagcggcgggacgttcttgacgacgtggcagaactcgatcatctgatcgtgtgcctcatcggggcggtggttgaacacgaagttcggtttgatgatgtgcttgtagccgaaggtgaacagatcggtggtggctttgttgacggcgtcgtgccagaagctttcagaaacgtaagtcataccgcctattgtctcacgcttgggctggtgcggctaggcgattcctgcctaggcgaattggggaaggggctaccgcgtgtcgaggcgcacgcaggcgtcggctcggcagaagatacatgaatcgggatgcaccaggtatcaggcgtgactcgccgctgagcaacgcgctcgggagagtcgtcggtcgtgagtcatcgcgctagtggtcgctgcgagaatatcggttcgcacaatgtgcgattttgcgcggttttgtggaaatgaacacctgaattgcccgggattttcgagagattgtccccaaaacgctcaagccggtttggtttgtgagcttttgtgtgcgataatgttcgcatgatttcgtcacaacgtcagcacctcatcttgagcaggttgcgcacacgcggggcagtgcgcattacggcgctatcgaaggaactgggtgtgtcggcgatgaccatccgccgcgatatcgccgaacttgccgacaagggactgttgaagcgcgtccatggcggcgcggtgactaccagtaccttgctcagcgaacccctgttctctgtcaagtctcagatggatatcggcctgaaggacgccatcgcccaggaagccatcaaatatgtggctcccggcgatgtaatcgccatcggcggcggcaccacggcctatgtcttcgcccagcatctgctcgaatcgcagcagtccagcggcatcaccatcctcaccaattcgattcccgtggccgagctggtccaggccctcgaatccaaggatgtggaggtgatcgtcaccggcggcgtgatcacccgatcgaactcgcttgtcggcccgatcgcggacaaggtcgtcgcttcgctgcgtgtcaacaccgtattcctcggcacccactcggtgtcgattccccgtggcttcctgatgccgaattcgctggaagccgcaaccgatatggcgatgatggacatcgccgatcgcaccatagttttgaccgatcacaccaagtggagctgcacgtcgctgtcgctgtttgcgcgcttcgaccaagtggacacggtcattactgacgacgggctcgaccccgactccgccgccaaaaccaaggatttagtaaaggagctcgtgctggcccaccagagcgagaccattgaggaaagtgagcaaacccatggctgatttcgccaactacacccccggggagtatgcgaaggagcacatccgcatcacgccgacgacgcttgccgacggccgtgacttcttctacctggacgacgaccccgagttcgtctccggtgccaagacccgcgagctcaaggacccgcgcccgctggactaccgtttcgccccgcacctggacgccgacggcaacgaagtgccgtacgccgccccgcagatgcgccgcgacccgctgaccggcgactggatcccgatggccaccgcccgtatgaaccgcccgatcaccgccggccccggcgccaccgccaagggcaacccgctggccgcccgcaagcccggtgacccgtaccaggacggcgaagtgccggacaccgactacaacgtcgtcgtgttcgagaaccgcttcccctccatggtgcgcgtgcccggcgtctccgaggacgtgacctacgttgacggcaacccgctgtgggagaagaagctcgccgccggccgctgcgaggtcatctgcttcgacccgaacgaggacggcctgccggccgatctgccggtctcccgcctgcgcaccgtggttgaggcttgggccttccgtaccgccgaaatctccaagatggaaggcatcgagcagatcttcccgttcgagaaccacggccaggaaatcggcgtctccctcgctcacccgcacggccaggtctactgctacccgttcatcgccccgaagatggagaaggaactccagcacaccgaggcctaccacgagaagaccggcggcaacctgcttaaggacatcatgaacgccgagctcgaagccggcgaacgcatcgtgatgcgcaaccacagctgggtcgcctacgtgccggccgccgcccgttggcccctcgaggtccacgtggctccggtgcgcgacgtgctcaccctcgaccagctcaacgacgaagaacgctgggacctcgcctccatgtactcgcacctcctgaagcgcggcaacgccttcttcgacaagggcgacggcaagggcatggacctgccatacatcgccgcctggcaccaggccccgatccacgacgcccgccgcgagaactaccgcctgaacctgcagttcttctccttccgccgcgccgccaacaagatcaagtacctcgccggctccgaatccggcatggccgcctggatctccgacaccacgccggaactcatcgccaagcgcttccacgagctcggctccatcgacatcgccgactgatagaaagaaaacatcaatgactgctgttgaattcattgagccgctgacccatgaggaaggcgtctcgcaagctaccaagctgttcgtcgacacctacggcgctgcgcccgagggcgtgtgggctgctccgggccgtgtgaacctgatcggtgagcacaccgattacaacgccggcctgtgcctgccgatcgctctgccgcaccgcaccttcatcgctctgaagccgcgcgaagacaccaaggttcgcgtcgtctccgacgtggctcccgacaaggttgccgaagctgatctcgatggcctcaaggcccgtggcgtggacggctggtccgcctacccgaccggcgtggcctgggcgctgcgtgaagccggcttcgacaaggtcaagggctttgacgccgctttcgtctcctgcgtgccgctgggctctggcctgagctcctccgccgccatgacctgctccaccgctctggctctggacgacgtgtacggccttggttacggcgattccgacgccggccgcgtgaccctcatcaacgctgccatcaagtccgagaacgagatggccggcgcttccaccggtggtcttgaccagagcgcctccatgcgttgcaccgaaggccacgcgctgctgctcgactgccgcccggagctcaccccgctggagaacgtctcccagcaggagttcgatctcgacaagtacaacctcgaattgcttgtggtcgatacccaggctccgcaccagctcaacgatggtcagtacgctcagcgccgcgccacctgcgagcaggccgcgaagatcctcggcgtggccaacctgcgcgtcaccgccgacggcatcgccaaggccgacgacccgttccaggcgctcaaggagacgctggacgcgctgccggacgagacgatgaagaagcgcgtgcgccatgtggtcaccgagatcgagcgcgtgcgctccttcgtgcgcgccttcgccagcggcgacatcgaggccgcgggccgcctgttcaacgcctcccatgattcgctggccgcggactacgaggtcactgtgcccgagctcgacgtggccgtggacgtggcccgcaagaacggtgcctacggtgcgcgtatgaccggcggcggcttcggtggctccatcatcgcgttggtggacaagggtcgttctcaggaagtcgctcagaagatcgccgacgaattcgaaaagcaaggcttccacgcaccgcgcgcgcttgccgcgtacgcggcgaaatccgcttcacgcgaggcatgataataaatcacaatgctaaatggcgggtgtcttccctatacttgggtagtcacccgctttttgtatacgaccagggagagccatgaacaaggcaatcatcaccgtcgtcggtcaggacaccgtcggcatcatcgcgcgagtctgcacctacctgtcccagcacaacgtcaacgtgctcgacatctcgcagaccatcatcgacggttacttcaacatgatgatgattgtcgactacgccaacgcggacaaggacttcggcgcgatggtcggcaaccttgaggacctcggcgacgacatcggcgtgcgcatccgctgccagcgtgaggaaatcttcaccaagatgcaccgtatttgaggcggcccgctcagcaggccgcctcacgcgaggaggtggaaagcccggtgggctttccactgacggagccatccttatccctctgatgagggtgaccgccaaactagtctttaaatatcctgtaaggaacaaaccatgctgaacatcatggaggtccacgagaccaatcagatgatcgagcaggagaagctcgacgtccgcaccatcaccatgggcatctcgttgctcgactgcgcctcggacgatgtcgacaagacctgcgacaacatctaccgcaagatcaccacctatgccaaggacctcgtttccaccggcaaggccatcgaacgcgactacggcatcccgatcgtcaacaagcgcatcaccgtcaccccgatctcactggtcggtgccagctcctgcaagacgagcgaggatttcgtcaagatcgcccacgcgcttgacaaggcggccaaggaagtcggcgtcgacctgatcggcggctactccgcactcgtttccaagtccatgaccccggccgaggagctgctcatccgctccctgccgcaggctctctccgagaccgacatcgtctgctcgtccgtgaacgtcggctccaccaagaccggcatcgacatgaacgcggtcgaactgctcggccatatcatcaaggacgttgccgagcgtaccgccgacaacgactcctacggctgcgtcaagttcgtggccttctgcaacgtgcctgacgacaacccgtttatggccggaggcttccacggcgtcaccgagggcgacgcggtcatcaacgtcggtgtctccggccccggcgtggtctcccgcgcactcgatgcggccaagggcaaggacttcgagttcctgtgcgagaccatcaagcgcaccgcgttcaagatcacgcgcgtcggccagcttgtggcccaggaagcatcccgccgcctcggcattccgttcggcatcatcgacctgtcgctcgccccgaccccggctgtgggcgactccgtgggcgaagtgctagagaagatcggcctcgaacaggtcggcgctcccggcaccacggcggcgctcgccatgctcaacgaccaggtcaagaagggcggcatcatggcgtcctcctacgtgggcggcctgtccggcgcgttcatcccggtctccgaagacaagaacatgatcgacgcggcttcttccgattgcctgaccatcgagaagctcgaagccatgacctgcgtgtgctcggtgggcctcgacatgatcgccattccgggcgatacctctgcttccaccatctccggcctgatcgccgacgaggccgccatcggcatggtcaaccagaagactaccgccgtgcgcgtgatcccggttgccggcaagggcgtgggcgagatggcgaacttcggcggcctgatgggctacgcgcccatcatgccggtcaaccagaccagctgcgaggcctttgtgacccgtggcggtcgtattcccgctccgattcacagcttcaagaactgattcagtagggtatctgccttcaaagaggtacatttgcgcagataggtatctgctttcagaggggtacctcaatcaagaaaccccgagtacaagcgttgatatttcaacgcctatactcggggtttcgtcctttaacagcccctcgaagcggcaatagacctccggcagatgccaaatcagcccctcgaagcgccgatagacccattttctgcgatgatggtcgtgctgcgaggctcagggtttcctctctcacgcctgtcggcgttcgttcggcgtcgctactcgaaggcccaccgggccttctcctcagcgccctccagcgaagttgagttggcgccaggcttcgtagatggcgatggacgcgcaattggtgaggttcagggaacgcaaggacgggcgcatgggcagtcgcacttgttcggccacatgagggccctccatgatgtccatcgggtcggggatgtcgccgggctcggggccgaacagcaggatgtcggtcggcttgtattccacctcggtgtacagcttggtagcatgtgcggtgaacgcgatgatgcgcgaattgggcatggactccaccaggttgtcgaaattcgggtgcagcaccacgtgggccatgtcgtggtagtcgaggcctgctcggcgcagcttggtgtcgcgcaggttgaaacccaacggctccaccaaatgcaggatggtgccggtcaccgcgcacaggcggatggccgagccggtgttgccgggaatgcgcggtgagtagtagcacagatgcggtgttacggtttcggtggtggcggccttttcagccgagagcatctcgtccaccacggagatggggttgccatgcgcgtcggttacgagttcgtccggtccgtaattcgatttacggtacccgtactcgaacatcttctcgacttttgtttcgggattctgtgcgttctgcgaattctgttctgcttcgttcgtcatagctgctaagaataagaacgatgaacgacacagcaatttctttgcgattgggcgcatggtgggaggccaatgcgcgcgatttgccatggcgcttcggccgggccacgccgtggggcgtgctggtatccgaagtcatgagccagcagacgcagatgagccgtgtagtgccgtactggaccgactggatggaacgttggcccgacgcccgcgccctcgccgaggccccaaggccgaggtgatcaccgcatgggggcggctcggctatccacgccgcgcattgcggttacaggaatgcgcccgcgtggtggctgaagattacgccgacaaactgccgcgcacgtatgacgaactcactgcattgcccggcatcggcgattacaccgcctccgcggtgatgagctttgcgttcggcgaacgaattgccgtgatcgataccaacattcgccgcgtgctgagccgcgtgttcctgggcgtcgaatcgcgcgggggagcgaccagcccggccgaacgcgcgctggcgaaccgcatgctgcccaaagacgagattctcgggtgcgatgctgacgtcgccgataatgccggtagcgccgaacatgtcgtgaacagcactatccgtggcggcaaacgctctcgactgcatcgtggcgagcgcccatcggtcacgtggaaccagtcggtgatggaactgggcgcggtgatctgcacggccaagtcgccgctgtgcgacacctgcccgattgcggacgactgtgcatttctcaaggccggccgccccggactgggggagcgccgcacccgcccacgccaacgattccaaggcacggatcgacaggtgcgcggtctggtgctcgccgcgctgcgcgagcttcccgctggagccacgttgcccagggaagatgccgacaagctttggaaggaccagattcagcttgccgcctgcatcgccagccttgacgatgacggcctgatagagattctggacggcggcctgcgactacccagctgacattgtgaaaaatggtgggctccccaagcgtgtatgggcgtggtgaccgtagactggaagagttatggcagtgcagaggaacacatcaggcgcgagaacggcacgcggagccggcaccggggccaatgggccatccggcgggccctcccaaaacaaccgttccggcaagccgcgcaagcgcaggatcagcaaaaagcagcaggccatctatcgtcgtcggcgtatcgtggccggtacggtgctgctgctgataatcgcgctgattgtattctgcgtgtatagccttggccggggtatcggtgccgtgaactcgatgatccaccatgacgaggtgtatgcgatttcccgcgacgccacgccggcgccgaagaaagtcagcaacgtcaaggattgctcggccagtgatgtgacattgcagctttccgcggcctcccaatccgtgccggtaggaggatcgcttgatttcaccgcgaccatcgtgcacgaggggtcaggcaactgtttagtggacgggtccgattccggccgtgtgctcaccattacttccggtcaggaaacgatttacaagtccgatgtgtgcccggcggattcacgtctgctgctgatggctaagggcgataaggacgttcagaaggtcacgtggaataccaatgcgaacgccacgctcgccaaatgcacggatgagtcaggttgggccaaagtcaatgcgggaacgtacgtggcgcagctgagtttgaaggatcatccgaaggtgaagagcgatccggtgacgtttacggtgcagtaaaagtcttgccttagcgctattcttttgactttgcatgaggtgtgtcatattgcgggcatgccgtcgacaatgaagcgtccgcataggcatatggtggccatgccggcgctcccaggggaattaccacatattagcgagcgataaggaacgtccattggctactgagtctacgacgaacaccaccaccatcatcgcacgcgccgaccagcatgatattgacctgcacaaggcgtcggatcgcgtgaacttcggttccatcaaggaacccatcgatgtgccctacctgctgggcgtgcagaccgacagcttcgattggctgatcggcaacgaacgctggaaggcgcgcgtcgaggaggacgaaaagaacggcactaacaccgtggcccacacctccggcctcgatgaggtcttcaacgagatctctccgatcgagaacttcgctcagaccatgagcctgaccttctccgatccgtacttcgaagagccgcgtcacaccgtgcaggaatgcaaggagaaggattacacctactccgcaccgctgtacgtgaatgccgagttcgagaacggcgacaccggcgagatcaagtcccagaccgtgttcatgggcgatttcccgctgcagaccccgcacggtaccttcatcatcggcggcaccgagcgagtcatcgtctcccagctcgtgcgttccccgggcgtctacttcgaccgccagcaggatcgcacctccgataaggaagtcttcggcgcgaagatcatcccgagccgtggtgcatggctcgagttcgagatcgataagaaagaccagccgcaggtgcgcgtggaccgcaagcgcaagcagtccgccatcgtgttcctcatggccatcggcatgaccaagtccgagatcgcccaggcattcaaggactacccgctggtgctcgacgcactggagaaggaaaccctcgagacccaggacgaggccctcgttgacctctaccgcaagattcgtccggccgacaccccgacccccgaggccggcaagaatctgctggactccttctacttcaacaccaagcgctacgatctggcccgtgttggccgctacaagatcaaccgcaagctgggtgtcgaggccgatttcaacgatcgttccctccaccaggaagacatcatcgccacaatcaagtacctggtggccctgcacgacggtgcggcgaccttcccgggcaagcgcaacggcgaagacgttgacctgcgcgtggacgtcgacgatatcgatcacttcggcaaccgtcgtatccgccaggtcggcgagctgattcagaaccagctgcgtaccggtctgagccgtatggagcgcgtggtgcgcgagcgtatgaccactcaggacgccgaggccatcaccccgcagtccctgatcaacatccgtccggtgaacgccaccatcaaggagttcttcggcacttcccagctctcccagttcatggatcagaacaacccgctgtccggtgtgacgaacaagcgtcgtctttccgcactgggccccggcggtctgtcccgcgaccgcgcctccatggaggtgcgcgacgtgcacccgtcccacttcggccgtatgtgcccgatcgagtctcctgaaggcccgaacatcggtctgatcggctccctggcaaccttcggccgcgtcaacccgttcggcttcatcgagaccccgtaccgcaaggtcgtcaacggccacgtgaccgacgaggtcgagtacatgaccgctgaccgcgatcttgaccacgtcattgcccaggccaaccaggagctcgacgagaacggcaacttcgtgcagaagtccgcccttgcccgagtcggcgaagaagaggcggtcgatgtgccggtgagctccgtggactacatggacgtctccccgcgccagatggtctccctcggcgcctccctgattccgttcctggagcatgatgagggccaccgtgcactgatgggtaccaacatgcagcgtcaggccgtgccgctgatcgaatccgagcgcccgctggtgggcaccggctccgaatggcgcgccgccaacgactccggcgacgtcatcaagtccgagaaggacggtgtggttacctacgtgtccgccgacctgatccgcgtgatgaacgacgacggcaccaccagctcctacaagctggccaagttccagcgctccaaccagaccacctgctacaaccagcgcccgatcgtccacgacggcgagcgtgtggaagccggctcggttatggctgacggccccgccatccagaacggcgacctggccctgggcaagaacctgctcatcgccttcatgccgtggaacggctacaactacgaggatgctgtgatcatctcccagcgcctcgtgcaggacgacaccctctcctccatccacatcgaggagtacgagatcgacgcccgcgaaaccaagctgggcgccgaagagatcacccgcgacctgccgaacgtcggcgaggacgctgtggccaacctcgacgagcgcggcatcatccgcatcggcgccgaggtcgaggccggcgacatcctggtcggtaaggtcaccccgaagggcgagaccgagctgaccccggaggagcgcctgctgcgcgccatcttcggcgagaagtcccgcgaggtgcgcgacacctccctgcgcgtgcctcacggcgagaccggtaccgtcatcggcgtcaaggagatcacccgcgaggatgccgaggaggacggcgacgagctgcccaacggcgtcaaccagatgatccgcgtctacatcgcccagcaccgtaagatcacggtgggcgacaagctctccggccgccacggcaacaagggctgcatctcccgcattctgccggaagaggatatgccgttccttgccgacggtactccggtcgacatcatgttgaacccgctgggtgtgccttcccgaatgaacctcggtcaggtgctcgaactgcaccttggctggatcgcccactccggttgggatatctcccttgacccgaacatggaagccgagtggaagaagctgattccgtccggtgccgagaaggccgagccgaacaccccggtcgccaccccggtgttcgacggtgtcaagcccgaagtcctgaagggcctgttgtccaccacgctgccgaaccgtgacggcgaccgtctggtcggccccgacggcaaggccaccctgttcgatggccgtaccggtgagccgtacaccaagccgatttccgtcggctacatgtacatgttgaagctgcaccacctggtcgacgacaagatccacgcccgttccaccggcccgtactccatgatcacccagcagccgctcggtggtaaggcccagttcggtggccagcgcttcggcgagatggaggtgtgggcccttgaggcctacggtgccgcctacacgctgcacgagatgatgaccaccaagtccgatgacgtcgacggccgcgtgcgcgtctacggtgccatcgtcaagggcgataacctgccgccggcaggtatccctgagtcgttcaaggtgctcctgaaggaaatgcagtccctgtccctgaacgtcgaagtgctcaacgccgaaggcgtggccatcgacatgaaggatgaggatgacgatccggccagctccgctgacgacctcggcttcaacattggcgcccgccccgacgcggccgccaaggaagaccagaaggccgaagagcccgaataccagtgatccctcgggctgcatgcggtcaatacgccgcgtgtagccccgccaacgtgaaatagataacgtacagagacctttccggtttgcactacccctcagtcagccttggctgacagctcccctgacaaggggagcttgggaaggtctcaagaacagaaacggattaacaagtgctggacgtcaacgcatttgacaagattcgcatcggccttgccaccgccgatgacatccgtggttggagccacggtgaggtcaagaagcctgaaaccatcaactaccgtacgctgaagcctgagaaggacggtctgttcggcgaacagatcttcggcccgacccgtgactgggagtgcgcctgcggcaagtacaagcgcgtgcgcttcaagggcatcgtctgcgagcgatgcggcgtcgaagtgacccgcagccgcgtgcgccgtgagcgcatgggccacatcgagctcgccgccccggtgacgcacatctggttcttcaagggtgtgccttcccgcctcggctacctgctgaacgtcaccccgaaggatctggagcgcgtgatctacttcgcctcctacatggtcaccgaggtgaacgaggacgagcgtcacaacgatctgcccggtctgcaggacgagttcgattccgagatcaagcgccttgagcagcgccgtgactccgacatcgaagcccgcgccaagaaggtcgaagaggatctcgccacccttgaggaggccggtgaggccaagggcccggcccgcaccaagctgcgtaacggtgccgagcgcgatatggccgccatccgcacccgctacaacgaccagatcgcccgtgtggacgccgtcttcgacaagttcaagaagctcaagcccggcgacatggtcgacgacgtggacctgtggcgcgagatgcaggaccgctacggcgattacttcgacggctgcatgggcgccgaagccatcaagaagcgcctgcagtccctcgacctggagaccatctccaaggaactgcgcgaggagatcaaggacgcttccgagcagcgtaagaccaaggctctgaagcgcctcaaggtcgtcaacgccttcctgaccaccggcaacaagccggaggccatggtgctcgacgtgatcccggtcatcccgccggacctgcgcccgatggtccagctcgacggtggccgtttcgccacctccgacctcaacgacctgtaccgccgtgtgatcaaccgtaacaaccgtctgaagcgactgatcgagctcggcgcccctgaaatcatgctcaacaacgagaagcgcatgctccaggaagccgtcgactccctgttcgacaacggccgtcgtggtcgcccggtcaccggtgcctccaaccgtccgctgaagtccctgtccgacatgctcaagggtaagcagggtcgtttccgtcagaacctgctcggtaagcgagtcgactactccggccgttccgtgatcgtggtcggcccgtccctgcgcatgcaccagtgcggtctgccgaagccgatggccctcgagctgttcaagccgttcgtcatcaagcgcctcgtggacctgaactatgcgcagaacatgaagtccgccaagcgtcttgtggaccgcggcgacgccgaagtgtggggcgtgctcgaggaggtcatctccgagcaccccgtgctgctcaaccgtgcacctacgctgcaccgtctgggtattcaggcattcgagccgatcctggtggaaggcaaggccatccacctgccgccgctggcctgcgccgccttcaacgccgacttcgatggtgaccagatggcagtccacctgccgctctccgccgaagcccaggccgaggcccgctcgctgatgatggcttccgacaacatcctgaagccggccgacggccacactgtgaccatgccgagccaggatatgatcctcggtttgtactacctgtccaccgtgctggaaggcgtcaagggccagggccgcgtgttctcctcgctggaagaggccgaaatggccctcgaccgccacgagatcgacatgcaggccaaggtgctcatccgcctgcccgagagcttcgtgctgccgaagaactgggagcccggcgaagtcaaggtgctcgacccgcgcgaaggcgaggacgaggtcgtcaaggaagaacgcttccacgacggcaccgtgctgttcgccacctcctacggccgcatcctgttcaacgagaccctgccgaccgactacccgttcgtcaacgagcaggtggccaagggccgtctgtccaagatcgtcgatgacatcgccatgcgttactccacccagcaggtggccgccacgctggatgccctgaaggatctcggcttcacccgcgcaccgtggtccggcgtgtccttcgcgttctccgacgtgaacgagccgcccgagcgcgacgagaagatcgccgagtacgaggccaaggccgacaaggtcaacgccaactacgagatgggtctgttgaccgaggaagctcgccgtcaggaactcatcgacctgtggaccgagtgcaccgccgaagtgtccaaggaagtcgaggagaagttcgacccgacctccaacctggccatcatcgtgcagtctggtgcacgaggcaacatgatgcagatcaaccagattgcaggtatgcgaggcctcgtggctaacccgaagggtgagatcattcctcgtcctgtgaagtccaactaccgcgacggcctgtccgtgctggagtacttcatctcccagcacggtgcacgtaagggtctggccgataccgcactgcgtaccgcagaatccggttacctgacccgtcgtctggtcgacgtctcccaggacgtcatcgtgcgcgaagaggactgcggcaccaaggccggtctgcccatccgcgtcgccgagcgcgacaacgacggcaacctggtgctcgtcaaggccgccgacggtggcccgtactcccgtctgctcgccgccgacgtcatcgacccggccgacggacagaccgtgctgtacaagcgcgacgacgccctgtccatggacgtgctcaacgacctcgtggcccacggcgtcgaggaagtcaagtgccgttccgtgctgacctgcgagtccaagcgcggcgtgtgcgccaagtgctacggctggtccctggccaccaacaagctggtcgatgtcggcgagaccgtcggtatcgtcgccgcccagtccatcggtgagcctggtacccagctgacgctgcgttccttccactccggtggtgtggccgcggcctccgatatcacccagggtcttccccgtgtcaccgagcttttcgaggcccgcaccccgaagggtgaggccccgatcaccgagttcgccggcagcatcaagatcgtggagaacgatcgcggtcgccagatcatcctgaccccggacgccgattccggcgcaccgaaggaagacggcgtgatcaagccgatcacctaccaggtctccaagcgcgtgccgctcaaggttgccgacggcgaccacatcaaggtcggcacccagctggtcgaaggttctgtggaccccaagaagatcctcaccatcctcggcaagcgcgccgcccaggtcaacatcgtggaggaagtgcacaccgtgtaccgctcccagggtgtggatatccacgacaagcacatcgaggtcatcgtgcaccagatgacccgtcgcgtgaccatcatcgactccggcgacaccgacctgctgccgggtgagctggtggacaacgcccgcttccgcgagatcaaccgcaacatcgtcaagaacggtggccgtccggccgtcggtcgtccggcgcttatgggtatcaccaaggcgtcgctggccaccgactcctggctgtccgccgcatccttccaggagaccacccgcgtgctcaccgaagccgccctctccgagaaggtcgacgacctcaagggcctcaaggagaacgtcatcatcggtaagctcatcccggccggtacgggcctcgcgcgctaccgcaacgccgtggtcgagcctgacaaggccatccgcgacaccatctacccgaacttcggtctgggcggcgatggcgatctcggcgacgcgagcttctccgacgccgacctgtctgacctgaacttctcgaacctcgagttcggcgatctgaagctcggcgacgacttcaacccggatgatttctactccgatcagggcggtcagcctgacatcgaggagtaagtgagaaggtcctagaaaggatgccccttctaggactcagatcttgcgttaatcgcaataagatggcccggaactatatcagttccgggccatccgtatatttgccattgtgattttcctgttgaacaagagcaggcagccgctcgttgcttgattactcaagcctgtttttcggtgaactggaagaactggtctccgatacgcaccgtggcaggcgcgctgagcttgagcggtgtgcccttggtgacttgtgtctcttggccattggtgatgatgtaggtgccgttcaacgagccgtagtcctcgatccacagcgcgccatcggtgtcgatgctgatggcggcatggttgcgggatgtggtgcgggtcgggtctacgatacgcaccgccttggcaccctgcggcacatccatggaaggcttgcggcccagcaacgtgctcttatcgatcacgatggtctggccggtgacatcgttatgcagcaggtacgtcttcttcggtgccttggacgtgaacgaggaggagagcacggtgctgtcccaatcctcgatgtcgttttcggcggcgtgcggtgtggtgtctgccggagcggtggcagcgggctcagcggcggcggccgtggcggcaggctctgcggtaaaagcggtattggttgccgcttccgcggtactgggctgcccgtagtcgttctgcggttcggctgtgccaactgcggaatccggggtgccttccaccggatcgtcagaataccaacccagttcaggtgctggagggtagggaagtttggccatgatgatgccgtcctttcactgacgggaagccagagcggcgttgattgccgggtcgccgagctggcccagccattcgatcagtgccggataggtgttgggattacgtgcgatgcaggcgcgtagttcaggcgcgtactgggcaatctgggcgatttgcatctggtcggtggtggtcagggcctgttcggcggtgaaaccgtaaggattggtggccacaggctcctcgaatgccgcctgagccgcgggctgctgagcctgttcggcggcgggctgctgggccgcctgtgccgtggctttctgatcctgaaccgggccgccgaatgcctcggcagtgaacccgtattgcgccagggtctcgcgggcgcgaccgtcaccgaactcggcgatccaacgcttcaagccgggataacagcgcggattcacggcgacattggcaccgaattccggattctcgtaggcgatttttgccagcagaatcggatccgcgttcggatcctgaacggcagcgaccgcagcatcataatcaaccatgggattacctccttatgttcgctcggttatgccgaacgtatggtccgtagtgtttgtagtgttgcgtcttcaatggcgccgatatcctcaccttcgtccagcctgaatgcgctgaacgcatgatgttcgggttcggtcaatggcatatcggccacaatcacagtgatattgtcggttccgcccgcatcaagagcggccgccaccaaggcgtccacggcctcctgcggactggaatgcgccgcggcgatggccgcgatctgttcgtccggcacctcgccatgcaatccatccgaacagatgatgaagcggccggtcagatcggcgacatatacgtcgggcatgatgccatccggatcacccagacattgggtgatgatgttgcgtggaatggtcgcctccgcctcttccggcaacatctgcccggaatcgatggcttcttggcgctgggaatggtctcgcgtgatgcgggtcagcgaagcggcgtcccacacgggaatgatatccgtggcgggagcatcggcatgcgccaacggactgagatggtaggtgcgggaatcgccgacattgaccacataggtctggtccgagaagtcctgatcatcggcgtcactgaacaaagcagcgctgcgggcgctggcggaatccgcatgatcttggggcagtaccaaaccggagcaggttgtgccggccacgccgccaaggcggtctcccagatcgagaatgtcgtgctgggcccgtgccaaggtgtcgtcgatatcctgacgggtgcgtgaaggcatggcggccaattgtgcgaaatgctgggcagccaactggcttgcctgctcgccgcctttgccgccgcccatgccgtcacagaccatgaacacgccttgttgcgcgaatccggtgtcttggttgtttttgcgcctaagacccacgtcactggtcatcgcgatacggatggagcctgtggtcatgacgccttccccttcttacgcgtgcgcttgacatgcgtcgtgtgcggctttgctgcgtgcccatttgacagtatagccacgcttttcagggaaagtcgtgtacgtatcctcctgaaacgcggcaaagaagcgagcattgccttgcgtaattggtcgactcctgtccaatatgtggtggcttggcccgattcaatgtcttgccccgagaacgtggcgtagtcggcttcccggccaagctggatcaaagcctggtcatctgtgccgagttgacgggcgatggcaccggcctgatctcgacgagtgcccttggctgtgatgccgctttgctcggcaagcatgcgtatggcattccaacctgctgccacacgggttttcggactgccgtgtcgccgcgctcgtgccagcagtatggccttgaacatcagaatcagaccgcaggcgatgagtagggtccacaatgggctgccgtacagggccaccttgcgggtcactcgccagaaccgcgcccagaacaggttggtcggcgaatcatcggcgtcggcgccggccaatgagctttggcccttggcttgcgtctgatcgcgcagcggatcggtcaacggcactggtggttgccggaccagcgtctgcggattcggcggcgtcaggttctggttttcatcaggcatcttggtctccttgggcgtcggatagaacgccacccatcccaggccctgcaatttgatttccacccaagcggtgacatcgttgccggtgaattcgattttggtgccattgcctgaggtcttctccgtgcgggcatcggtgatttcgccatcctcgtttttcggcaggaagcccaggaccacacgggagggcagtcccagatcacgagccatcagtgccatggcggaggcatattgctcggagtcgcccaccatggccgtgcctgccagcagcttgttgatgcggtagttgccatggccggcatcggagggatagtcgccttcaagtccatgagagaaccatccggagtctttcaatgtgtcggccaacgccgtggctgcggcaccgcccgaggactgcccgccggcaatggacgtggccagtttgctggccgaatcgggaacatcctgggcttctggttgggtgatgcgggccgcagccgcactgctgatctgcttatcggtgggattacgggcgataatgccggattcggtataggtgaggcctttacgcgtgccggcgggaataatggcggaatcggtatccgtgttgtagtaaaacgtgtcattgccgttgtcggcatcgttggcgaagctcacgccagtggccgctcccgccagcggcagccaggtgtcggtcagtccctgatcgacggtgaaggtcgcagtgaaggatttaccctgctcatccgccttgatcgtggtgcccacgcgatgataattcgaggagtccgtggcttcggaagaatcggacaggttccatactgtgccatcgaatcgatccatcaccgcaagtttgaccggtgttccggccggcagattatgaacggtcagcaacacgtcttttttgtggtccttgatataggatcgcatgccgctgagcgggctggtgtaatcgtaggggcttaacggcggatcgtagcggtcacgcagcacgaaacggtcctgtggcaccagcaacgtgcccccgaaagcaaggccggcagcgagcacgacgatgatcagcgcggatatccagcgcccccattccagcagttcaagacgccaagacagccagataatcagcagcaaggcaaaggcaataccgcagatggcgcgttgccagccgctgtctgtgcccagcagggcacatacggccacggccgccgcaaggggcagcactcccaccagagacaaccatgcgttggcattaatggcaaacacgccggtgaagaacgtaagccacaggccgatggtccataccgccatcagcacgccgtcttgcgtgcccagaggcggatcgacggaaataatgtacttgaacgagccaaacgtcatttcccaacctgaactcaaggtcttcaaggtgggaatcacgtaatgggacgtagtggaactcagcgttaccaccgggccgatgatgaattgggcaaacgccagaaacacgatttgccaccacagtcgcaacgccggcaacatgcccgccagagcgatgatcgcgcccagcaaggtggccggtacagcggcaatcgcccaagtggccacgccgccgtacacgtcgatgagattggcttgcgccagcaacatcatcgccgctatgagtacgaggctggcgattcgtttgccccacggctggcgactgaggcccatgccgcgaagcacattgcctctggtcatccagataaccgaatgtgtggagtcggcccaggagccggtggtggtggaggtcccggtgtacgtgccggaggaagtgccggtgtatgtgccgctcgatccggcgtacgcagcggtattggtattggtgatactggactggtcgaaggtcatgcgagcacccccatgatcagcgggagatcatcgaggtcgccgatggtggccaatgtgaagttggcgaatcttctgatgccgcgattggcgccggcgctggcctgcaataccacgcagctggccgatcggggcaaggccaaggtcatgcgcttgatttgctcgatgtctttcagcgatccaacagtgaaaaaatagaacgaagcatcaggactgtgcttcagcgtgccctcggcgagattcggattatcctcacgatcaggctctatggcactggcgttgtcgaggaactccatggcgttgcgcggctggccgtgcgcgttgcccgcgtggcagaacaatggacgatcctgcagcaggcatttgacgccgatggaggagtggatggacaccgccatctcgaattcctcgccgttgacgtattcgtccgggttcacgctgatggtcaccgaggtgtcggtgcggcgcgtggcctcatattggcgaatcatcaacgtgccggttttcgcggagctcagccagtggacgttacgcacgtcgtcgcccggctcgtattcgcgcaatccgtagaagtcgagatcatcatccacgatctggccggatggttggccttccaggtcgcggggcacgccggcattcagagtatcgagacgcacggtacgagggtggatgaatacggtgatgcggtcggccagctccttttcgtgacgcaccagaccgaacgggtctcccttgcggatgcgcaatgggccgatgggcagtattgcgcgcgatacggtacggaactccacatcggtttgcttggattgcccgggagccagcatggggatgttgaatcgttcatgcgcatcgccgattggcagatatccgcgtgccgtggtcgtcggcgttctgccggtgttgtcgatgccgacgataacggatacggtgtctcccacggtcacgcgatgattggatacgacgatggacgcgtggaagcgtgtgttgccgagggaaagcacgattgccgcgagcatcatcaccatcgccacgatgccgaatacgagcagctcataccagcccagaaacgggaacgcaataaggcatgcgatgcctgcgcccgttaccgcccagcccaagggcgagacgtaggatgcgaagaaccgtctgatgcgtcttaccgcgcgcttgaacatgcgttcagcgcgccggcgacggcgtaatgcggcggatgtagatgccatggtcggatacctttccgggccctatcaggaaccgatggtgggggagggaacgtcttcgagcacctgtgcgatcaggctttccggagtcgcgccatcgaaggtggcttccggagtcagcgtgatacggtgtgcgagcacggccactgcaaggtccttgacgtcatccggcaccacgtaggcacggccatcggccgcggcccagatacgggcgcatcgggtcagtgccaaagcgccacgcatggaggagccgaccgtgatcttctcgttgtggcgggtcgcctcgacgagcctgacgatgtattcacgaatcgcattatccacatagatttcggtggccacctgacgcagccgcatgacatcgtcaccgctcagcaccggggaaatggtctgcgcacggtcggtgatatcgacctgcttgaggatatcgacggacacatcatggcccgggtagccgattgacgtcttgataaggaatcggtccatctgcgcctcaggcagcttataggtaccgagctgctcgatggggttctgggttgcaatcacgataaacggctgcggcacatcatgtgtgacgccgtcaacggtgactttctgctcttccataacctccagaagtgcggactgcgtcttcggcgatgcacggttgatctcatcggccagcacgatggaggcgaaaatcgggccttcgcggaactcaaattctccgcgcttctgatcgtagaaagtcacacccaccacatccgaaggcagcagatcgggcgtgaactgaacacgcttgaaaccggtggaaatggaattggccaagcctcgggccaactgggtcttaccggtgccggggttgtcttcaagcagaatatggccaccgaccatcagtgcggtgacgcattgcttgatagggatggtcttgccgataaccaccttggagacattttcgaccagcgcattgaaggactgctggaaatcccggacctgagccgtgggctggggcagtagtccggaattgatgctggcgggcagtgccgatgcggctgcttgcgcggctttgctcgactgacgctgcggctgtgattgcggctgggattgcgcggtggcctgctgcgggatggctggcgtcgatcccttgcgcggcttgagcacggtgctgtcatcgcccgcaggaatggaggcggcatcagtagtaggagacggcttttctgacggcgcttgtgacggccgctgcggcaggttaggcagcgcaacggactgcggcgccgactcggtgcttggggtcgtgccggtgtgtggtgcggatgccaggtgcgtggcgtcggacaagtgcgtgctgtcggatagctgcgtgctgtcggacagacgggtcgtgtcagacaactgcgtcgcgtcatcgatgttctcgctcatggatgttctcctactgcttgtgaatggtggttgacgatattggggtattgccgaaaccaagaatccaggggttcttggccaaagtggtgacatcggtaccggatttgagcgacttggtcccctccgaggagtcagagggacgtgtgcccgcgacgctgcctccgtccgcagtgttgtcgagaccggagtatcccggcccgccggtgactttgacgctccacgcgtagttgccatcggcggccacggccaagtcggtgacatccaatggctggccggagttccacgtgaacggttggccattgatgatgatttgtacagtggccgacttgccatagacatcaaccgaaccgccggtgacgttaatgacgtgagcgttgtctgaccagcgcagctcctgcggtttgttgattacagccttcttctcataggtgtaaggagcgccattgtgcgggcctccggtgacggcgtcgctggtagcgccgttgaacacctgttgcaccgatgcggtgttgcatttggcccaaggactcattcggaagtcgagtgagttccggttagtagctgtaccggaatcgatgccatcggcagtcacgctgtaggactgcgcatgtccctgcttggtccaatgcacggtgcatgtactgccggatccggtggtgtagacgtcagtgggcggctggaccttgtactgcgggacaaagctgctcttgcccgtgccggaggaagcatcgcgctgcggcaccacggtggccgttacggtgatttcccgggtgttcaaatcgttctcattgatatcgaacgtagcgccactgtcactgcaatcgatggtgtccttgacgtctcctcccaaggaaattcgccggcagccggcattgcggttattgccgagagtgactttcgccgttaccgtggtgtcgtcgttcgacaacgcaatgttcggcgcatccgggtctccccagatcttctctgacggcgatgcggcggactcggcactccaattgattttgttatgggctttgacggtcgccgtaatggcggtgccatcggaaatgtcgttgttgttgaacgtaaacgacagctcggtggccgtattgccggtttccttggtctgcggagcacctgcaccggtgacggtcactgaatagttgtcgacggcgctgaaatcaccgctcggcgctttccacgtcaccctggcggttttattgccacctgtgatcgtaacatcggtgggagcggacggcaccttgtccggtgtggcttcgacggcggtggacggcttggaccagccgacgtcatttcgcgcggcgacggtgaaggaataggttttgccgttcttcagaccagtgacctggcatgaggtgacggcaccgcaatccttctctccggtgacggcaccggtccaactgaccttgtagttggtgatcgggctgccattggcggcaccgggcgtccatgtgaggctgaccgcgctgtcctgcggttccccggctacgggggagagcagtggcggctcgggcttgtcgatcacggacacggtaatcgatgcggtgacttcacgatccttggacttggtgccgtcttgcacggtgacgagcacggtgttcgtggaagcacctacatcggatgcgacggcgatggtgatgtttccggaggcatcgcatccggcgatggtgagtttggcggcgtcatccgccttgcagctgatgacggtcagcgaggaatcggggaacggattgtacgcgccggtaagcacgttcacggcatcgctggcaccggccttgatcttcaacgtcttgtcgccgacgcgtgtcagcggacgggtcgaagacactacgcgcacggtcacaccggcattcacggtgcccgcgccgtatgcgatttgcacgggaacggacgcggtggtgccaggagcggcatccttggtggcggaaacctgcaagctaccggaacgggacaggtttgcggtgatttgcctggatgatgagcttccaccggaatacgtgtattgcttttcgtcgtcatacacgccggacggtgcatgggtgagcgccgtcagatcaacggtcttggggtccgcgcccgcctcgacatcaatagtggaggacgagaacgtgggcggcggcacatcgcggcctatcaccgtgatctggagagtgatcactgcggaattgatgatcttggtcttatccgatccctgcttgccatccacagcggtaaaggtaatggaggcggggcctgcgtagtcttttgccgcagtgaacttcagggtcttgtcgttcacgtagaaatcggagttggaagccttggtggcgctgacggaatcagcgctttcgatatacggttccttgccggcgccgacgcggacatagtcattgatgttgatttcaatggtctcgcgcgagttgaccttcaattccggtgccttgggacgcagcgtgggcggaaagacaccataggccggtacctggatgaacgcggtggaggtgatgttgtatttcgtattggtcaccgtgtaaggcacggctcgcgcctgtgacgtcaggtcgacggtgatggtggtcgaatgctcgccgcccttgacgtgagcgtgagcgctggcggagggatgcacgccgaccttgagctcattggctgtgccggaaggattggcgatccactgggaaacatccacatccacggacttcttatcgatggtggcggcggacggcacacgatagtcgtaggcggtaggcggctcgatggcggcactcggatccacgtttaccgtgagggtggccgtatcggacaagccggccttgtctttgaccgtgtaggcgatatagtcggtggtggcgctgtcgggcgtggtgaaggagagcatattgtctttcacgctcaccccgtcgagaccttggacctcgacatgcttgtcgacggtcagattggtgttgtcgccggagatgtcgttctgcgcgaccggcacggttgcggccgtattgggcctcaacgtgatttcgtcatccctggcgtatacgccggagtcggacgatccttggaatacgcccacgcggatctgcgcctgtgcgcgctgaccggtccaatcctccacggcataggagaaggtgtcggtgccggacgaatccggatacgcttcatagaccaagtagtcggaaccgacttcggatatgcggcccagcgtgggtgccttgttgcccagacccaacagctgattgtcgtcgccatccgtgtctatgccggtcagtgtgatggggatgcggaccttctgcccggcggcaacctgcgcttcggcgtcatgcggggttggcgcggccttgctcgctgcgtcgctcttatgcacggtaatggtgatattggcggaagccacattacccagattgtcttcaaccgtataggtgatggggaagttgccggtctcgctggatgcttggtagcggaccgtgtctccagagacgaaggccagacccttgaacgtccccttgtcgtattgcaggttgttcttgagtttgaccgtggtgccatccgagtaggccacatggtcaagcacatccacggacacgatgccgtcggtacgcacctgggcattgatattgctggccttgggcactgaattcgaggtggccagagccggcggctgcaacacgatggtgcccttggcggttccggaggcgttggccacggtgtaggtaagggcgacgggcttcgtgggcacctgacgcgcggtgatatacacgcgcttatggctgacgagaccaaccttgatgccggagtcggccggtgcgctcaccgtggtgacggacagcacaccgcccatcggatcgacgtcattggtgagcggctccacaatggcggtattatccgcgccaagcagggcgacatcgttggcggcaaccggtttggcggcctcgccggtggcgggctgcacctcgactcgagccaatccggtggccggaatcgaaccttgagtaatgatgtagggcacataataggtgccgggattggtggccttgaacgtcaacgacatatccgccgcattggtggtcgtcgaagcgccgttgggcgtatccacctgagtcagttgtgccggctgcaaggaagtgccatgcacataagaggacagcttgacgacggtatccgtgttgggaacggtggttttcgctaccgggtcgatgaccgcggccaaggtgttcgcgggcttgaccgagaaatacaccatgccggtgccggttgccgtgccgtcggagacggtgacctcgacgcccacacgtcccgacgccagcgcaccggtgttgaacgtaagctggccgtcggctcgggtggacacctgcacctggtcggtgttctgggccacagcggagaccagagtgagcgggtctccatccggatcgttgaagctgctcagcgcattggcggtataactggctccctgctccacatcgatctcgggaggagtgtcgaactgtacgggagcgtggttgcctccatcattcagggttacggtcaccgtggcggaagaggtctggccgcgaccatcggaaatatcgtaagtaaaggtaacggtgcctgcggatgcggcggaggcatcgagttgcagataccggccgtcgtaaatcggcgaaatggtgacgtctttgttgtttggtgcgccaaccttggtgattttcagtacggaacaatcggtctgctcgtcattgcgcagcgcgtcgagaatctgttccgaaccggctcgtgcgccgatttcatcatcctcggctttgatttggccggattgtgcggaacaggtcttggagaagtcgtggtggttgttggccgagtcgttgttctgctgttctttctcggtctgctcggtctgtattttgttccactgtattttgatgactttggtggaatcctcagggttccacacattgccgttaaccgtgtcgttgagcaccacaaggcgatggttggtgcggaacaccaattcggaagtagtattgacggattcgagggtttgcggcttgacgctggtatccgtgggggagcaggcgcgaatgtagttgctggccttctggctccaagccgagtacacgcagcccttggacgataccggtcgtgccggattcgccttgcccccgttggctatgaaattcgccttggcattggacttcaacgggataagcgcaaggcctctcggtgatgccgcggccacccaatcggactgtatgtcatcggtgggaggctcctgaagggtgagggtgccggtcgtgtcgacatcgacgcggccgcccttgaatatgacggttttgccggttgcgattaccggcgtgctcccgatgacggtaaagctttcaacggtctgctgcttgccgtcggtcagcgattcgagggttttgacgttggcgctgctgggattgtcaagacgcagcaccataccgtcggatggacggtatccgtagactttgccatcgtgggttactgcgatgcgcccgccctcgcccagctttattttcggatcggaagtggtgggggtcacggaatcaaggttttccgacaagccggtccacacattgccggtcttctcgttgatcagggctgcggtatccccgccgaccacagtggtggtgctggctttgatgtcggtcttgacaccggtgctgaccgtggatgccttgatggtggaggctttggtcgtttcggtcaggatggtgtcgccattatgctgtgcgatgtcgaatcgtggggcggaggaggagacgccggcgtcggcctccttgttctttacgttgaatcgtgcggccttctggtttttcagcgaagtgacccatacggtgccatcgtccagttgcacatggcggcgcgtgacggtgctcatgatcaccgcgccggcaacaagtcccagaagcagcaggagcgtgattacgggaaccgtccacgtatgccctccggagggcataaggcggcgcaaagccgcgctgatgcgtcggcgacgatcgtatgactgggacgatgtggccatctgaactccctgacccctgttttctctggttgctggtgtaatgacaacgctttacggttccaatacctgccgttcctgttgtccatttggtgaattcgccgctgctgggcgcacgtctgatgcgatacgcaatgccagggtggcatgcccggcagtggcgagcggatcattcttgcggcttggccgcacaggcgatggcggggctgacggacatctggcggttcttgcgcacaatggacacctgaatgcaggtctgcgagccttcctgcgcgttgacggtcaccgtgggatctgacgttgtgacggtttgcgcgctctggtcggtattgctgccctgcactatggcccacgcataggtatcaccgctttgcgggtctggattcgtccaggtgaacgtcacggatgacccatccgccgcataggtgccgttcagattctccggggaaggaatctgggcgttcgcggtatcggtgatcacgtcatcctgattattgcggttgttgtcatcatccttggtgccgggcgtcgccacctgtttggtatctgatccggtggcgctgtccatgcggggaacgaccacgaaggcgaatatcagtgccgctgcggtgatcgccgcaagtataccgacggtaatacccaccggtttgacccatcgccgtgacgaacgggtgatctgatctcgctggtccgtggcccggcgccgacgctcgatgtctttgggataggccggcatcccttccacggtaacgggagtggcatgcccgaaatatgcgaattgcacacgctgcatggcacgtgcgaactccaacgcggagtagtaccgctggtcggggtccttgttcagggcccggcgcagcaccgcttccacatcggccggcacgtcggggcggttgaggcgaggcaatggctggttgacgatcagcgaaatcagttccgattgcgaacgcgggtgataatcgtgctggaatggcgagcagccgacgaacatggcgtacagggtggccgccagtgaatagatgtcggcggcttccgaaccattggtcagatgctgaagcacttcaggcggtgcccacggcggcgagaatccggtttcggtacggtcatacacatcggtggagataccgaaatcacccagaacaggcaagccctgcgaggtgatgagaatgttgctgggcttgatgtcgtgatggatgatattgctgcgatgcgcggtgaacagcgcgcttgacagcttgatgccgaggtcgagtacctgctcgcaggtcatggaccgggccttcatgatgctgttgtaggtgccgcccggcgcatattcgatgacgatgtagccatggccatcggaggtgacgccggcaccatataccggcagaatgtacgggtgggatgacagcttggccatgaagttggcctcgcggttgaacagggcagcggcccgtgggtcaagggttttggcgctggcctttaccgccaccgggcgtgcgggcatacgctggttatataggtacaccgtggcggtggcaccgcttcccaacatctggacgaaatcatatccgggcagcttcggcggtctcatcggaatgttgtccatctgttccctccctccttggaaaatgcgctctccctgcattcgttctacaggataccgtcaagggtacgattcttcgtcgggttcggtaaaatttttccctctgtgacggtcgggtttaggctggagccatgatgacgagacttgaacctggaacagtgctggacggcatcgaccgtgatggagcggcgaggctgattgtcggcacgcctggaagcggcaaaactgaattcgccttatcggtgttgatggcggggctgcgccgctacggtggcacgcaggcggtgatggccgtatccggccgtgtggccgccgacgcattgggcaatcgggtgattcgtgagctcgggttttccgtgcaggccaggccggtcaccacgctgggtgccgtggcattccgggccatatcggctttgcgcgagggaactggattgccgtcgcctcgattgctgaacggtgcggaacaggatgctttgctgcgtcaagtcatggccgtgcatctgcgccatgccgtagcgggagatgattgcggcacctgtgatttgctgcgcgtctactttgcccaggatgactgggcgagactcatacgcgatgccggtgccggcgagatgcccggctcggccgcttccgcacaatcaagcctctcgcaacaagggtcggattcgccgtctccgacgtcggcaggcggctcgaccagcgcggataggttcacgcgaggtatttcagatgcgtttatcagccagttgcgcgatatgctggcccgattggatgagctcggtgtaggcgttcacgaagagccacgtctcttggacgccgtgacggaggacgcgcgattgtcggtgcaatggcgtttggctttcgcgttgcgccgtgaatatattgcagcccaaagcgcggtatatccggggcaataccgtttggatgcctcgtatttgctggtggcaggcgctcgtgtggtgcgtgaggcattcgccgccgatcacgcggatgattccgaccggcctatgtgtgtggaggcgttgggcttgccccggctgctggttgtggatgatgttcaagacaccacgctggccggcatgcgcttcttggaggagttggggaatgccggcgtcaagttggtgctggtcggcaacccggatgaatcggtgcagaccttccgcggatcgtatccggaatatctgatgcgccgtgccgtggaagggcggctgaaggccaaggaagaacagctggttggcggcagtgccgtcgctgatcagtcgcacatgacgatggctgatgtgatcgcgtctcgtatttcgctgtcgattccctcgccggaagacgagccgctgcctccggccgagcgtcccggcaagctgaccgccatactgggcggagtcgatgcagcgaattatcaggcggacggcacggtgaccgccggcctgtaccgatcctcacgtgaggagctggatgatgtggtctggcgcatcaagcgggcgcatcttgaccggcatattcggtggaacgacatggcggtcatcacccacgacaatgccgccgtgcggctgttcggcgaacgactgcgccgagatggtgtaccggtgcggtattcgtcggtcacccgtcctttgaaggacgagactttcgtgcagggattgttcgcgcttgtggagcttgcccgattgcgtgccgaggggatggcggaatgccagatgacgttggcttcctgcgcggcatatataaggactagagtggccacgttgatgaacggcccgttggtgagtgccggggccaaacccggtcaggggcgtcccgcaaggcttgcgccgatcgaatcggccatggggtcgttggagtcgctggcgcatctcgccacggatgatgccatgctgacctctctgacgacggcatgggaaacattgcgtgaaacataccatgaaacacggcgtgaaacaggtcgtgaaacatcctcgtcagtggtttcgacgtcagcggtttcgtcgtcagtgacttcgttgccagtgtctgtcgaaatactcggtgaaccgtccggcgatgacttggcctttggcgttgacgcgctgtacgtgatgcttgccattgatgatgccgccgcgccggcgcaggctgcgctcgcatccatccacgcggtgctcggcaacgaccctcaggcccgcgcttttgcgaacctgtggcatctggtgggcagcgttgcttccggcttggagcggctgccggcaagccagcgcgtacagccgcgctatgcgctgtctgttgcgtggaacgccaccggtctggcaccggtctggcagcgtgcggcattattcaacacggcagaggggcgtacggccaatgaccggctggacgcggcaatgcgcctgttccagttcgccgatgattccaccgccagtcgagacatcacgtcattcatggcacaggttcggggcatggaagtgcaggccgattccttggcccacataggaccggtggaagacgcggtgacattgactacgccggcaggcgcggccggacgccactgggaatatgcgtggataccggtggtccagcaagacgtgtggccgaacctcgccgggcgcaacaccatgttcggtggtgaagaccttgccgagctcgtgctgaggggagcgcttgaagaaagcgacaaaaccgggcatgatccgcggttcgcggctgtattgtcgggcgagaagaagagtttcctggtcgcgctgacccgtgcacggcgaatcatgatcagcgcggtatggaacgacagcatgagcccctcggactttctcttcgggtatctgccggaatactatccgcgcaaccggcaacaggcgcctttcaccacagtgggggcacatgcgggattcgccgaatatgatctggccggattggacgccgacccacgtgggttggtcagcgccgcccgcgcggttctggccactgctcaaccgcagcaggctgccgcaaaggacgccgcgattgcgttgacactcctgttagagcatggtgtgcgcgccgcaaatccgcagagctgggcgtttgtggaatcgccggcccaatcggatagcgcgtcatctggcggtgcgtcatctggcggtgcgtcatctggcgatacctcatctgacagtgcctcatccgacagcgcgtcatctggtggtgtacagcctgacggtatccaaacagggaaaggcaagacggatgcgcaggccgcgcccatggtcaccttatctccatcggcggtcgacagcctatgggcgtgcccggtgtgctggatgctggagaaccggttcgccggtcctcgccccagctccgtggccaccagtttcggaaccctcatccatgcggttgcgcagcaaggcagcgaggaagggctggaccatctttcccacaatgcccaggcgttggccgcactgggcttggactccacggccggcgcggaacgtcgcatcgaggctgtctcggcacggcttaatgccatctatcagagcaaacgtcctgatccgaatgccatagccgacacccggaaccgctatgaggccacccgtaaggacgagtccgcggcggataccctgcgcaacatcgccgattactttgtgcgcagcgacgccgatccggaaacgtatcttggcaagaactccagcaacttcagcattggcgcattggccggtgccgaatgcgaacgggagtttgccgcacgattcgatgtgcgtgacatactcgacgcatacaatgccgtgcccggcctgcacccaatcggtcggaacacgctggtccgtctgatgggagcactggtcggagggtggccggaaggcatggacgagcatctgaccgtgagactgtccgggcgcatcgaccgtatggaaacccgcgtactcgcagacggcggcgaatgcattcgcctcattgactacaaaacaggcagaacgcccacggtcaaacagattttcaatgatttgcagctcgtgtgctatcagcttggcctcgtgttccccgaagacgggccgcgcggtgccaaggcacttgccgcaatgccgcatatcagccaaagcgtgctattccatgtcgggcagaatgcggcaccagccagaagctacgctccggaaggtgccttccagccgccgctgttcactgatggctcgttgaatgccgaaccgttcacgccccgatactggtataaagaccccaaccgtttcttcgacatacccgccatagatccggctactcctcccgaaggtgtgagtgccgaagcgtgggcgcaattcgccgcgctcgccggtacgcagacgttatggtcgctgaccatgatcgcccgcgtattctatgccgcggcggccagcagatcagccatcatcgaggcccatccgcaagacacccatatcggattctgccgtatgaagaacgtctgccctgcctgtgcaggccagatcgacacgattttcgaaacgaggcaagcatgagcacgttcactcccagtgcggaacaggccgccatcatcgatgcgccagtcgatgctgacgtattggtggttgccggtgccggttccggcaaaacctttacgatgacccaacgcatcatcgcgcttatcaatcgaggtgtggcacctgaacgcatcctgggcctgaccttcacacgcaaggccgcaggcgaactgctggaacgcgtctccgccgcagtggccggtgatatggcgggctctacgaccgccacggtgtctgatcgggcattcctcaagccggccattttcacgtatgacgccttcttccagaccatcgtgcgccaatatggactgcttgtcggattcgatcagaacacgcaaccattgagcgcagccggagcgcttcaactggccaccgaagtcatcgacagtcacatggatctggcgttcagtgaggattttggcgccttctccagtttggcgaaccgtgttctggcgttgtcggatgccattggcagtgccatgatcggtgccggctgcaccagcttcgatgatgcgatcaatcgagtacggcaatgggattcggcattcatcaatcgattgcaacaagccgttgcagacgaacccatgcccgaggacgagccgaaaatccccaagatcaaacgactgaagaaagataccgacgccagctggcaagccaagctcgatgaccgtgccgaacatttgcacgcccgctgcacctatcattgcggtgcgctgctggagaccacacgcaaacgcgatattctgctccagctggtggaggcctatgcccaagccaagcgggaacgcaatatggccgaattctccgacttcaccattgccgcgtatcagcttatcgagcgcttcccctccatcggagagcgtacgcgccgcaggtacagccacgtgctgctcgacgaatatcaggacacctccaccacgcaggccgctctgctggcagcactgttccacgtggatgcgtcacagaggtccgccgtcaacgcggtgggtgatccgttccagtcgatttacgcatggcgtggtgccagccctggtgcattccgtatgttccagcaagatttccacctgcctgccggatacaagccattcccgttgtccgtcaccaggcgcaacagccgtatagtgctcgaagccgccaataatctcacgctgccgttgcgctccaatccgtcgcgtccctccagctcattgatgcgtgaggtcgatgtctcatcgctcgaccccatgcctgatgcccccgaaggaacattgggagtactgggcttcgccacggccgggcaggagatcgacgccgtagtgcgtttctgcaagacggccatcgcacggcaccgttccgcagccgaacaacaggaacagatgccgggcgaacagaaagcgccggtcgccgtgctgtttcggtccaaatcacatatgcccgaatatcaggcggcattggaacaggccggattgaccacattcgtggtcggctattccgcgctgctggaacgtccggaaatccgcgatctgatggcgttgctgcacgtggccgccgaccacaccgatacgggatcgctgatgcgcttgctggccacgccacgattcaccatgtccgcagcggatttgaccatgttggcccgttttgctgaagaacagaacatggaacaacgcttccaagcattggtgcaggccggccttgcccaaccggatacaccagcgaatgaatgggcggctgtggtgcgtgagtaccgcgatcaggtggccaatgcggtattcctgccagacgtattgctacgcggcgacctggtaaaactgcttgaacggttgagcgcacacgggcgcaacgccataacctgggccgcggtgatgctccgtcaggtgcatgatgccgtcgggcggccactgggcgacgtgattcgcgccggcatagaagcgttggatcttgacatcgacaccgtattggccggtgtgctgcataatccgcagcaccgcgccaatcccgctttggcgcatatgcctatggatgcgattgtggatttggtggatacgtacacgcaagagattgccgctgagcaaactccctcgttgcatgggttcatcacatgggtggatcatctggcttcggtggaggatgaagccgccagtctccccgacgctccggtggatgtggaactgatgaccgtacaccagtccaaagggttggaatgggatgccgttgcggtagtggggcttaccgccggcggattccccagcaatcagggcgaccatctcaagatcgtgctggacgaacaccatacgggaggcaccgagcaaggtcactggaccgcacccgaatatcatgagaccgccgactcctggctcaccaaccccaccgccgtgcccgtgcctatgcgcgccgatgccggcattttgccgcgattcccccatgatgccgatgtggaagccgaccccatcgcatcgttggcggctttggatgatgtggagcttatcgatgatgaagtgttcggctccatgcgcgaattcggcgatggcgtggaagaagtggatgcatccggctggtatttgacgcaggcggaggaatatgggcgtcggctgcatgccgacgaacgtcgattgatgtatgtggcgcttacccgtgcgcgggaagatgccctgatgacctattgcgcctatacgggcgaatccgggcgggacccgtcagtggtgcccaaaggctctcgcgccgctcagccatccaatttctggcttgaagtgcatgacgcgctccaagcccgtgaacatgcgatatcggctcaggactgtgtggaacggctgcaaaccgccaatgccgggaagcccatgctgatctcggcgcaaggcgaagcgattgcccctcccgaagggttctttatcggagagcatgccgcggcatacagtgacgccgtggtgggggaggcgtggcaaacgccgattacgcagacgaatgccgccgtcgaattgccgtggccggctaccctcagcgacgcggtgcatgaacagctgtcacgcggcatcgatgtcatcgccgcagattcctcgtcacttgagcagcaccaagacgccggcccactcctgcaacgggcacaattgctggtggacgacgccgatttgatggccgatgccgccagcggccagtcgcttgatgaggcagtcaaagccaaggcgcaacgcgttctggctgcaggacgccagaacgtgacaagcctgcaagcccgcgtaggtggcatgaacgaacgggaggagcgcctctactggcgtagcattatccgcccgattccgcgcatatcgtctccggcggccgaggccggcacgcagttccatgcgtgggccgagcaattcatcaatgccggtaagccggatgaagcggtactggcatatgaagccgaaccaagcatgccgcatacaggtcaggatgcgggattcgtttcccgggaagccatgttggccgatttggccgaacgggagcggcaatgccgcaagccatccacacggcagcccgctgtcccacagcccacggctcaacaatccgtatccgccgtatccgccgtatccgccacttccataagcagcgacaatgccaccgagtccaagctggtggcgtggcagcgcagactggccgaatcatcgtgggccaagcgcatcccggcgtggacggagcgtgccatcgtcgtggacgtgccgggcgtgggcctggtcaatggcaaactcgatgcggtattcatcggtggacttgacccgtccagcaccaccgcacgctttaccgtggtcgactggaaaaccggtcgtcggcccaccaagccagacgacatcacccgcaaacttgcccagctcgacatgtaccgactgctgctggcagcggtcgaaggtgtggaattggacagtatcgacgccactctctactatgtcagtgagcccgacgagggcttgcgcgagcttcacgcccgcgcgaaaaccaaacaggaaatccttaccgagttgagctccggcattcccgaacaatctgacaacgactgagcccaaaggctcatgacctgtacagcatcggacggccttcaccggtggagagaccttatgcatcgcaaggcatctccgacgatgaagacgactggccacgtaccggtccgcggttgaaacgcaccgcgtgacgttgcccgggaaccgctaccctcggatggcacgtgtgggcgggcgcacgtgccggacaacgcaccagtaaggagttattgtgtccacgactcgcgcggtttcgaagtcgtccgctgcccactcgccctaccagcgcctgttcatgctgcccggagccaaggcgttctgcctgtccggcgcggtggcacgattgccgatctccatgatgagtctcggcatcgttctggcgctcaaccatctctacgacaattggaccatcgccggcaccatgagcgccgcctatgtgctggccatgagctgcgtcaccccgttctacgcccgcgccttcgaccgtttcggccaagcccgcgtgggccggcttgcgctcgccgtgcagattgtggccatgctcgccttcgccttcgcggcgttggtgcgcgtgccgattccgctgctgttcgtcctggccatcatcatgggtctgacgcagttctcattcggcgcattggtccgaacacgctggtcctatgcgttgcgcggtgtggaagatggtgaacagctgctcaacacggcctacgccatggaagccgccattgacgagatcgtctttattctggggccgattctggcggcttggctggccacctccgtgcatccggtatcccaactgttcgtgcccaccgtggcatgcggtatcggcggcaccatattcttctcgctgaaatccacccagccaccggttatcgtggaacaggtcaccgtggccgcgcacgatgacggcagccctgctgcaagcgaagatgccgaccagctgaccctgcgccagctcaaacgcagcggcgccaagcccaagagcgtattgctctatgccggcgtactgccgttgctcgctgtgttcatcgtgttcaatatgagcttcacgtccttcgacgtgtccattaccgccaccatgaaatccatgggacttgagcccttcctcggtctgcaattggcgatgttcgcggtcggctcgtgcatcggcgcgctggtgttcggctcttgccgactcaaaggctcccattgggcgcatatggtgatgttcctatcgctgctgaccgtcggctacgtgttcttccggctgtcaatggacaatctcatcctgctgggcgtcttcgaaatcctcgccggcctgaccgtctcgccgacgttcgccaccggcaacctcatcgtcaaggatctggtgccggcggaatccctgaccgaagggctgagctgggtaaccaccgcaggcacggtcggcacgtcgatcggctcgtccgtggccggcattgtgcttgacgcctccaaccctcatgtgggcatgatgctgccattcatcttcacgctggcgtccgtgccattggcgttggccggatgggccttggccaagcggcgtgggtgaaacgggatcgggctacgcccgatggatggttggcggcttcgccggggtctctccctcagtccgcttcgcgtccagctcgaacgcaattaatgatggctttcagccaactgaattattgctcactgtcgttcgccctcacctaaaaacgcctccggcgttttcttcacggttcggctcatcagagggagctcgacttcacggttcggcttgtcagagggagctcgattctgtggacgggatattggcgtgagggcttggcggtgataggctgattgccgattggaaaacgttccgggtacattgccgggcaggtacgggtagacagggaagaagacatgatcaaggtttcggtggtcggagcaaagggccgcatgggctcgcacgtggtcgaagcggtgaacaaggccgaggatacgcagctggcgctcgcattggatgccggcgacgacctgacccaggtcaccaccgacaacaccgatgtggtcgtcgaattcaccgtgccgtccgtcagcctgaacaacgtgctgaccctgatcggccaaggtgtggacgtggtggtcggcaccaccggctggaccgacgagaaactcgcccaggtcaaatccgccatcgccaacggcccgaagcccgaaacccagaaggtcttcatcgcacctaatttcgcgatctccgccgtgctggccgactactttgccaccaaggccgcgaaatacttcgaatccgccgaagtcatcgaactgcaccaccccaccaaggtggacgccccctccggcaccgccatccacaccgcccacggcatcgccgaagcacgcaaggccgcaggactcgcccccgtgccggacgccaccgaaaccgatggcggctcacgcggccaggtggtcgacggcatccacgtgcacgccgtgcgtctgcgcggcctcaacgcccacgaggaagtgctcttcggcaacgccggcgagcagctgaccattcgggccgacagcttcgaccgcaccagcttcatgcccggcgtcctgcttgccgtgcgcaagctcgccggcgacgctccggccggcctgaccatcggcctcgaccacttcctcgacctgtaatcgacccgcagtcgaccagtagtcgcccccgcatttcaggcagggaagcgcgccgggacgcgcatcacggcattgccaccggctccggtcataatgccacgcattcagcaacaatcaaggtacgtaatataagagtccacaatgggaagtacggtgaacactatgagcgagcatgacatgcaccttcttgagccagcacctttcggccgcattctgccggctatggtcaccccgatgaaatccgacggcagcgtcgatttcgccgccgcgcagaagctcgccaaatacctcgtcgccgatggcgcggatggtctggtggtcaatggcaccaccggtgaatcgcccgtcacccatatggatgagaaggtcgagctggtcagggccgtcaaggaggtcgtcgacgttccggtgatttccggcgccggctccaacgacaccgcacacaccgtgcgtatggtcgaacagactcaggaagcgggcgccgacgcggtgctcgtcgtcatgccttactattcccgcccctcgcaggacggtatcgtcggccactacaaggccgtcgacgaatccgccgaaaagccgatcatcgtctacgatgttcccggccgtaccggcttgaaggtcaaggtcgaaacctacgaccgactggccggacttgaacacgtcaaggctgtcaaggacgccaccggcgatcttgcagccgcagtggagaagcagcagcgcaccggcctcgcctggtattccggcgatgacggcctgttcctgccgttcctctccatcggcgccgtcggcatcatttcggtgattgcccacgtcgcctccaaccccatgcagcagcttgtccaggcattcgatcgcggcgatatcaccaccgcccgtcgcctcgccaaccagctcgccccccttgtccacgcgttgaatggcgacggctatcaggccgtcatggccaaggctgcgctcaaggtcaagggcgttatcccctccaccaccatgcgtctgccgaacatcggtcccgacgccactcagcttgacaaggctgaagagggcatgcgcgctgccggactgctgtaagcccgaaacgctgcatacgggttgccagcccgccgcccctgcatgacagagcagaggcaccacaacagaaatcccaaaaaggttatggcacaagaacaaaagaaaacaagcaagaacacgaattctcgccgtcgcggttccgcgcgcggccgcaacaccaacggatccaacagccgtacgccgtcccgtaagatcaacgccacccggcaggccaccgcaccccagcaggatgccgtgctgatcgccccgccgaagtaccgcaagggctccatgcgcatcacgccgctcggcggcttgggcgaaatcggccgcaacatgaacgtgatcgaatacaacggtcacctgctgctcatcgactgcggcgtgctcttccccgaggaggagcagccgggcgtggatctcatcctgcccgatttcagctacatcaagaaccgtctcgacaaggtcgacgccctggtgctcacccacggccacgaggaccacatcggcggcgtgccctacctgctcaagctgcgtccggacatcccgctgatcggctccaagctgaccctcgccttcgtggacgccaagtgcaaggaacaccaccagaaccccaccaaggttgaggttgccggccgtgagaagctcaaggtgggtcccttcgacctcgaattcgtcaacgtcacccactccatcccggacgccctggccgtctatgtcaagaccccggccggctccctgatcgacacgggcgatatcaagctcgaccagctgccgctcgaccaccgcatcaccgacctcgtcgaattcggcaagatcggcgaaaagggcgtggacctgctgatgatggactccaccaacgccgaggtgcccggcttcgtcaagcccgagacctccatcggcccggcccttgaccaagcgttcgcccaggccacccgcaaaatcatcgtcgccagcttctcctcccacgtgcaccgtgtgcagcaggtggtggacgccgcccacaagtacggccgcaaggtcgtgttcgtcggccgttcgatggtgcgcaacatgtccatcgccgccgacctcggctacctgcacatccccgaaggcaccgtcgtggacctgaagcaggccaacgacattcaggacgacaagctcgtcttcatgtgcaccggctcccagggcgaaccgatggccgcactcggccgcatcgccgacggcaaccaccgcgatatccacatcaacgagttcgacaccgtgattctcgccagctccctgattccaggcaatgagcacggcgtctacaaggtgatcaacaagctcgtgcagctcggcgccaaggtcgtcaaccgcgacaacgccgccgtgcacgtgtccggccactgcaacgagggcgagctgctgtacatgtacaacatcgtcaagcccaagtgcgccatgccgatccacggcgaaaaccgccatctggtggccaacggcctgatcgccgtcaagaccggcgtggacccgcagaacgtggttttggccgaagacggcgatgtggtcgacctgtaccacggcagggccgcggtcgtcggctccgtgccgtgtggttacgtgtacgtcgatggcgattccgtcggcgagctgaccgatgacgagctggaaaagcgccgcattctcggcaccgagggcttcgtctccgcgttcgtggtggtcgacaccgacaatcacgaggtcgtcaccggcccgaagatctacctgaatgccgtggccgaggacgaaagcgagttcgacaaggttcgtcaccagatcgtcgaacagctcaacgaccagatgatgcagggcacgcgcgacacctacaagctgcagcagaccatgcgccgcacgctcggcagctgggttgcgcgccagctgcaccgcaagccgatgatcgtgcccgtcgtggccgacatcgcccaggacgtcgaaaccgtagaaaccaagtagtccggattatccagggacgaccgtaaggagtaattgaagtcatgcccggttctaatctcactcgtattgaagccgaagaacgtaaggccgttatcgaagcgccgattcactatcacgtcgaccttgacctgacggtcggcgcgaagaacttcggttccaagtcgttcatctgcttcaacgcgaagcctggttcgtcgaccttcctcgacctgatcgccgacgaagtgacctccatcgacctcaacggcaagtccctggacccggccgtggccttccaagacaaccgcatcgaactgaccgacctcaaggagaagaacgaggtcaccgtcgaagccaggtgccgttactccaacactggcgagggcctgcaccgctcggtcgacccgtccgatggcaacatctacctgtactcccagttcgaggtgccggacgctcgccgcgtctacgccgtgttcgaccagcctgacctgaaggccaccttcgacttcaaggtgctcgctcccgccagctggatcgtcacctccaacatgccggttgccaccatcgaggacgatccgcgcgaaaccctcgacggcaccctcggcgacaagccgaacgaaagcacccgtctgtgggacttcgagccgaccccggtgatgagctcctacctgaccgccatctgcgccggcccgtacgccgaatggcacaccgaatacctgaacgaagacggccgtaccgtgccaatggcccagtactgccgacagtcgttggccaaggccttcgcgaaggacgtcgactacctgttcgacatcaccaagaagggcttcgcgttctacgccaagacctggggcgtgccctacccgtacgccaagttcgaccagatctacgtgcccgaatacaacgcgggcgccatggagaacatcggcatggtcaccatccgcgactcctacgtgttcgaatccaaggtgaccgacgcgctggccgagcgccgcgtggtgaccgtgctgcacgagcttgcgcacatgtggttcggcgactatgtgaccatgaagtggtggaacgacctgtggctcaacgagtccttcgctgaattcacctccacgctggccactgccgaagccaccgaatggcatgacgcttgggccactttctgctccggcgagaagagctgggcgctgcgccaggatcagctgcccaccacgcacccgatcgtcgcgccgatcaacgacctcaacgacacttacgtcaactttgacggcatcacctacgccaagggcgcctccgtgctgaagcagctggcattctacgtgggccgcacgcagttcttcgaaggtatccacaactacctgaaccgtcacgcctactccaacgccaccctggccgacctgctgagcgaactggaaaagacctccggccgcgatctcaaggcctggagcgccaagtggctggaggaatccggcatcaacacgatcgccactggcctgaccgtaaacgcggacggcaccatcgccgaactgaagctcacccagagcgcgccggccgaacacccggtgctgcgcccgcatcgcctggccgtcggcttctacaacgaagacgccgcaaccggcaagatcgtgcgcaccgagcagttcgaactcgatgtagatggcgaaaccaccatcgtcgaggccgcagccggcaagccgcgcccggcattcgtgctggtcaacgacgatgacctgacctacaccaagattcgtttcgacgccgaatcccaggcattcgccgaagccaacctgcatcgtttcgatgatgccctggcccgcgccgtgacctggctcgccttctgggatatgacccgtgacggcgaattcccggccgaacgcttcgtggacatgaccctgcgtcttctggccacggaaaccgaatccaccaccttccgttacgcgctggcctgcatgagcaccaccgcccaccactacgtggcgcccgcccgccgcgacgatgtgctgcgccacgtggccgccgaactgtggactctggccaacgccgccgaagccggctcggacacccagttccagctcgtcaccgcctacttgggctacggtgaggagggcgacgccgcattcgccgccaacgcacacggtctgctggacggcaccgtgcgtcttgaaggcctcgaaatcgacaacaacttcacgtggaccatcgtccaagcgctcacctccgtcaacgagatgaccaacgacgacgtggacgcgcagctcgccaagaaggagaccacggaaaaccgcgagttcgcctacggcgcccgtgcctccatggccaccgctgaggccaaggaatgggcttgggatcaggcgctccacaacgacgagctgaccaactcccagctcgaggccgtggcccgtggcttctccgccaccccgcgctccgatctggccgagccgttcgccgccaagtacttcgagactgtggactgggtctgggccaacaagacctaccacatggccgacgccctgctcaacggcctgtacccgggctacgccgatcccgccacgctggtcaagctcggtgacgcctggctggacgagcacattgccgccgacaatgccctgaagcgtctgatcgtcgaaaacgtggcatcctcccaccgcaccctcaaggttcgcgaatacaacgaagcgctctgatttccttctggctcccctcgggcgcgaggggagctgtcgcctcaggcgactgaggggagtcgcttccgcgagaagctacgtccacattccaacataaaacccgcaaccaatcctcaacagcgtattctcgctcaaggccggcaatatgccggtcgatgagcgacaaggatacggggaatgattgcgggcttttccataacttcattactgctgattctgttggccggaatcggcgcaggattcgtgggctatgcggtaggcgcatcgtcactggtctcatacccggccctgctcgcgttcggcattccgcctgtattggcaaacgcttctaacaccgttggcgtggtcggcacgggcatcggtggcgtgatgggtgcgcgcaaagaactcaaaggccaagcggtacgctccattacgtatgtggtcatcggcgcattcggcggggtggccggtgcgtttctgttgctcaaactcgacccgagtgtctttgaatttgccgcaccagtgctgattttgctgagctcgctgatcatcgccatcaatccgcgcggccgcatgcaggccaagcaagccgccgcggatgccaccgcgcaactcaagcacatcgaagccactgaagccactgaagccactgaagccactgaagccactgaagccgccaagcgcgcaaccacccctaccgcacctcaccgcccgccggaacaactcgtgcagcccatgagtcaggattcctggtgggtatggctgggcgtagcggcggtcgccatctactccggctacttcggcgcgggcgccggtaccttggctctcgccgtgcttgatgccgccaaaatcggcccattccacaagatcaatgcattgaaaaccctgatcggcacaggcgcgaacatcagcgcctcagtggtattcatcatccaaggcgcggtcgattggccggccgccatcatgctgtgcatcggatgcttcatcggcgggtacatcgccccgtccatcacccgcaagattcccgcaaacatcatgcgcgccgccgccgtaatcgccggcatcattcttaccatcgatctggggctcaaaacctattgattcgtgccttacactgatgcagtgaagcatacagcatggccgtcaaccgcagcgtggtcgcagaccccgataaggtggccaatgtctggcatttggcgactgcggaacctgagcgcctagaaaccagcgcggcaggcgaagcggtgaacgacttcctcgatccgccagacacgtcgcagattcacggcattgcgtgtcatgctgattggcggttcgcggcgcgagcaggtgctgttcgccggcgttatgaaggagctactcgcgcccatcaacaatccgcgatatgtcatcatcggtaaggaatggggcgtgcgcgcttactgcgtgagcttcccctgcccgtccgtatttgcccgccgccagcaggacgccgagatactgagccggcagttggaccgctgcctgacgcattgcaccatggtatacgcccgcactgaggaaggtcggcatacgctacttcgctgccaaacgcgttctttcctcaaccgcgacgagcaactgccgcacatactgaccacaacatcggagtaatagatcgttgcattcatggccgagaccaccccggtagaggagatgccgttgggcatgttcatcgcatggctcagcgtgttcctcgccgtcgttctgtttggtgttgctttgccggttatcgatgtacgctgggtagttccgttcgtcgtatttgccgctgtattgtttacaggcgcgtttgccggcccgttcttactagtgcgatggcttcgttcccgtgccggagtgcatcggtccgcccggcatgcccgctaacgaatgtatctcatcattcatccgccgaacaagatgaatatgcgggtttgtgggtgatgccattgcggctgttgaatgctgatttccggttctggagcagattccgtggcggttttttgccgagtcgggtcctagggtggagcacaacgactacgatggtgcgggtaacgcgatacaaggagtggaacttcatatgccgaagatgtttggaaccgatggtgttcgaggactggccaatagggatttgaccgcacgtctggcgttggatttgggcgatgccgccgtgcgtgtgctcggcgacgccggcacccaagacgatcagcctgaggggcgccgccgcgcgctcgtgggtcgtgacacccgtgtgtccggcgattttctggcttccgccctgtctgcgggcatggccgccggcggattcgacgtgatcgacgcaggcatcatcccgaccccgggcatcgcgttcctgaccagcgtgctcaacgttgagatgggtgccgtgatctccgcctcccacaacccgatgcccgacaacggcatcaagttcttcgcacgcggcggcttcaagctgcccgaccagaaggaagacgacatcgaggccgtgctcggccaggactgggaccgcccgaccggtgccggcgtgggccgcgtgagccacgaccagaccaccgccaccaacctgtacatcgatcatctggtggccaccatcgctccgctgaacgatgacaaaacccagcccaagccgctcaagggcctgaagatcgtggccgactgcgccaacggcgccacttccgtggtggctcccgaagccctgcgccgtgccggtgcggatgtaatcgtgatcaacgcctcgccggacggctacaacatcaacaagaacgccggttccacccaccccgagcagctgcaggccatggtcaaggccaccgatgccgtgatgggcgtggccttcgacggcgacgccgaccgttgcctcgccgtggacgaagacggcaacatgatcaacggcgaccagatcatgggcattctggcccgcgccaagcagcgcgaaggcaagctcaaccacgacaccctcgtggtcaccgtgatgagcaacctcggtctgaagctcgccctgaaagatatgggcatcaagaccgtggaaaccgccgtgggcgatcgttacgtgcttgaggaaatgctcaagggcgattactcgctcggcggcgagcagtccggccacgtgatcaaccgcgaattcgccaccaccggcgacggcaccctgaccgcactgaccctgtgcaacgaggtcgtcaagtccggcaagagcctgaaggagctcgccgccgacttcccgcagctgccgcagaccctcatcaacgtgccgaacgtggacaagaaggccgcctccaccaacaagcgcatccaggatgccgtggcccgtgaggaggaactgctgggagacaccggccgtgtgctgctgcgcccctccggcaccgaaccgctcgtgcgcgtgatggccgaggccgccacccaagcctacgccgacgaagtctgcacccgcctcgccaagatcgtcgccgaagaactcgcgctgtagcacccttccctaaggaaaaaaacaatgtttggaaagaacgccaaagtcgacctcgaactcaaccgtgatgtcgaaaaactcatcaaaaccggcggcaaggagaagctcctgcccatcgtgcaggccggcgaaccggtgttgcgccaacggacagtggcctataatggccagctttccaagcgtacgctcgccaaactcatcgatacgatgcacaccaccatgctggaggcacccggcgtggggctcgccgccacccagatcggcttggggctcgcgctcgccgtggtcgaagaccacgtgcgcgacgacgaggatgatccgcgcgaaatcgcggaattccccttccacgtgatcatcaacccgagctacaaacccaccagcgacaaaaccgcctcgttctacgagggctgcctgagcttcgacggataccaagctgtgcgcaagcgttggctcgacatcaccgccgaatgggatgatgaagacggcaaacaccacagcgagccgctgcacggctggcccgcacgcatcttccagcacgaaaccgatcatttgagcggcgagttgtatatcgatcgcgccgaaatccgttcgctgaccaccaacgagaacctcgaggactactggtgcgaagacccggtgcccaccgaggccgctgaagagctcggtttcgcactatgaccgaccgtgcatggttcgacgccgccaagggagacattccccaatgggcggcgtccatgcccaaggacgccgatggcaccaccatcgactgggactgggtgcgttctctggacctggcgcatggcgtcggcacaataccggaatccaccccacagtccatccacgacgcattgaaggccgactacgccacacgcgagcgtctggaatcgatcatcgcccaatgcaacagcgcattcatgaccgatttcgaccggttcatcggctcctatcgtctgcctcgcgcgctcgcctacgccaatcgtcggctcaacgacaacatcaacacgctgttgcatctgggcgaacagcaacacctatgggcggtcagtcgcgaacggcgggggagggccaccattgccgtgctcaagccgtactccggcagcggcccgtcgaacgatgaccaaggcatgctggatctgagcggcgaagccggtggcacatctgccggaaacactgccgccgaaaacagcgatgtcaagttccccacaacagtcgccttggacgatgtccaagatcgtacggcagcgattcttgacgcacgcgccgaacggcgtaaggcccagcgcttccagaagcgggcgggcgatgcggcgatggcccgcgccaatctctccggcgcgacttcgccgggtggtgccgctctgccgggtggtgccgccgcgtctggcaacgctaccggacaccatcccaagcccgactggcgcgacgcctacctgcccggccgcgacgtggatgcggtgatgggcatcgacatcgaaaccaccggcatcgatccggcacgtgactacatcatcgacgtcggcttcgagttcatgaacatggccagtccgcgcccggccggcgaacccgagacatacgcctatgagcagggctattacgccgccggcgacgcctacggccagtcccgcctcgcttttggcgtgccgccggaaaacgcggcgctcggcaacgccctcatcgccaaactcaccggtatcgatgtacgcggccgcagcagcgaggccgggtaccgactcttcgacgaatggccccaagcccaggccggcctgctcgcgcggcttacccagcagccgtacgtggcgcataacgccaccttcgaacatagctggttcatgctgaacgtcgccggatacgcggaaagctaccgcgccgggcgcatcaccatcatcgataccctgccgatgagccggcagtgggaccccggcgcggtacccaccaacgagcatccttacggagacaacacgctcgacgcctacgccaaacgtcagggcgcgcttgattccgcccacaacgaacgccacctgggccttgaggattcgcacatcatgctggtggccatgaaacaccatctggcggcgctgaaagcgcaagggaaagggccgtgggggtccaccggcagggcgggcatcggcggcaagtcctgcggtcgtaagcggtgagtacactattggtctcgtgagtaactatcaggacagccgacagcagcgtgagaaccgccgccgcaccatcgtgcgtgtggtgtgcgtggtcatagctgtggccatgctcggctccctggtcatcccggcgatttacgcggggctttgacgttgccttcgcatattcgtgcccgcagttgaacacgtctgatgcgagggattcgtgaggtcgcccggccggttatcggcaaggcaggcccggaaccttctgacagcatggattgcaggcggatgcgcgtgtggcgcggcaatgcccgccaacgccagaggaatgtgcgaaggctgtcaacaaggacgtgacttcccaaggaatctcaaagaatcaacagtaaggtaaaccacgatggcagaatttgactttacccaggcgatcggcgaagcccgcgccaaatacgaatccatcgccaaggcgctggacgtcgaccgactcaaggccgatatcaaggatctcgaaacgcaggccgcggccccgggcctgtgggatgacccggaaaacgcccagaagatcaccagccggctgtccgccgcggaatcgcagctgaagcgtctgaactccgcctcccagcgcatcgacgatgtggaaacgctcgtcgaactcggccacgaggagggcgatcaggactctctggacgaggcgcaaagcgaaatcggcgagatccagaaggatctcgaccagatggagattcagaccctgcttgacggcgaatatgacgaacgttccgccgtggtgaccatccgctccggtgccggcggcgtcgacgcggccgacttcgcgcagatgctgctgcgcatgtacctgcgctactgcgagcgtaacggcttcaaggccaaggtcatggacacctcctacgccgaagaggcgggcatcaagtccgccaccttccaggtggacgccccctacgcttacggccgactgtccgtggaaggcggcacccaccgtctggtgcgcatctccccgttcgacaaccagggtcgccgccagaccagcttcgccgccgtggaagtggtgccgctggtcgaggccaccgatcacatcgacattccggatacggacatccgcgtggacacctactgctcctccggccccggcggccagggcgtgaacaccacgtactcggccgtgcgcatcacccaccttcccaccggcatcgtggtgaccatgcaggatgagcgttcgcagattcagaaccgcgcctccgccatggccgtgctccagtcccgactgctcgtgctgcgccacgaggaggaggccaagaagaagaaggagctcgccggcgatatcaaggccagctggggcgatcagatgcgctcctacgtgctgcacccctaccagatggtcaaggatttgcgcaccggctacgaaaccagccagacccaggccgtgttcgacggcgacatcaacgcgttcatcgaggccggcatccgctggcgccacgaacagcgccgcgccgccgaaaccgaggagtaagcagcattatggcgctgatctcactggacaatgtgtccaagatctatcccaaaggcacccgaccggcgcttgacgacatcaacctcgatatcgaacgcggtgatttcgtgttccttgtgggtgcgtccggctccggcaagaccacgctcttgagcctgctgttgcgcgaggaagaggccaccaacggcgagattcgcgtggccggcaacgatctgcggcgcatcaccaaccgtcaagtgccgcagtaccgccgttcgctgggcttcgtgttccaggattacaagctgctcaataacaaaaccgtgtgggagaacgtggcgttcgcccttgaggtgatcggcacacggcggtccaccatcaaatcgttggtgcccaaggtgctggataccgtggggctcaccggcaaggaaaagaactacccgcatgagctctccggtggcgagcagcagcgtgtggccatcgcccgcgcctacgtgaaccacccgcagattctgctggccgacgagcccaccggcaacctcgacccgaccacttcgctgggcatcatggaagtgctggacgccatcaaccgcaccggcaccaccatcgtcatggccacgcataacgaagagatcgtcaactcgatgcgcaagcgcgtggtcgaactgcacaacggcaagatcgtgcgtgacgaggctcatggctcctatgattccgccctgttcttcccggatgccgaagtcgaagccaagtccgacgccgcccatcatgtgctggcggcggcgaccaaggccatcgagggcagtgacgagccgtccgaaggcatcgcccgtctggccaactccgtgcattccggccgcaccggccgctatggcgagacgttcgcgccgctggaagacacgctgacctggggcaagggcatcccgttggacgagcaggccgccgccctggaaagcacccaggcgttcgacccgttcaatgacgagtccggcgagaccgccgcggttgccgatacgtccgtgtcatccgccgccgagccgccggccccgccggaaccgcccgagccgccgaccccgccggaaccgcccgtaccgcctgtcggcgagcagtccgccgcagaccaaacatccgacgatcaacccgctgagggcgcgaaggagtaagggggatcatatgcgagcacgattcattctgtccgaaacgtgggccaacctcacccgtaacctgtcgatgctgctgtcgctgacgctggtcaccttcatctcattcctgttcatcggcgcttcggtgcttactcaggcgcagatcaccaaagccaagggcgactggtacgacaaggtcgaggtcgtggtgtggctatgccccgacggcaccagccaatccgcgaactgcgcttccggcaaatcgccctcagccaatgagatcacggcactgcagaaaaccattcgcgacgaactcaacgacgtggtctccaacattgactacgtcagcaagcaggacttctacgacagcacattcaccaagcagtacccgaatggcgaattccaaggccgtacgctgaccgcggacgatatgcaggactctctctggctcaagctgaaggatccgaccaaatatcaggtggtctccgaagtgctctccggcaaggagggcgtggaagacgtcaccgaccagcgccagatcttcgacccggtgttcgccgtgctcaaccgagccacggcggttacggccgtgctcgccggcgtgatggtggtggtcgccatcctgctgaccggaaccaccattcgcatgtccgccgcgtccagacgaaccgaaaccgaaatcatgagatacgtgggtgcctcgaactggacgattcgtctgccgttcattctggagggcgccatcgcctcactgatcggctcggtgctctcgtgcctgatgctttcggccattgtgaacgtgttcatcaccggctggctggcgaaatccattacatggattccttatgtgaatcagctcacggtactggtgatatcgccgttcctggttgtgggcgcgatactgctgtccatcatcgcttcaaccatttcgttgcggcgttatttgagggcgtaacgcgaccggcttacccgcgagaaatgtgatgacatcgtgtgcaagcctctcaggttcgcatgttatggtattggcttaagtgagcgaaaggaccattcacatatgacgaatgtacgtgtgatcaagcccgcactggcggcattggtggccgccgcagcctgtgtgggaggtctggcgttcggctcgtcccaacctgcccaggcagacacctattccgacctgatcaatgcgcagaaccagcacgccgcgtcggtacagcgcgaggccgaactcaagcagcagttggccggtgtcaaccaggaactggcggataaggtacttgagctggatgatttgacgaacaacaagattgtcgccgcccagaacaaggtcacgcaggccaacgaggatgccgccaccgctcaggacgaggccgacgccgcatccgaacgtctttccgccgcacagaaagacaaggagacgctcgaggagcagatcaagcagaccggcaaggactacgatgacgcgcacgccgccgtggcccagctggcccgtgacgagatgcacggctcgaatgcttccgacgtgatgagcgtggtcacgggtgccaccagcacacaggacttcgtcaactccatgcagtcccgggacgcgttgtcccgcaacgaggcgaatgcggcttcctccgccgcgaactcgctgagcacgtcgaagaaccgtggcgaacgtctgtcggccatcgaaaagcagatcgctgtgctcaagacccaggccgatgagaaggccgcttccgcgcagaccgccgccgaaaccgcgcaaagcgaacgtgacgctttggacaagctacgtcaggaaggcgaagcaaggcgtaacgaactgtcttccatgatcgacagtctggattcccaatccgccaagcaggcggcccagaccgtactgatcgcctcccaggtcgattcctacaatcgtcagtaccagaaggagcagcaggacgccgccaaccgggtggacaccggtaaccagggcggtacgccgaccactccggtgactcctactcccactcccacaccgacgccggcccccaccccgacggttcccagcggtggcggcaacagcagcggccaaggtacatcgaacggtgattacggcaacgcctatgccaccggccagtgcacgtattgggcgtatgaacgccgtaagcagatgggcattggcacgccgtcctatctcggcaatggcggttactggtggcgcagcgccccctcgtacggcttgcgcgtggaccacaaccctcaggtcggtgcggcgctctccttcttgcctggtcaggacggtgccgatggtacctatggccatgttgccgtggtcgaagccgtgtatggcgacggcacattccagatttctgaaatgaactggggtggtccgtggatcatgcactaccgcaccttgaccaatttgggtcagtactggttcgtccactgatcggttggttcggccgatatatacggttgaagggttcctcttgaagaggaaccctttttcgtattcgaggccggtccgtgatatcgtcggatgttgcgttgctacccacgaaaggaggagacatgcccaaggaaaccggtgagaaactcatcgtacagaacaagaaggcccggcatgactatgccatcgaagacaagtacgaggcagggctggccctgaccggcaccgaggtcaagtcgttgcgcgaaggccgcgcatcgctgtccgaggcgttcatctccatcgaccgccgcggcgagatgtggctggagggcgcgaacatccccgaatacctgaacggcacatggaacaaccatgcgcccaagcgcaagcgcaagctgctgctgcaccgactgcagatcaccaagctcgcccgcggcatcgaggccaagggatacacgattgtgccgctgagcctgtacttcaaggacggtcgcgtcaaggcggagatcgcactggcccgaggcaagaaggaattcgacaaacgtcaggccctgcgcgaagagcaggacaagcgcgaagccctacgcgccatgcgctacgccaacatgcgccactaatcccgtcccttggctcccctccggaggggagccaagagtaggatgtccacgttgtgggccatttcgcccacgattaacgcttccgtagcattgcactcctacgctctggaaccatctgggaaacatacccgcccagctgactatccggagagaggaaatccaatgtctctaagcaagggaatacaatccgctgcggccgccgccctgagcgcggccatgctgatcgccttggcagcctgtggcacgactgacagcaccgacaccgcagccaagagcggcgattcatccaaggactcgtccagcacttcgattcaaggcttcgacaccagcagcatccagaaggacgacgagatagccgcactgctgcctgattccgtcaccagcgacggcacgctgaccgtcggcaccgatacctcttacgctccggccgaattcctggccgaagacggcaagaccccggtcggcttcgacgtcgacctgtccaaggccatcgccgccgtattcggcctgaaggaagaaaccatctcctctaccttcgactccatcattccgtccgtgggctccaagtacgaccttggcatctcctccttcaccgtgaccaaagagcgcatgcaggccgtcgacttcgtcacctacttcaaggccggttccacctacgtggtgcagaagggcaacccgaacaaggtcgactcctcgaacctgtgcggcgtgaaggtggccgtgcagaccggtaccacccaggaagaggaagtcaacaaggccaacgagcagtgcaaggcggacggcaaggatgccatcgacatccagtcctccaagctgcagaccgatgtgaccaccgccgtggcttccggcaaggcctccatcttctacgccgattccacggtgtccgcctacgccatcaagcagaccggcgacaccttggagacgctcggtgaagacgccggcggggtgcccgaggccgtggccatcaagaagggcgataccaagaccgccgaagccgtgcagaaggccatccagaagctgatggacgacggcacctacaagaagatcctcgacacttggggtgttggttccggtgccatcgacaaggctgagatcaacccggccgacgccgcctgattgccaggtgtccctgttcgttcccgctggcgggagctgtcgccgaaggcgactgagggtggtctgtagcataacagccaccagcagttgtattcttatgcggcggcctcccagcgggagcatttgtatatgtatacgctataatgtatatttatacctgattgttgatagtcgctatagggcggctccacagagaagaagagagagatcatgcagttcaacaagctgaagaccattgcggccgccgccttgagcgtggccatgctgttctccgccgcggcttgcggcacctccgacaaggcgggtgactccggttccgataagggcggttcctccaagtcggtcaccatcaccagctacgacgtgagctccgtgaagaaggacgatgcaatcgccgcactgctgcctgaatccgtgaccaaggacggcaagctcaccatcggcaccaacccctcctacgccccggccgaattcctcgacgccgacggcaagacccagatcggctacgacatggatcttgcccgcgccatgggcaacatcttcggtctcgataccgaaatcgtctcctccaacttcgatacgatcattccggccatcggctccaagtacgatctgggcatcgctgccttcaccatcaccaaggagcgcatggaatccgtcgacttcgtctcctacttcaccgcaggcatgggctatgcagtggccgcaggcaaccccaagaacgtcgatgagaacgacctgtgcggtctgaacgttgccgtcgagaccggcaccgtcgaggaagaggccatcaacaagaccgccaagcagtgcaaggcggacggcaagaaagacatcaccatccagtcctccaagcagcagaccgacgccaccaccgctgtggtgaccggcaaggccgacgtcttcttcgccgattccccggttgtcggctacgccattgcccagaccgatggtcagctggaacagctcggcaaggacttcgatgaagtgccgaacgccatcgccatcaaaaagggcgattcccagaccaccgaagccgtgcagaaggccatgcaaaagcttatggacgacggcacctacaccaagatcctccagcactggggcgtcgaatccggcgcactggacaaggccgaaatcaacccggccgtcgaatagccgacaagctgtcgcgaaaattcgaatggggcgcactgtttgtaacacagtcgccccattcgtacactaaggttcaacgctagttgcaacttgcagttcaggctgcccaacacgtccaaggaaccaaattatggcgaagaaagaagtcgacggtgagggagtgaacatccccaaccgcatcaaggcgctgccggtcaagcgccccggcccgattgtggccgcagtgatcgtggtgctgctcgccgcgatgctcattcaaggcttgattaccaatccgcgactggattggcccaccgtctggaagtacctgttcaacgagaacgtgcttgaaggcattcgctataccttggagctcaccgtgatctccatggtcgtggcgatcatcctgtcggtgattctcgccatcatgcgcaaatccatcaatccggtgctgcgcggcgtcagctggttcttcatctggttcttccgcggcacgcctgtgtacacgcagctcattttctggggtctgttcgccgtgctgattcccaagattagcctcggcattccgttcacctcggtggagttctggagcatcgactccaacgtggtggtcaccgcattcaacgccgcatggattggtttggctctgaacgaggccgcctacctgtccgaaatcgtgcgtgccggccttgaagccgtggaccccggccagaccgaggcggccaaggcattgggcatgaaccgcacgctcatcatgcgccgcatcgtgctgccgcaggctatgcgcatcatcatcccgcccaccggcaacgagaccatcggcatgctgaagaccacctcgctggtcaccgccgtgccgttcaccctcgaactgcagttcgccaccaacgccatcgccaaccgtatctacaagccgattccgctgcttctcgtggcctgcttctggtacctgctgatcacctccattctgatggttgtgcagtcccgccttgaggcgcacttcggcaagggcttcaacgcccgcccggtgggcaccaagggcaagcagccgccattgccgggtaagaccgacggtgaaccgaaggatgacgtggacaagctcaaccagaccacatttgtcggattgaatgcataaggcgggagcgcgattatgactacgaatgacatcaccagtgttgccccggtcgtgcgcaaggcggctgacggttccgtgattcctgctgtcaaggccgtgcaggtgcacaaggcgtttgggccgctgcatgtgctcaagggcatcgatctaaccgttatgcccggtactgtgaccgtgattctggggccctccggttccggcaagtccacgttcctgcgtctgatcaaccagctggaaaccctgaccggcggttccatcgaggtggacggcgaactcatcggctacaagcacgtgaccaaaaacggccaggacatgctgcagaccctggacgataaggagatcgccgcacagcgttctcgcctcggcatggtgttccagcgcttcaacctgttcccgcacatgaccgcgctggaaaacgtgatggaagccccgattcacgtgcagcaccagtccaagaaagccgcccgtgacctggccgtggccgagcttcagcgcgtcggtctgggcgatcgcatggactattacccctcccagctgtcaggtggtcagcagcagcgtgtggccattgcccgtgctctggccatgaagccggagatcatgcttttcgatgagccgacctccgcccttgaccccgaactggtgggtgaagtgctcaacgtcatgcgttccttggccaaggaaggcatgaccatggtgtgcgtgacccacgaaatcggcttcgcccgcgaagtcgccgaccagatcgtgttcatggacggcggcgtagtcgtagaaaagggcggccccgacatcatcgaccaccccaccgagcctaggtttaaggacttcttgcagcacgtgctgtaggaaggctcgttgttgcagctccaaaaacgtacgctgatgaactcagcgtacgtttttttgcgacgcctaatcgcacccccatctcgtgaagaacgtacgctgagtggtagtcagtgtacggttttcacgaaggggcatgttccaatcctgcaaaggcggcgggttggattcgctttgcgcaataatcgtccgctaggctggtgagccatgtgtggaatcgttggatacgcgggaaatattgaaacggcatgcggcaagcctttggaggtctgcctgcaaggcctggaacgtctggaataccgaggctatgactcggccggtgtggcgctgaccgcgcccggcatggataaggtggtcgtgcgcaagaaggccggccgtttgaagaacctggtcgaagacatcgagcgtaagccgatgccgcttgccacggtgggcatcggccacacgcgctgggccaccaatggcgagccgagcgacgtgaacgcccacccgcacaccagcatggacggcaaggtggccatcatccataacggcatcatcgaaaacgcctctcagctgcgtctcgacctgcaagccgaaggctaccgattcgcctctgccaccgacactgaggtggccgctaagctgctcggcaagatcgtggacaagattatcgcggacgaaggcaagccagacctgttcaaggctgtgcgccgcatggcccgcatgcttgaaggcgcgttcaccattctggccaccgactgccgccagccggacatcgtggtcggagcccgccatgattcgccgctggtcgtgggccttggcgagggggagaacttcctcggttccgacgtcgccgcattcgtggcctacaccaagcgcgccatggaagtcgaccaggatcaggccgtatgcgtgtccgccgacaaggtcatcgtcaccgatttcgacggcaacgtggtcgaaaacccgaagacctacaccgtggattgggatgcttcggccgccgaaaagggcggctgggattcctttatggacaaggagatccacgaagaccctgccgcagtgcagcgcaccctgcttggccgcttcgatgcgaatggcggcatcacccttgatgaagtgcgtatcgacgaacacgacttcaaggccatcgacaaaatcatcgtcgtggcctgcggcaccgccagctacgccggccaggtagccaagtacgccatcgaacactgggtgcgtatccccgtggaaatcgaactcgcgcacgaattccgttaccgtgacccgattctgaccccgcgtacgctcgtggtggccatttctcagtccggcgaaaccatggatactctgatggccctgcgccacgcgcgcgaacaggggtccaaggtgctggccatctgcaacacgcagggtgcctccattccgcgcgaatccgacgccgtgctctacacacacgccggcccggaagttgccgtggcatccaccaaggcgtttgtggcgcagatcaccgccgcctacctgctgggcctgtatctggcgcaggtcaagggcgcgatgttccgcgatgagattcatcaggtgcttgactccctgaaagacatgccgcgcaagattcagtgggtgctcgacacccagcccaagaccatccaggcggccgccgagcgcatggtgaacgccaactccttcttgttcctcggccgtcacgtgggctacccggtggcgcttgagggtgcactgaagctcaaggagatcgcctacacgttcaccgagggcttcgcggccggcgagctcaagcatggaccgatcgcgctggtggacgagggtgagcccgtggtgttcatcgtgccgccgcagcgcggccgcaatgtgttgcacgccaaggtgatctctggtatcgaggaggtcaaggctcgtggcgcgtacatcatcgccgtggccgagcagggcgacccggatgtggaacggtacgctgacgtggtgttctggcgccccgcctgcccaacgctgatgagcccgctggttgacgtggtgccgctgcagctgttcgccatggacatggcaaagctcaagggctacgacgtggacaagccccgcaacctcgccaagtccgtgaccgttgagtaagccacatcggtatgtgattgacgagcctcatattccgtttgagatggacgtgctgtatgaggacgagcggatcatcgtggtggacaagccgcattttctggccaccatgccgcgcggcatgtggtatcggcagaccgcgctgatccgattgcgtgagcggctgggggagccggacatcacgccagcgcaccgattggaccgcatgaccgccggcgtattggtgttcgtgcgggatccggcctgccgcggcgcgtatcagatgctgttccagaaccggcaggccgtcaaggtctatgaatgcctggcgccctgccggccgatcagccgcccgcgattcggcacgatcatgcaggtcgagccgccacgcccgttcccattgctgcgccgatcgcacatcaccaaggaacacggcacgatggccgcattcgaggaaccgggtttggccaacgccgaaaccctcatcgagcgcggcgacctctgtttccctcccgctgacgggaggtggcgcgaagcgccggagggtggtccccatccggggaatcaccccatctgccgctacacactccacccgcgcaccggcaaaacccaccaattgcgcgtccacatgaattcgctcggcctgcccatcgtgggcgacgacttctacccgcgcatccagacgcgcccctacgacgatttcagccaaccattgcagttggtagcacgcatgctgcgattcaccgatccaataacaggcgagaagcgcgaattcgtttcccgtgtgccgcttaagatctgatttcttatgcattgagagtgttttcgctcatggtgtcaccattcatagagttcggcgggctgcggggttttgcggacatccagcgacaagccaagctcagtcagggcgctgagaatggtggagaattcgggattggggactcgggcgtgttcaaattcgatcagccagcgacgtggcacgcccagccgttgggccatgtcggtctgactaatgccctggcgttgcctatgaatcactggcaggtggatcactggcaggtaccagtggatgccagcgcatgccgctcgtcagctgatgtcgagcacggaaccgcgttcaatcagttccggcgggattacggttttgacgccgaccggtatcttctcgccttcgcattgacggcggaccatggagaaggcggtggcgccaatgtcgtcaaagcgcagcttcatggtcgtcaggttcaagcgcgggaccatatcgaccagcgaatcatcgacgcccacgatgctgacatcctcgggcacacgcttgcccactgactgcaacccgagcattgcgccgtacgccatctggtcgttggcggcgtagatggccgtgcagtcggggtcgtgggccaacgccacgccggcctggtagcctgaatccgcgcaccaatcgccgatatacatgctcggtacgcgtgctcccatttgttccaacgcttctcgccaaccgcgggcgcggctttcggcggcacgcgaggtggacggtccggcaatgtggtagacggtcttgtgtcccttgctcatcaggtaatcgacgatagcgatcgagcagccatactggtcggcgtcaacagtggggcagtggtcggcggcggattcgcagatgagcacgactggaagttctcgcggaggcttgtatccgacgaaatcggagatgcgttcctccagcactacgatgacaccatccaccggctgacgctgcatgcgatcgatggcggcggaaagcgtgcgttccgcaccgtggcgcatggtctggatggtgactgaataatcgtcatcggccgcgttggccacaatagaatcaaggatgcgggcgttgccgaacgtggcggtgttgaacatcaccacgccgatatcctggaagcggccgtgctttagggctcgggccgcataattcggacgatacccaaggcgtctcattgcagcttcgacacgctggcgtgtttcgggtttcaccgcatcgctgccattcgccacgcgggacactgtctgtggcgaaacgccggcggctttcgctatgtcttgcatggacacctgtgttggcctcgacatttcaccctcgcttgactcattaatgtcggtgtttcgtttgcaacgcttatcttagggccgcttacggtaacgataacatcgttgtcttcgtgaccattgtagcagagtgactgagaaacccttaattcaacacggtactcaacacgattggacaatgttacaaatggtgttatgatgataacgcaaacattttggtcaaccttcgaaggagaggggttgggaatggcttcagccgatatcgcagctgcgcccgtgcattcgggcaaggctcgtgtgaataagcacaaggccgattggcgtggatggaaattcatgtggccttttgcggtggtgttcgtgttcgtgttcatcgtgccgatcgtgtacgccgtttatatttcgttcttcaagaagcagatgatcggcggcaccaagttcgtcggcttcgagaactacgcgcgcctgttgggtgatggccagttctggagcagtgttggtcgtgtggccctgttcacgtgcgtgcaggtgccgatcatgctgtgcctgtcggctttgatggccctggcgttggattcgatgaagctgcatggcacgaggttcttccgtatctcgacgttcctgccctacgcggtgccggcggtggtgtcgacgttgatctggggtttcgtgtatggcgcgaagtacggcctggtgggttcgttgaacgatttcctgggcacggacatcgacgtgctcgcccccagcgtgttgttggccagtatcgggaacatcgtgacgtgggagttcacgggctacaacatgctcatcttctacagctcgctgtcgaccatcccgcattccctgtacgaggcggccagcatcgacggcgcgtcggagtggcagatcgtgaagagcatcaagcttcccgaattgcgcggcagcctggcgatcacggtgatcttcagcatcatcggctcgttccagctgttcaacgagccgagcattttgcagaacatggttcctggtaatgcgatcacgacgtattacacgccgaacatgtacgcgtacaacctgagcttctccggcaaccagtcgaactacgcggccgcgttggcgatcgtgatggccgtgatcaccatggccatcgcctacatcgtccagctcaacagcctcaaggagcagatgaagtgacgacgactactgctgttcgtgttgaggaatcgatgatgatcgtgaaggagcgtatgtgatgagtgcagcaacgacttcggccgccggtcgcctgaccgacgccgagctcaaggcccaggagaaggccgccaggaaggcggagaaggcccgccagaagaggatcgccgccgacgaggccgccgaacgcaggcgcagcgcgaaggccgggttcgcgaacgtgaacaacccgaggcgttccacgttgttgaccgtcctgtgcgcggtcttcgccgtgtactgcctgttcccgttcgtctaccttttgatcaacgcgacgaagacgcaggccgacttcaccagtacgttcggcctgggcttcggcaagacgttcgccctgttcgacaacatcgcgacggtgttctcctatcaggacggtatcttcgcgcgctggctgttcaacacgatcctgtacgtggtggtcggcgccggcggcgcgaccctgctggcgatcatgggcggctacgctctggccaagttccgcttcccggggcgcaaagcggtgttcgtggtcatcatcggcgcgatcagcgtgccgggcatcgctttggcggttccccagttcctcctgttcgccaaattgggcctgacgaacaccccgtgggccatgatcatcccgtcgctgatcagcccgttcggtttgtacctgatgtggatcttcagcgagcaggccgtgccccaggagctgctggaggccgcccgcgtggacggtgcctccgagttccgcacgttctggcagatcagcctcccgttgttggctccgggcatcgtgacgacggccctgttcacgatcgtggcgacgtggaacaactacttcctgccgttgatcatgctcaaggacgcggactggtacccgctgaccatcggcctgaaccagtggaaggaccaggcgagcacggccggcggccaggcgatccagaacctggtgatcacgggctccctgatcacgatcatccccttggtcatcgcgttcttgtgcctgcagaagtactggcagtccggcctggccgcaggcgccgtcaaggagtgagcgtactttggctcccttctggtggagggagccgagataaaggcgcataaccactaacagaaggaggcacctatgcagatattcgcattgttgagaattgtgcaggtgcctccttgtgtgtctgtgcaacgtgaggaatttattcccgtagacgcagattatcgataaaattcaataaaggaactgaatcatcatggaacgtaaagagttcaagtggccgcagcctcttgcgggcaacgagccccgcatctggtacggcggcgactacaaccccgaccagtggccggaggaagtctgggacgaagacatcgagcttatgcagcaggccggcgtcaacctcgtctccgtagccatcttctcctgggccaagcttgagcccgaagaaggcgtgtacgacttcgattggctcgatcgcgtcatcgacaagctcggcaaggccggcatcgccgtcgatctcgcctccggcaccgcatccccgccgatgtggatgacccaggcccacccggagatcctctgggtcgactaccgcggcgacgtctgccagcccggtgcccgccagcactggcgcgccaccagcccggtcttccttgactacgcgctcaacctgtgccgcaagatggccgagcactacaaggacaacccctatgtggtctcttggcatgtgagcaacgagtacggctgccacaaccgcttcgactattccgaagacgccgagcgcgccttccagaagtggtgcgagaagaagtacggcaccatcgacgctgtcaacgacgcttggggaaccgcattctgggcgcagcgcatgaacaatttttccgagatcatcccgccgcgcttcatcggcgacggcaacttcatgaacccgggcaagctgcttgactggaagcgcttcagctccgacgccctgctcgacttttacaaggccgagcgcgacgccctgctcgagatcgcccccaagccgcagaccaccaacttcatggtctccgccggcggtgccggcatcgattacgacaagtggggttacgacgtggacttcgtgtccaacgatcactacttcacgcctggcgaagctcacttcgacgagctggcttactcggcctccctatgtgacggcatcgcccgcaagaatccgtggttcctcatggagcactccagctccgccgtcaattggcgcccgatcaactatcgcgtcgagcccggcgaattggtgcgcgactccctggcccacttggccatgggctccgacgccatctgctacttccagtggcgccagtccaaggccggtgccgagaagtggcactcttcgatggttcctcacgcgggccccgactcccagatcttccgcgatgtgtgcgagctgggtgccgacctcaacaagcttgctgacgagggcctgctgagcaccaagctggtcaagtccaaggtcgccgtcgtcttcgattacgagtcccagtgggctacggaacacaccgccacgcctactcaggaggtacgccattggaccgagccgctcgcgtggttccgcgcgctggcggacaacggtctgactgcagacgtggtgccggttcgcggcccttgggacgagtacgaagccgtcgtgctgccgagcctgaccatcctgtccgaagagaccacgcgccgcgtgcgcgagtatgtggcgaacggcggcaagctgttcgtgacctactacaccggtctggtggacgacaaggatcacgtctggctgggtggctaccccggttccatccgtgacgtggtgggtgtgcgcgttgaggaattcgccccgatgggcaacgacttccccggtgccatggaccaccttgacttggacaacggaaccgtggcgcacgatttcgccgacgtgatcacctccgtggccgataccgctcacgtggtcgcctccttcaaggcagataagtggaccggtttcgacggcgctcccgccatcaccgtcaacgacttcggcgacggcaaggccgcatacgtcggtgcccgtctcggccgtgagggtttggccaagagcctgcccgtgctgctggaggaactcggcatcgagacttcggctgaggacgatcgcggtgaagtgctgcgcgtcgagcgtgcggacgaaactggcgagaaccacttcgtgttcctgttcaaccgcacccacgatgttgcggtcgtggacgtggaaggcgaaccgctggtcgcctcgctggcccaggtcaacgagtccgagcacacggccgccatccagcccaacggcgtactcgtcgtcaagctgtaaaaccgcgcatagcgcctaattaccgaaaggctcccctgctgctcatcgtagcaggggagtcgttttcgtatctccagcaaagtcgggtagggtggtcaccgtgcgaggcaaaaacagagtgacgatggcggacgtggcccatgaggccggtgtttcggtagcctcggtgtctaattttctgaacaaacagccatatatgagcgaggcgatggccgcgcgtattgcggaagccatcgacaggctcggatacaaagtcaactcgtcggccagaaacctgcgttccgggcgtacccggttgctcaagctggtcattcccgatctgcggcaggtgtacttctccgaactcgccgaggatattctggccgaggcccggcaacatggctacggcgtcatcgtggaatccaccaccaacaatcgtgcccgcgagctggaaagcatcgcatcgatgggcacgcacagcgcggacgggctcatcttaagccctctgatgatgacggttgacgatatcgcggctttggatggcgattacccgctcgtgctgttgggtgaacgtttgttcggcgtcaacgcgccgcacgtagtgattcgcaatcgcgaaggggccgccgccgcgacttatcacctgcttgatgccggttgccgccgcatcgccgtagtcggtgccgtgccccaccccgagcacgatttctcgtcgggctccatccgcacccacggatatcgtgaggcgctggccgcgcgcgacatcccctgtgatgacagtctgcttatcgaaacccaaggctgggggagcgccgacggtttggccgcggtggacaccatgctggagagtggcctgcaattcgatgccgtgttcgctttgaatgacttgctggcgtggggcgtgctgcgtgaactgcgcgaacgcggcgttgccgtgccggatgatgttcgcgtcatcggcttcgatgacgtggaggaatcggcctacatggtgccgtctctttccaccgttaaccccggcagggaagccatcgcccgactggccgtcgaatccatcatccaacaggtcgaatccggcagtcgcgctcctgcccaaaccatcgaggccccctatagcctctccctgcgcgagtcctcgccggcgttggcctgcgcctgatgaatccatggttcgaaatatccgaagtgaatgacaaggcccgtcaatcgtatggtgattgacgggccctggtcgtattggacttgactgtacttggtacgggcgtgactctccgtcttttagccgtggaattccacgctgatccaggagatggcgggaagcgttgccgtgcaggtgccggtggcgttcatcgcaatgtcgagcggttgcggcgtgacggcttcgggcgcttcggcggtgttggtgcggtacggatcgtcctcatgcaacagttgcgccttgccgagcgcgagcgtgccgagaccgggcaggccgggcagcccggaaaggtcgatggtgagcgtgtgcggggtgttggcgtcgcggttgacggcaagcagcagaccggtgcgggcctgttcatcccacgtgactaccgcgtcgatggccggcacgtcgccgtatgcctcggtatggatggtgggggagctgatggccggagcgtaggcctggccgcgcgcgtgaagggcggcttcggcgaacgggtagaacgtggtctgccgccatgccgggccgtgttcctcggccatgatgggggcgatgacgttgaccagctgggcgcgcgaggcggaacgcacgcgatcgcagtgcttgagcagggtgatcatcagggaaccttcgaccaccgcgtcggccgcggtgtagatgtcttccagcaaatgtggagacttgggccatggctcgtggtgcaaaccctgcgcggcctccgccttccactggtcttcctgctcgttccacttgtccgaataccatacgccccattcgtcgaaggacagggcgatgtctttggtgccgttattggcttcgcgcgcctgatcggccgcgtccgagacggtggcgatgaacttggtcatgtcttcggaagaggccaggaagtcctgcatggaggcggcggcccgggttttatggccgcggtcgaagtagtaggcatggcaggagacgaagtcgagattctcgtaagccttggtgagcacggtcttctcccacgtgccgaaggtcggcatataggcacccgaggaaccgcaggccacgagttcgagaccggactcggcgagcttcatggcgtgggccaccttatccaccgcgccggcatattcttccgggctcatgtggcccacctgccacgggccgtccatttcgttgccgatgcaccacatcttgatatccatcggctcctcgatgccgttggccacgcgctgatccgcccaagcggtgccgggcgcgccgttgacatactcgagctcgtcgagcgcggctttcagcccccgggtgcccatgttgacggcaagcatgatttcggtgccggctttctggctccagcggtagaagtcgtcgatgcccatctcgttggtttcggtgcaatgccaggccaggtcgcggcgcatggggcgattctcgcgtggaccgatgccgtcttcccagttgtagttggatacgaaattgccgccggggtagcgcacgcaggtgacgcccagctccttgaccaggtcaagcacgtcttggcggaagccgttttcgtcggcggtgggatggctgggctcgtagatgccgccgtagacgcagcggcccagatgttctacgaatgagccgaacagacgcgggggaacgtcggctaccggagtggcgtcggcgttgagggcgatgctggcgtccggcgtggttgcgttgccagttgtggagacgttactggccgtggtgccggcggcggtcggcgccgggctgctttcctgcttgtcgggatgggtggtttcggcggaatactggctgttgtgagtggtcatgagcgggatgcatctccttcggtttgcggttagtcaccatggtgcgacgtgtcgtgtttgcgtaaacataaaacatgtggtaccgtttcttaaaacgatacaagacttggaacaaaacgccaagtcccgtcgtttccaataacaaggaaggaaagaacgatgaagttcggcaagaagacaattgccctgattggtgctgtggccatgctctcctctgtagctgcctgcggttccacttctgccggggatggcggaagcaccggctcctctgataagaaggtcgagctgaccgtgtggtcctgggattccacactgcctcgtacggtcaagggattcgaggccaagaacccgaacattaaggtgaaggtgaccaacgccggcaccaacaaggacgagtacaacgcactgtccaatgccatcgaggcaggctccggtgctccggacatcgcccagatcgaatactacgcactgcccgaatacgtgattcgcggccacctcgagaacctttccgatctcggtgcctccgatttcaaggacttctacaccccgggcacgtggtcctcggtgaacatcaatgacggcgtctacgccctgccgatggattccggcccgatggcctggttctacaacaagggcgtcttcgacaaggccggcgtcgatccgactcaggtgcgcacgtgggacgacttctacgaggccgccaagaagattcgcgccgtggactcctacatcacctccgattccggtgacgccggcttcttcgactccatgacctggctggccggcgcgaccccgttcgagacctccaaggacggcgggaccgtgaccatcaacctgaccggtgacaagaacgtcaagaccttcaccgacttctggcagaagatgatcgacgaagatctcatcgacaccaagaccgtcggctggaccgacgattggaacaagggtctggatgacggctccatcgcatccctgctgaccggcgcttggatgccgtacaacctgctttccggcgctccgaacggtgacggcaagtggcgcatcgcccagatgccgaccgcagacggctccgagaccaactccgagaacggtggttcctcgctggccatcgtgaagtccgacgacaaggacaaggtcgccgccgcctacaagttcatggaatacgcctgccacgacgccgagggcattaagacccgtgttgacggcggtgccttcccggccgacaacgacaccctcaagtccaacgacttcctcaacatgacctccctgaccgactccgacggcaaggcccacgagtacttcggcggtcagaagttcaacgaggagctggccaaggccgcagccaatgtgtccaccggctacaagttcctgcccttcgaggtctacgctcgcggcaagttcggcgactacgccggcgatgcctacaccggcaagaccacgctctccgatgccgtggcttcctggcagaaggacctgcaagattacgccaagcagcagggctaccaggtgaagtaacggcaatcacagcagacttcctcctgtggtttctgtagcgggaggttgcgataacagggtcgggcactcttcggagcgcccgattttcttatgccatgggagcagtggcgcgcggattgcgataccaagatggcgtgttgccgaagaatgtgtataataaaagatgttatcgcaaccatagctacaaagtggcgaaacaaagccgttttgtgactactgaaccatagagtgatggttcacgatagcatgacgacgaggagagttgccatgctgttgtggtgacaatcactgcagaccgccgaaaggcgatccaaggaaggagaacagaacgatgaagttcaccgttgctaagaaggccattgcacttaccggtgcggttgccatgctgggttccgttgccgcctgcggttccgacaccgccagtggcaagccggctcaagataaggacgttaccgaaatcaccgtgtgggcttgggagcccacgctgacccaggttgccaaggacttcaccaagaagaccggcatcaaggtcgatctcaagaacgtcggcaccaacaccaaggaatacacccagcttgataacgccatcgaggctggctccggtgctccggacgtcgctcaggttgagtactacgccatcccgcagtacgccatcaagggcaacctgctggacatcaccgacaagacctccggctactccgacttctacacccctggcccgtgggcttccgtgcagttcgccggcaaggtctacggcctgccgatggattccggcccaatggccttcttctacaacaaggaggtcttcgacaaggccggtgttgacgccgagcagatcaagacctgggatcagtactacgacgccgccaagaagattcacgctctgggcgacaactactacatcacctccgacaccggtgacgccggcttcttcgactccatgacctggctggccggtgcaaagccgttccagacctcttccgatggttccgaagtcaccgtcaacctgaccgaggacaagggcgtcaagaccttcaccgacttctggcagaagctgctggacgagggcctgctcgacaccaagaccgctggctggtctgaggactggttcaagggcatggtcgacggcaccatcgcctccctgttcactggcgcttggatgcctgccaacctggccaactccgctgctgacggcgctggcaagtggcgtgtgacccagatgccgaccgctgacggctccaccaccaactccgagaacggtggttcttcgctggctgtgctcgcctccaccaagaaggctgacgctgcttaccagttcatcgagtacgccaaccacggcgacggcgtggccacccgtgtggccggcggtgcattcccggctgacaaggcctccatggagtccgactccttcaagaacaccaccactgtgaagaacgccgatggcgaggacgttgactacttcggtggtcagaagtacaacgaggttctggctcaggctgctgagaacgtgtcctccgactaccagttcctgccctacgaggtcaaggcccgcaccatcttcggcgactaccttggcaagtcctacaccggcgaccagaagctgactgacggtatcgccgcttggcagaaggcactgcaggattacggcaaggatcagggcttcaccgtgaagtaagccttgaaccctcgctgagactgcctagctaatctcacctgatacacaaagcctcgtgacgaatcccgtcacggggcttctaccgttttaagccccgcctagtacactcgtcaccatgcgagtgatcggacagcgaatcaaaagaatggcaaccatagcagtgactgccatcctttccgtatccttggcctcgtgcgggcagtccaccaccgataaccgcacggaaatcagcgtatggagctgggaaccgagcatgggcgaggtcatccgccgtttcgaaaaagccaatccggacatccgcgtgaaatggaccaacatctccggctatggcaatctcaacaccgccattcaggacggttacggcacgccggacgtggctcaaatcgaatactatgcactgttgcagtacgcggtctccggccaattgcttgatctgaccgacaaaatcggctcggattattccaacttctttaccctcggcacatggtcgtccgtgcagctcgccggccgtacctacgggctgcccatggattcgggcccgatgggcttcttctacaacgaagacgtgttccgccaagccggcgtggacgccaccaagatcaagacttgggatgactactatgaggctgccaaaaagctcaaggagattggcgtgtacatcgccgccgactcgggcgatggcagcttttacgatgccatggtctggctcgccggcggccagccgttccacacgtcggccgacggcaaaaccgtgaccatcgatttggatgaggacgccggcacccaacggttcaccgaattctggcagaaaatgatcgatgaggggcttgttgacaccacctccgccacatggtccgaccgatggaagcgccgtgtgggcaccggtaccatcgcctccgtattctccggagcctggatgccgtcgctgctgctgtccaatgtgccgggcgcggccggtctgtggcgcgtggctcccatgcccacctatgatggccagcccaccaacgccgaaagcggcgggtcggcactgaccgtactgcaattgacccgtaagccggatgcggcttatcgtttcgtggactttgtggcgcatgacgcccaaggcattagcgcgcgtgtggatggcggtgctttcccggccgattatgccaccctgaattccgctgattttttggataaaaccacgattaccaatgaccggggcattgaaatcccgtatttcggcgggcagaagttcaaccgtgtactgtcggaggccgccgaggatgtgtcggtcggataccagtatctgccgttcgaagtgtatgcgcgcagtgacttcaaatcgacggtgggccaggcatacgagtggtccggcagtttccacgcctatcagcagcgacaggaagccattgagatgggtatgaaggacaaggaaggcaacccgctcgaaccattggagaagcccggcaagagagtcagtctctccgacggcctggcccaatggcagaaagacctccgagaatacggcctcaatcagggctttacgattaagtagggattcggggttggatcggaatcgaccgcgctatacgcggccgattcctgcatactacgtcacttcacattgcgcgagtagatgtgcgccatgcccttgaaaatcaaatccgggtcatacacgtcaatcagctcggtgtcattctcaaacactcgaccgaggccaccggtggtgatcaccttgaaatcctcgcctccgagctctttgcggaactgacgaatcgtgcgctccacaccgcccaagaacgtgtaatacaaaccggcctgcatgcaggtcttggtgttggtgcccagaatcgtatctggtcgcgtaatttccacttccggcagctgggccgtatctccccacagagcggccgcaccggcacggatgccggtggtgatgacgccggaatcgaccacgcccttgtcgctcacgtgtgtgaacgtggtggcggtgccgaaatcagccaccagcactgggccgccatactcgtaataggcaccggcgcagtcggccagaatatccgcacccagcgatttcggatcgtcaacgcgcacgttcataccggtcttgatgcccggtcccaccaccatcggatcaatgtcgaggaatttgacgatggacgaacggaaggagtgcatcactttcggcaccaccgaacagatgatcacatcgtccacatcggatggctgaaaaccgctcattctcaggaattcagtcagaaacagcccatactcatcagacgtatggttggctttggtggtgatgcggtaggtgccggcgatggtatcgccatccaaaaagcccagcacgatgttcgtattgccgatatcaacggcgaccagcatgataaccctccagattcaagatggatttcatgcgcaattctacagtcccatggctatgatggcctgcggtggtcgacccagcgtggcggccaaccgtagaacacaacatatacagaggaagaaccatgtctcaagacaatggtgcgcacatcgaagacggcgcaaccacagatgcgagccttgcctcgcgtgcaaagaatccgaaaaaaaacggcccgaagtggtggctgatctcactgattgccgtcatcgtggcagtggcggtcgtcatcggcgtcacgctcgctttcggcggtaagaaagatgacaagtcggcctcgtccagcaaccaatatgccgacaccgtgaccatcggcctcaaactggcccccaccaatctggacatccgcaacaccgccggctccgcgcttgaccagatcctgattggcaacgtatacgaaggcatcgtggcacgtgactccaagaaccaggtcgctcccgccatcgcctccagctgggagacgtccaaggacggcctgacctacaccttccacctcaataagaacatgaccttctccaatggcgacaaacttgacgccgaggacgtggcctggtccatcaacgagctgatcgctaagggctaccacgacgccgacgcgctcgccgccgtcagcaaggtggaggccaaggacgccgacaccgcggtgatcacgctcaagacgccgaactccaacctgttgtggaccctgaccggtcgcgcagggctcgtgttcgacaaggatgccaagtatgacctgaagacgcaggccgtcggctccggcccctacaccgttgccaagttcgtggaaaacagctcgatcacgctgaaggccaatgagaagtactggggcaagaacaaggccaagacgcccactgtggtcgtcaagtatctggccgacgacaacgccgcggtcaatgcgctgaagtccggtgacgtgcaggtgctcgccccgattaccgagaacctcgccgaaccgttcaagtccgattccgccaagtacacggtcaaagccggcaacggcaccgacaagttcgtgctcggcttcaacaacgcttccggttccaaactggctgacaagcgcattcgtcaggccatccgttacgccatcaaccacaaggagctcatcgcctctcgcggcggtgcggacaaggcgctcggcggcccgatcccgtctctcgaccccggctacgaggatctgacgaatctgtacccgtatgatcagaacaaggccaagtcgctcatggctgaagccggctattccaccgacaagccgcttcaacttacgctgacctacgccaacatctacggcaccgagctcggagaccagctgcgctcccagctcaagcccctcggcatcgacctgaaggtgaatgtggtggagttctccacgtggctgcaggatgtgtacaccaaccacaccttcgatatttcgctggtggaccacaacgaaagccacgacttcgcatcgtggaccgatccgacatactatttcggttacgacaacaagaatgtgaccaagctgtacaacgagggtgttgccgccacctccgacaaggagcgtgatgccaagttcgccgcggccgccaagcttgtctccgaggatgcgccggccgactggctgttcaactaccgcatcaccaccgccacggccaagggcgttgaaggattccccttcgacctcaaccagaccgttctgcccctctacaacgtgacctacacgaagtagttcgttacagcaatgagctccctcagtgagggggctcattgttaatccaagtaaagtaggcattatgcgattcgtgttgaaacggctggcgttattcgtggtggcgttgttcggcctgtccgtggtggtttttgcagcattgcgcattctgcctggcgatgtggcctccgtgatggccggcgtcaactcgccgcctgagcgtgtgacccagctacgcgaacaactcggtctgaatcggccattgattgcacaatacttcgattggatgagtgcgctggcccgtggtgacttcggcacttcaatcctgactggtcgctccgtaacctccttggtaggcgcacgtgcgtccatcacctttcccctgattattcttgccctgctcatcgccttggtcatcggcttgccgctgggctgtgcggcggtactggcccgcagcgcaacggtgcgtgcggtgtttcatgtactggctattgtcggcggtgccgtacctgcgttgtggggcggtctgctgctgattctgttgttcgggcgcggcgtaggattgcttgatgtgtttccctcgcaagggttcccgctggatggttggggcgcacccggttcggcgatatcagcgttggtattgccggctgtatcggtcggcatcatcgtgggagcatcgcttatgcgatacacgcgcgcggccttaggggatttagccagttccggctacatcgatatggcacgctcgtgtggcatgacgcgcactcaggcggtgttgcgtgtgggattgcggttggcaaccccgcagctggtgtctgttatcgggctgaccttcgcttcgatggtcactggcgtgatggtcatcgaaaacctgtttgcgttaccgggcatcggcaacggtcttgtgaccgacgtgggcaaccgcgacctgattgccgtgcaaagcgagctgttcctgctggccgcgttctttttgactgtcggcctcgtggtcgatttgttccaccgcgtgctcgacccgcgtctgaaaaccgctaccgccattacggaggtgaccgcatgagcaatgttcgtcgtgcgacgactggtggtcgacgggctgccttcgtcatcgtcctgcactctatgtggcgtcgtgccgagggcaaattcgcacttatcgtgctcgctctgtggttgctcattgccatcgtttccctgttctggaccccgcaatcgctgtgggccactgatggctaccatgtatgggccaagccgtccgccgagcactggctcggcactgacggcaccggcgcggacgtgttcagctggctgctggccggctcacataccaatcttgtgatcgtgctgctgaccgtagtggcatctatggcttgggggctgctgctcatcgcggccatggtggcacgcaatgcggcgctcgccagttcttcggtagtggtagttgatgcgttgatttccgttcccaccgtgttgattgcgttgattctggctgtgccgttgggagcgtcaatcgcggtgattgtgatcgcctgcggcttcggatatgggttgaatctggctcgtgtggctcgccccgcagcgttgctggcggcccgctcgtcgtatgtggaatcggccttggccaatggtgccagcgggtggcgtgtgctcataagccatgttatgccgaatattctgccggtattggctgtgcaactgtcattgtcggcgggcacggcggtgttggctgagtcggggctcacttatctcggtatcggtgtgccgtccggtgtgccgagctgggggcattctctggccacttcggtcaaactcatcaacgtgttcccattaaccgtggtgtggcccggcctgatcgtcacggttgtggttgtggcgctgaatatttttggtgatgtgctgcgcgatgccatcgatccggtcaccaaccccgcattacgtgaaataggaggcgaacgatgagcgtcgatgttcgcgggttgaaaatcacgattggcggcaaaccaatcgtctctgatgcggatatgaccattgccgacggtgaacgagtcggcttgatcggttcttcaggctccggaaaatctatgattgccaaggcgatgctggggttgctgcccctgaccgctgtgactaatgggtcgattgatatgggcagcacggaaattatcggagcttccgaacgtgcgcttgccgacctgcgcggccggtatgtgggtgcggtgttccagaatccggctgcctcgctgaacccggtgatgaccgtggcgcagcagatcgccttgccattgcggttgcactatgatctgaccaaggtcgaacgagccgaccgagtgaatgccttgttgagcaaggtcgggctggatctcgatatggccggcaaatacccgcacgaactgtccggcggccaacagcagcgcgtgggcatcgccacggcgctgatcacctcaccgcgattcatcatcgcggacgaacccaccaccgcactcgactccatcacgcaacgccagatcgtggacctgctgacctcgctggtggacgacgccggtgcctccatgctgttcatcacccacgatttctccgtactcgcgcgtgccaccacccgctgctacgtgctggacgccggccgcatcgtcgaatccggacccaccgccgacctgctcgccgcgccgaccacaccacaagcccagcgcctggtcgccgccgcccaaaccctcaccctccacaccccaaggaggattcgcatgagtaacagcagtgtgccgctcctctccgcccactccatcaccaaatccttcggcccgcgcaccgcacgccaccaagtcctcttcgacgtctccgccgacgtccacgccggcgaatgtctggccgtgatcggcggctccggatccggcaaatccacgctgacccgcattatgctgggcttggaatccgcggactccggcagcgtggaatacgagagccaatccattgtcggcggccgaaaatcgccgggattcgcggccctgcgccgcgaatcgggactggtgttccaggacccgttctcctcgctcgacccacgttggcgagtcgccaaatcagtggctgaaccgctgagtctgcaacggcgtgacctgaacaacaccgatatcgacgagcgagtggccgcggctctgaccatggcaggccttgaaccggcagacttcctgaaccggtacccaatcgacctgtccggcggccaggcgcagcgcgtggtcatcgcccgcgctatcatcaacgagcccaaagtgatcctcgccgatgagccgatgagcgccatcgacgtggccgcgcgcattcagatcctcgacaccttcgccgccatccgcgcggcccggccgagcaccgccatcatcatggtctcccacgatctcggcgtggtacagcacatcgccgaccgcatcctcgtgctccatgacgggcgtctcgaagagacgggttccaccgctgaagtgctcggcaacccccaatccgattacacccgtcagctcatcgaggcagcctcgttatagaccttttttggctccctctctgaggggagctgtcgaacgcagtgaggctgaggggagttacgggtgccgtcgtattcccctcagtccgcttcgcggccagctcccctcagggaggggagccgaggccgccggcgacacgcgcttgtcgcgggttgtgctatggtgtgagacatgcagattatctcatgttgttgtcgctaaccgacgcccctgggcgagcggtcagtgacgcataacttgagatagagcattcgaatcgcggcaaatctgtcgcatgaattttcatgaaatcgatggcacgagtgtaaccgtgtaacgcgcgagtcgtggttaacatgaaaaaccgattcactttccggcttcaccgtacagtgagcggggatactcgatttcaaactaaagccacagtccattcgtctgggaacgtcggttcacgaacgcaacgcagcaaaaccccacaaccccagcaacgaaggacttcacatgaccatccacaacagcctcgcagaactcatcggcaacaccccgctcgtcaagctcaaccacattccgcaggcggccggcgtcaaagccaccatcgccgtcaaagtcgaatacttcaaccccggtggatcttccaaggaccgcattgccgaacgcatcatcgacgccgccgaacagtccggccaactgaagcccggcggcgtgatcgtcgaacccacctccggcaacaccggcgtcggcctggccctggtcgcccagcagcgcggctaccgcacgattttcaccctgccggacaaggtctccgaatccaagcgcgcggtgctgcgcgcctacggtgccgaagtcatcgtcacgccaaccgacgccggcccggacgacccgcgctcctactatcaggtcgccgaacgactggccaatacgattcccggcggcttccgcccgaaccagtacgacaatccgaacggcccgctgagccactactacaccaccggacctgagatctgggaggccacggaccacaaggtcacgcacttcgtggccggcatcggcaccggcggcaccatctccggcaccggcaagtacctcaaggaagcctccaacggcgcggtcaaggtcatcggctccgacccggaaggctccatctactccgcttcctcacgcgacgaagtccaccagtacgatatcgagggcgtaggggaggacttctatcccaaggccttcgaccggaacatcaccgacgacatcgtgcgcgtgtccgacgccgaagcctttgaaatgacccgccgtctggccggcgaggaggcgctgctggtcggcggctcgtccggcatggccgtggtcagcgccatcaagtacgcgcttgccaatgatttggacgagaaccagatcgtggtggtgctcgcccctgattccggccgcagctacttggagaagatcttcaacgacgactggatgcgtgccaacggctacggcgacatcgtggagcgcaccagcaagccctccctcgccgagcagtaccttaacggagctccctctgatgagggagctggggacggactccataactagctatcaaaagaatcaataccaacatccgcactaaccaaccgcacctgttctaccttcgaatacggaacgatcccgaaaggaacccaatatcatgtccgctgaatacaacgccaagttcgccaacaccgacatcgccactcgcgccatccacgccggccaggagcccgacccgaccaccggtgcggtcgtcacgccgatcttcgccacctccactttcaagcaggatggcgtgttgggcctcaggggaggccacgactactcccgctccatcaaccccactcgcaccagcttcgacgagcagctcgccgccgtggaaggcggcaagtacgcgctgagcttctcctcgggcttggccgccatcgacgtgctgctgcgctccaccatcaagcccggcgacaacatcctgctcggcaacgatgtgtacggcggcacctaccgcctgctctccaaggtgttcgtgccgtggggtgtgggcctcgacgtggtgaacatcaccgatctgaaagccgtggaaaccgcattggcctccaagcactaccagtatgtgtgggtcgagaccccgtccaacccgctgctcaacatcaccgacatcgcggccaccaccgaagtcgcccacaagtacggcaccaaggtcgctgtcgacaacaccttcgcctcgcccgcccttcagcacccgctggccgatggcgccgatgtggtggtctactccaccaccaagtacatcggcggccactccgacgtggtcggcggtgccgtggtggtcaacgatgaggagacccgcgagaaggtcgccttcctgcagaacgccgccggcgcagtgccctccccgttcgactcctggctggacatccgcggcctgaagaccctggatctgcgcgtcaagcgccacagtgccaacgccctgaaggtggccgaatggctcgaatcccagccctctgatgtgattgagcgcgtctggtacccgggcctcgagtcccacccgggtcatgaaatcgccgcccgccagatgcacggcggcttcggcggcatcgtctccgtgcagctcgcggccggcgccgaggcggccaagcacttcgtggaccacacgcagatcttcacactggccgaatcgctcggcggtgtggaaagcctcatcgaggtgcccgccgccatgacccacgcctccgtggccggcaccaccctgcaggtgcccgccaacctggtgcgcatttcggtcggtatcgagaacgccgacgaccttatcgccgatctcaagcaggcgttggatcgtatctgaccgtactgacggtactggtggcaccgtattgacggtgccaccacgcttatcggcggactcgctatcgattggtacctacaaaaaatccccggcccacaagggtcggggattttccgttatcgattaaacatattgaatcagctggcgttgccgccctgccatccagtggcatccgcaccagccgggcgcaacgtctgaccggaagtcggtgtggtgccatcaacgaccacacgagtgccgatggtggcaaagtcgtacatccacttggcatcggccacctgcatgttgatgcagccgtgcgagcctgggataccctgctgcacatagatggggtgctcgccccacatgtatgcaggaacaccgtgcagagcctcgccgccgttatagtaggaaacccacggcgtgcctggctggttgtagccttcgccaaccatggtctgcgattcgtacttgagatacacgtagaacgtgccggtatcggacagcatggaaccatcggcggtgggcttgccagaagcgatgttgaacttcttgaccaccgtggtgccctgatatgcagtggcagtctggttcgtcagatcaacatgaacccacttatcgccatttgccgtatcgaagttatgaggcacctcgacctgcttgacatcatacgggctgtctttcacagccacagtggaatcagtggactggttctgctcgatggcggtagccagacgttcgggggcgtccccggcgccagtcacttcaataccatccacgccgagtgtcttatcggcaccaatttccacgccgccttcgtctttcggcgtgatgtagacctcgcgtgtcaccttgggaacagtcagttctttggttacgctgtcactggtgacgtacttggtgatggcatcgcggtcgactaccagactcatggtgccttccgccttattcaccgtgggcttgaggaatgaggcaatggtatcggccgggatggtgacgctcttgttcacgccgttgtctacggtcagtttgaggccaagcctggcattggcgtcaaactgtgtttgctgtgcgctcgcgtcatcaatcggattctttgcggtctgtagcttgaccggcaccgtcgcattttcgcccggggtcgcgacggcctccttgactgcagcattgacaacattggtatccgggcccttgccgtcctgacccgcggtgtagtcgaactgtttggtgctcttgttgtagacaacggtggcaatctgcgctcggtcggcctcatcgaccaggccggcggtgacgaattgttcggcagtctctttgtccgtggtggcggtcagagcgatatgcggctgatcgaaaatattgagcttggccacgtcgccggtcttcgcgttcaacagcgcatctacggttttatccgtgtcgacggtgacgccaaggtccttcagcgaggctttgacgctgttgccttcggcggtgaacgtcactgtggtgttattcagctgctgcttcacagtattcgcaagttcttcgcgggtctggcccatgacagagacattgcccaaatgaacaccgggcgcagccttgtcttggaagtaccaacgtccgacgaagaaataggctattaatgcggcaagcaacactgcaaatatggttatgatggcaatccgtgcggccttgccatgtgatttagcggtggtagatgccataacatgttcacccacataggctgtattatcggcatggttattggtgccattgtcactttgctgtggtgtggcggtacctgaatccgcggctgcgaacagcccatcggtggccacaggctgcagcaccgccgtctcctgatcgtcaggagaggagaaggaaaatgtatcgttggccatcaaaatgccccgtcttagttctctcaaagcggcatatcgtgcgatatgccgggaataacgttccttgacgcataataatacggaagggctacgtacatcgttgcgaggtattccgttatacgctgaaatccagccgcggtcggcctacactggtcgtttatgacagcacatcaggcggcgctggaggcgctcacacgatacttcggctatgactcgtttaggcccggacagcaaggaattgtcgaggctttgcttgccggacgcgatgtcttgggcgtgatgcccaccggcgcaggcaagtccgtgtgctaccagattcccgccgcgctcagcccgggtatgactttggtcatatctcccttgatttccctgatgcgcgaccaggtcgatgcgctgaacgacctcggtctgccggccgcgttcatcaataccactcaaactcccgacgagcaggcgatggtgttcgcccaagccgccgccgggcagatcaaactgctgtacgtggccccggaacgcttggaaaccgggcgattccgcgactttgccgcccgtacgccgatctcgctgatcgccgtggacgaagcccactgcgtctcccagtggggtcaggacttccgctcgtcgtacttaggtatcggcgatttcatcgccgggctgccgcagcgtccaccggtgggtgcgttcaccgccaccgccaccgaacgggtgcgccgggacatcgtgggactgctgggattgcggaatccggccgtcaccgttaccggattcgaccggccgaacctgtattttgatgtggtcaaactggaaaccaaatacaaggccgcatgggtggcgcggtatgtggccgaccatccggacgaatccggcatcgtctactgcgccacccgcaagaccaccgaagcgctcgccgacacgctgaaccagatggggcatccggctgtcgcctaccatggcggcatgtcgccggacgcgcgtgaggtggcccagcgcgacttcatcaccgacaaggtgccggtggtcgtggccaccaacgctttcggcatgggcatcgataagtccaacgtgcgttacgtcatccaccacaatctgcccgaatccattgaggcctactatcaggaggccggccgcgcgggccgtgacggcgagcccagccgatgcacgctgctgtggaatgagtcagacatcgtcacccggcgtcggttgctggataacgattatgagaacgaacgattgactcccgaagagcaggagatcgttcgccagtccaagcgccggctgctggacggtatggtcggctactgccgcaccaccgactgcctgcaccggtatatgacccggtatttcggtcaggaattgtcgccgaatgctggttccacggcgggtgaagacattgcggcggactcttcgcagtccggcagatgcggtgcctgctcgaactgcgaaagcacgttcgagaccatcgacgtgacccgcgtggcgcaggcgatcagccgttgcgtgcatgacgtggggcagcgcgtcggttccggcaagatcgtcaagatcctgcgcggttcgcgggcacaggatctggcatggctgaacccggagcggatgcccaccttcggcatgctcaaggacgtgaacgaggctcgcgtgcgcgacgtgttgagccagatggccacggacgggtacctgtcaattgccgaagggcgtatgccaatcgtcatgttcggtgcgcgggcggccgaaaccgccgctcccgacttccactatgagatcaaacgggtggaacgcaagtcggaggcggccggttccggtcggagcgggggagtggctgatactgccgattccgccaatgttcccggcgatgcgctgggctcgtatatcccggacgatgacgaggaatcgctgttccagaagctacgcgaactgcgacgcaccatcgcccaggaaatcggcaagccgccgtacatcgtgttctccgacaagaccttgcgcgacatggcccgcatcaagccggttaccaacgcgcaatttctggcggtcaacggcgtcggtcaacacaagctcgacctctacggccagcgcttcatgcaagccgtcgcctcgttcaatgccgggagtgcgtcataacaatctcctatagcgaactgcggagtatttgcgggcgttcttgggctggctcgactacgatgactgttcgatgcttcatgaccgaacactcggcaagtagaaaggcaacagcatggcagaagaaacggccgaaaagcccgtcgtcgaatcattccagcttgatcacaccaaggtcaaggcgccgtacgtgcgttacatcgacaccgaaacgggccctcacggcgacgtgatctccaactatgatctgcgcctgacccagccgaacaagcaggccatccccaccggcggcctgcacaccatcgaacacaccatcgccgtgctgctgcgcgaacgtatcccgggctacatcgactgctcgccgttcggctgccgcaccggcttccacctgctgacctggggcacccaccccaccgaggaagtggccaaggccctgaaggaatcgttggagttcatcgcgtacaaggccacgtgggatgacgtgcccgccaccaccgagaagagctgcggcaactatcgcgaccacagcctgttcaccgccaaggaatgggccaagcagatccttgaggaaggcatcagctccgacccgttcgagcgcaaggtcgtctgatcgcaagccaatcggcatggaagaaccccgcccccgcataccacgcggacggggtttctttgtgcctatgtttgtgcctatggcatggtaggtttgccgtcagttaatcgttggccgctgcacatcggtagcttggcatgttggagaggtggaagtgactcagtcgaacgctgcaaacaaggcgacaggccgccgtttccgccacgccaccatgcgcgatctgccgcagatgcagaaaatctacgcacgcgcacgcgcgttgatggccgccaacggcaaccccacccagtggggcaacgaatttccgcgtgaatcgatgattgaggacgacatcgccaaccagcgtacgatgctgctggtcgacacctgcaatggccacgaacgcattctggcccagttcgccctgtgcccgggcgaggatccgacctacgccaaaatcgacggcgcctggctggacaacgacgcctatgtgaccatccaccgcatcgccgcatccggtctggtgcgccacgcggcccgcgactgtatcaggtgggccctgaagcactacggcaacgtgcgcgccgacacccaccccaataacaaggccatgcagcacgtgctcgaaagctccggcttcgcccgttgcggcctgatccagctgctcgaccggccggtcgacaccaccagaatcgcctatcagcgccacgagtggtgagtgtggctgccggctgatgtgctcgtttctgcaccgtcatcggtttctgacggtagaatcagtgtgtgagaagaacacgttgggtcgggggcgtcgtgacggtgcttgcggctgtcatgctgtcgtcgtgcggcggcgtccagtcgaatcccgggtaacacaccgttgccaatccattcaccgcgcaggtgaatggagaagacatggcgatgcctgtcggccgatggagccccatcggccgacaggcatcgaggaagtcaccgtggccggcggaacgcgcggtcgccgattggggcgaatggcttgtgtggttcgctttggtaccagtaggcgaccgtggccacgtcgtcctgtcgttcgaagttgccggcttcctcggtgccgatctgctgccattcgacgcgcaggtctcgctcgaagtagatcgggtcggggatgtgccaacggtataggccgcgggtcacgggggtggcagtgtcccagtaggcgctttcgcgtccggcgaggttctgcgagtagaacgggaagccgaggtatgggccggtgaaggtgcgctcgtgcatgcggccgtgttcgtcgaattcggcgaagctccaggcaccgccgaagtagtcctcggcgccggtgctgcaccaggtggggtatttgccgtcgccgtcgatgtagaacttgaattcgccttcgccccaccagcggctttcgagcgcggtgagcgccaggtaggtgccgacgtaggtgccgtgtccttcgacgccatcgagcaccacgtagtcgtgggcgagttcggtgacgcgttggcggcgccactgcgcgtggaagcgcatcgtgtcggccggcagctggtcgtattcggtgtagtcgatttggtagaagaacgcgggcacgtcctcgttgtggtcgttgcgcagcacgatgcgcgcgtgttcgaacggcatggcgaagtagcagttgaagccccggttcgggttgaccatgacgggaattgagttgatggtgcaggactgggcgtgtccgcagcagaagaagtcgccgatcgggcattgcaccgagggggagtcctcgccgtcccagtagaattccaggatcaggttgcgtagcacgtcggggccggtgggggaggtgcggtcggttaccgtcatccagatgtgacgaatcacgccggggtcctcgacgtccatcaatgtcaccgattccccggacctcaccgtgctgatgcaggggcttcccttgcgggaggggcccaacgcgctggccgccatggccgcgcggcccttgccgccgtccgggttttcggcgttgatgcagcgggtgcggccgggggtcctcatggccacggcatccaaggcgccttgtccgagccccggcgcggggttcgctgtggtgaatgcgtcgagcatgatgcttacttcctttcctgtcgcaggcccgtcccgccacggcgttttgtctgggggcgggttctagtgatcgttgcaacacctgacctaccgcaaggagggtcaggtgaccagaagccaccgaaacgaagaccgtggcggggaacaccgttggacgttcaacggcgtcgaatatccgacgaggaagctgatgtgcgaggcgagacgcgccgagtacgtgcgcctgctggacgaggaaggcatgaacttcacccaggccgcgcacgcggtcggcgtctcgaaacgcaccggcaaggcgtggcgcaacggcaggacgcgcgccacgggaaggaacgagaaacccctggtggactggtatcgttccaccatggacaaacccaagaccctccatccgcgctacctgagccaggaggagcgcatccagatcgcggaccgtctgcgtctgggcgattcgatccgcgccatcgcccgcctgctgggccgcgaccccggcacggtcagccgcgaggtcgagcgcaacaggaatcccgagtccggcggttacgagccttaccgcgcccagcagaaggccgcggaccggctcaaacgccccaaaccgcgcaaggcggccgagggcacgcgactgtgggacgagatcgccgccgggttgcgcaggcattggagcccggagcagatagccaaccggctgaggctggacttcccggataatggggatatgcacgcgagcgtcgagacgatctaccaggccatctacctgcaggccaggggcgaactcaagcaggagctgaaacgcgccatgaggcaggggcgaaccgcccgcagaccccaaggcggccaaggccgcaaaccccgtttccgcgaacccatggccatgatctcggagcgacccccggagatcgaggaccgggcggtcccgggccactgggagggcgatctcatcaccggcagccgcaacaaaagcgccatcggcacgctcgtcgagcgcaccaccaggttcacgatcctgctgcacctgcccgacgggcacgacgccgaacacgtccagcaggccatcatcgacaagatgcagcacctgcccaaactcctgcgcaacagcctgacctgggaccagggagcggaactcgccctgcacaaacggatcggcgcctcgctggacatggccgtctacttctgcgacccgcactccccgtggcagcgcggcaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaaaccaagcgagaagatcatcgaactgctcgacgccgcgtgataacctcaacaaccgacaacgtgaccatggaaggccgctcaaacctcaggtgttgcaaccaccactagaatctgccgggtgagccgggctgctgggggggtatttcacggcaccggcggtgatgccctgggagagcttgcgctggggtagtgcccgatatcttgcgcactttggtcttcgcccgtccctgtggcgatgatcggttcgcttcccgtacagtctcaccgagtcttgacatgtcgaggtagcggcgcgtcgaccactcgttcgacgtgacatagcgcacgcgtgcgcagacgagcatcaacgcgctgcgttcgtcggggaagctgccgaccatgcgcgtgcgccgtctgacctcgcggttgcgggggtgaccctggcgaggacgttgcgttcgaagtgcaccatgcaccgctggtagcgggcatcgcgttcaaggtctccttgacgctcttgcggaccatacggtccagggtggtctccgacatggcctcatatcgcaaaaaccgtacgctgaaagtaactcagcgtacggttttcacgaaagcagccatcggctatcggtcagccgatagacctcagtcctcagtcctcagtcgcagcgaccttggcgtcagccccggccttctgctcaaggccgagcttggagcgcttgcggctgtagccgaagtacacgatcaggcccagaccgaaccagacggcgaaacgcacccaggtctcccagttgagaccggcgatgagcacgaagcagaatacgatggccagaatcggggtgaccggcacgcccggcgcgcggaagccgcggggcgcattcggctgggtcttgcgcatccatagaataccggccgacacgatgatgaacgcggacagcgtaccgatgttcaccagctcgaacagcacgttgatgttgatgaagccgccggcgaacgcggtcagcagaccgaagaaccaggtgcccttgaacggggtacggtacttctcgtgcacgtggccgaagaacttcgggaacaggccgtcacggctcatggcgtagcagatacgggattggccgtacagctgcacgagcatcaccgtggtcatgccgatgagggcgcccaggttcacgatcaccgcgagccagttcatgccggtctccagaatcacgccggccaccggggcgtcgatgtacttggcgaactccttgtagggcaccacgccggtcatgatcagggtcatgatgacgtagagcacggtggaaacggccagggacagcagaatgccgcgcggcagcgtcttgttcgggttgatggtctcctcagcggaagaggacacggcatcgaagccgatgaagctgaagaacacgatggaagcggccggcacgatgccgtacggctgggtggagccgggctggaaagtgtagatgccgtacggggagaacggctgccagttggacggcttgacataccacacggcgcacacgatgaacagcacgatgatggcgagcttgatgagcaccatcacgtcattggtgcgcttggtctggttgatgccgatcgagagcacccacgtgatgatcagcacgatgacgaaaccgggcaggttgaagtaggtggtgacgtccgggttggtgccgtaggcggcggtcagttcgaccggcaaatgcaggccgaagccttccagcagcttgttgaagtagcccgaccagccggcggacacggtggccgcctgcagggcgtactccagaatcaggtcccagccgatgacgaaggcgatgagctcgccgaacgccagataggcataggagtaggccgagccggaaaccggcgccatggcggcgaactcggcgtagcacaggccggcaaaaccgcagcagacggcggccagcaggaacgatacggacagggccgggccggcggtcagcgcgcccttaccggtgagcacgaagataccagtgccgatgatcgcgccgatgccgagcatcgtcagatcgaaggtgcgcatcgtgcgcttcaggggagtggattcggcgacaagctgatccacgcttttcttacgaaacagatccatgttcttctctcatgaaatctaggattatggggctgaaccggacggatttccgggatcccggcacgcctcaacgccgggaatcaaaggcggcttccgagaaaccgcatatcggtcattagtgtacgactgccgggcgaaaacagacgattgcgactacacgtcacattctcgcgcaacaataggtgtctatgagcatgaacgcagcacctgaaatcgcattctcgtccgagcagggcaaggccaactatgcggccgcccgccgccaataccccgcacaggccatcgtggacctcaaaaccatgcgcgacaacatggcccacctggtctccgtggtcggcgggcccgcttccggcacggcggtgatgggtgtggtcaaggccgacgcctacggccacggactgctgcccgccgccctggccgcgctcgccggcggcgccacatggctcggcaccgcgcagtcgcacgaagcgttgctgctgcgcaagctcggcatcggccccgaccgttgccgcattctgacttgggtctacaacggcaccgaagtgccatttgatgagctgatcgccgccgacatcgacgtatcggtcggctccctgcccggcatcgacgcggtggccgccgccgcacgcaggctcggcaagcccgcccgcgtacacgtcaaggtcgattccggcttcggtcgcaacggtttcacgccggccggattcgacgccgcgctcgccaaactcgtgccgctcgccaaagggggcgtgttgcatattgtgggtcagtggagccatctcgccgtggccgattcgcccgatgtgcccgaattcgtgtcctccaccgaccgccagatcgaaacattcaaggacttcacgcgccgcatggaacaggccggcattccgccggagatccgtcacctggccaacacggcggccactttggaccgcccggagattcacttcgaacttacccgccccggcatcggcctgtacggctacgagcccgatcccgcgatgggcaccccgcgcgactggcatctgaccccggccatgcgcctgcaggcgcagctcggcacggtcaaggatgtggaggccggccatggcatctcttatggccgcacctacctgaccccggacaacacctcgaccgctattgtgccgctgggctacgccgatggcatccaccgctccgcttccggtttcgatatggaaggtgccaagcacgtggagaagccgggcggcccggtgcgcatcatgaccactgaaggtccgaagctctaccgcgtgtgcggccgcgtgtgcatggaccagttcatcgtggacctgcacggatccgccgccgaactcggcgttcacgagggcgacacggtcgaactgttcggcccgggccgcggcgaggattacgttgagcctaccgccgacgattgggcccgcgccgccgacaccatcagctacgagatcttcacctgcctgcgcaaccgcatcccgcgcctttacgagcatgccgccgaagtactgcccgccgccgacctcgccaaactcgaccccgcgacgctgctataaggtgcattaacgccatacggtggcaccccgtaatcccttcttcccgaatatgtgccactgatatgtgctgagcgtcacatattcgggaaatcggccccaatctcccgaatatgtgccgttgagttgacgtcagtggcacatattcgggaagtcgggattactgcggccgatatgtgtgcctatgcttggcatatggaaacgactttggatggggaacaggtgctgagcgacgagggctacagcgccttcgacgaggagcgatgggcacccgagccgcccaaatccaagtcacgcactgcgttcgagcgcgatcgcgcgcgactgattcattcgtccgctttgcggcgtttgggcgcgaaaagccagattctgattgccggtaccgacgatttcgctcgcactcgactgacgcatacgctggaagtcgcccagatcggtcgccaaatcggcgcattgctcggctgtgatccggacgtggtcgactgcgcctgtctggcccacgaccttggtcacccgccgttcgggcacaatggggagcgtgcgctcgccgacatcgccggcaatatcggcggcttcgagggcaacgcacagaccatgcgtatcctgacccggctcgaacccaagatctttcacccggacgggcgttcggccggcgtgaacctgacccgtgcggccttggatgcggccgtcaaatacccgtggaccttggccgaagccgaccgacacccgaaggggagcggtcgaagaaattctgcgtctacccggatgacgaaccggtgttccgctggctcaaaatcggcgcgccccaggccgccaaacccatggaatgccagatcatggacctttcggatgatatcgcctactccgtgcatgacgtcgaggattccatcgccaccggcgcgttcgatccgattgtgctcgccgatccgaagatgctggaccacatcatcgagcagacgcgcgcatggtatggggcgaagtgggatgccgacaagctgctggccgcgttcatgcgattgcgccgagagcatttgttccctgcacatttcaatggttcgcgcgaatcgttggcgcagcttaagaacattacgtccgatttgatcggccgcttctgctggtcggtggagaccgccacgcgcgacacgtatgggcccgggccgttgacccggtattcctcgaacatcgtgattcccgagaacacgaattacgagatcgtggcactgaagggcatcgccgtgtacttcgtcatggcgcctcgcgagcgcgagccattccatcaggaggagctcaagatcgtatcggatttggtcgatgtgcttatggccgattcgccgctcccatccgacgctttggaaagccagttcctggccgattggaatgaatccaccaatgacaacgagcgcctgcgcgtcgccatcgatcaggtcgcaagcctgaccgacaactccgctctggccctgcactccatcttgtgctgagggcgtgttggacgggtgcttccctcagtctcgctgcgcgagccagctcccctcgggtgaggggagctgtcgctgtaggcgactgaagggagtttcgcggaagaaatgataaccgacggtaaaaatttaccgtgtctcaggtgaggcggtactctagagacttatggtcggaatgattaagaaagaagatgtcgagaaggtgcgcgccgccgcggacctgtatgacattgtatctgcgaccgtaacgcttaagccctccggcaccggcaccttcgtgggcctgtgcccgttccacgacgagaaaaccggcagcttcaacgtgcgcccctcactcggcgtgtggcactgcttcggctgcggcttgggtggcgacgtattcaaatacgtcgaacaatccgaaaacatcgacttccgtgaagccgtggaactgctcgccgacaagtaccatatcgagctgcactacgagaacagcggcaacggcccgaaccgcgagaacaccggctccaagcgcacccgactgctggaagcctgcgaggaagcccaacgcttcttcgtctcccagatcctgaccaaggaagcactgcccgcccgcaagctgctcggaggccgcaacttctcccaagccgactgcgaacgtttcggttgcggctacgcgccccaaggttgggataatcttgtgcgccacttggcctccaaggggtttacgcagaaggaaatcctcgacgcgggcttggcccgccaaggccagcgcggcatctatgactatttccgcggccgcgtgacgtggcctatccgcgattcgaccggccgcacgctcggcttcggcgcgcgcaaactatacgaagacgatcagatcgccgccaaatacatcaacacgccggatacgcagctctaccgcaaaacccaggtgctttacggcatcgatttggcgaaatccgccatcgtcaagaagcggcaggtggtgatcgtcgaaggctatacggacgtgatggccatgcacttggccggcattgacaccgccatcgccacgtgcggtacggcgttcggcgccgagcacgccaagattgtgcgccgcctgatcgccgacgattcgctgggtgcggtccagctggtcgggccgttgaaggtcaaggaccagccgttgagctcgcgcatcgtgttcacgttcgatggtgacgccgccggccagaaagccgcgctgcatgccttcggccttgattcggccttcctctcccaaaccttcgtggccgtggccgacgacaatctcgacccgtgcgacctgcgcatcgagcgaggcaacgaagcagtgcgctcgctgatcgcccgcgccaaaccgttgtatgacttcgtgattgacgccgccatcagccggttcgatctgacctacacgcccggccaagtgggtgcgatgaaagccgtggccccgctggtggcgcagattcgcgaccgctccctgtgggacgcttacgtgcgcaagtccgcgggccgtatcggtgtggaccttgaggtgatgcgccgcgaggtgatgaacgcacgccggcagatgcatgtacgcgatgaggacgcctacgcgcccaaacgtcgattcgagcgtgacgagccgcgtgtggaacccggcaccaacccgtacgccaatccggccacgcgcaaggccttggagcgccgtgacgccgccgaacaggcatatttcaagatcgacgacgccgtattcatcgccgaacagcagttcatggccgtgctgattcaggtgccgcgcgccatcgaccgcaccatgttcgggcagctgaccatcgaccatttcatgacttcggtgttccgcaccctgttccaggcgatcgcggccgccggcggactgccatccgacgataccccgcaggggctgtggatgcacaaccttaccaaggccggcgggccgatgctcaatcaggtgatcaacgagctggctgtcatgcctctgcctctgcctggcgacgacagtggcaacggtgcgcagccggtgcaggccaacgtgtcgggaggaggtgttggcgtgaatggcggtgccgccgcagtacagctgcgtcctgccacgccggaggagcagcgctacgccactgagcttctcacccgattgttggacatgggcttcatgcgccagatcggtttggccaaacgccgcatggcccaactgcccgacggcgaagagaagataaccctcctcggccaaatcgcccgcatggaaaccgcccgcaaagacctccaagcccaaatctacggcaacaccatcggctaatacccccccactgattgcgcgcatcctcgaatacgtgccggatgcataagtccatacaaccggttgccggattggatgggtgcagaagttgcggattggccccatccaaattggactggtttgggtgggccaatccaatccgttcaataatgaagcgcgataccaagcagcgtcgaaacgaagggaaactcatgacgcagaatcgtgcggaactcaaccgtaatctggcccagatgctcaagggtggtgtgatcatggacgtcaccacgcccgaacaggcgaaaatcgcgcaggatgccggcgcatgcgcggtgatggcgctggagcgcatccccgctgacattcgtgccgccggcggcgtctcccgtatgagcgatccggccatgatcaagggcattcaggaagctgtctccattccggtcatggccaaggtgcgtatcggccacatcgccgaggcccgcattctgcaggccatcgaaatcgactacatcgacgaatccgaagtgctttccccggccgacgacgtgtaccacatcgacaagaaccagttcgacgtgccgttcgtgtgcggcgcgaagaacctgggcgaggcactgcgccgcatcgccgagggtgctgccatgattcgtaccaagggcgagcccggcaccggcgacgtgattcaggccgtgcgccacatgcgcaccatgaacaagcagattcgcgaactcgtcggcctgcgcgacgacgaggtctacgaggccgccaagcagctggccgtgccctacgatctggccaagtacgtgcacgacaacggccgtctgcccgtcgtgaacttcgccgccggtggcgtggccaccccggccgacgccgccctgatgatggagcttggtgccgaaggcgtgttcgtgggctccggcatcttcaagtccggcgacccggccaagcgcgccgccgccatcgtcaaggctaccgccaactggcaggacgccgatctgctcgccaagctgtccgaaaacctcggcgaagccatggtcggcatcaatgaggacgagattcagaccatcatggccgctcgcggcgagtgagtgcattaccttggctcccctctttgaggggagccaggaaagggtgacgctcccgccagcgggagtcaaggcccaaggagacaacatggttgtagctgttgaatatatttccaaagaagaatccgcggacgccaaaaacgccaagcacggcgtgaccggcatcctggccgtacaaggcgcattcgccgaacatgcggcggtgctggacaagctcggtgcgccgtggaaactgctgcgcgcagccgaggatttcgatgaatccatcgaccgcgtgattctgcccggcggcgaatccactacacagggcaagctcctgcattcgaccggactgttcgagccgatcgccgcccacatcaaggcaggcaaaccggtgtttggcacttgcgccggcatgattctgctggctaaaaagctcgacaatgacgacaacgtctactttggcgcgctcgacgccgtcgtacgccgcaacgcctatggtcgtcagctcggtagtttccaggctactgccgattttggtgcagcggatgatccgcagcgtatcacggacttcccactggtattcatccgcggaccgtacgtggtgtcggtcggacccgaagccacggtcgaaaccgaagtcgatggccacgtggtgggcttgcgtcaaggcaatatcctggccaccgccttccacccggaactcacggacgatacccgcatccacgagctcttcctgtcgctgtagtcgattcgtctgccgttagactggtatccgattgacgaatcaaggagacgatctgctatgcagcttgagttgaatcgacgcagcaaggtgccgatgtaccggcagctggccgccgagctgcgtgaacagatcgtctccggcgcgatggccgagggctaccgcctgcctcccgaacgcgagctgtcctcacgtctcgaagtcaatcgcaccacggtgttgcaggcgtatcagcagctcaaggacgaaggtcttatcgcctccaaagtcggcaaaggcacgttcgtgctgccggctgcctccgcaagccgaacatcgcacacgtcaaacagtgacttcgggaatgcaataacgcgaacaacacgatcgtcggcagaaatgggaacatcgcaagcctcctcttccggcgacgtagaacgtgctacctccactgatttcttgacgacagaccagggcagcagctctgcggcggtccatacgattcgtgaaagccgttcggttcagggcccggaaccaaccgtcgtgcgtccgccatggtcggtgttgttctctgattattccaaccggtttacctaccatgacatcgcctcggccgagcgggcgcagcgcggcgacaccattattgacttcgccaccggttcgccgaacccggcggatatcccggacgatctgctgcgcaaggtcagcatcgaagcattcgaatcgcgggaattcgacggccaaccggaatcacctatcgagggattcgaagagttgcgtgcgctgcttgccgaacatatgcgcgcacgaggcgtacaatgcggcgtccgcaacgtgatggtgctctccggctccgagcagggcattgacctcatcgtgcgtgcgttcatcaaccccggcgactgcgtgctggtcgaacaatccacgttcttcccggcattgcagaccttccgttcggcggatgcgcgcatcatcggcgttccagtggacgagcacggtatgcgtacagacctgttggatgggtattgcgcgcgattccggcccaagctcatttacaccgtcccgacattccaaaaccctaccggtaccacgctgccgcccgaacgacgcagcgaactcatcgacgtggcgcggcgctatcagtgtctgatcgtggaagacgatgcttacggcgatttgtggtacggcggggaatcgtctgacgcacatcgccccatactgctcaaaggcatggagaatgcgggatacgtgatgtatttgtcgacgttctcgaaaaccgtcacttcgggcctgcgcacgggatgggttgtggccgacccgcatgtgatcaaccggctggcggctctgcggcgcatggtcgaccagcatacgagcacgtcatcgcagcgcatctgtctggaactgcttaaagaaggccgcatcgccgaacatttgcgcggtttgatcaaggcttaccgcattcgacgagatgcagcaatcgcagcattggagcggtatgcgccggatgaagtgtattggaccgtgcctgcaggcggctactatatttgggtttccttaccggacggcgtgcgctctctggatgtattggaatcctgccgttcccaaggcgtcacgttcatgccgggcagcgtgttcgacgttgacgaaatggatgattcccatattcgtctcaactttgtgcgcccggatgctgctgacattgataccggcattcgaatcattggcgagacgatagcacagatgtagccaagtgactggctcattgcggttgtcgagttttttgatggctgcatacccacatcgatgggtgcattcgacgaatgaataagcgaggaagccatcatcagttcgctgtggcatgcgcatagcgttgtcgggcgaacggggcagaccacgtggtcgttgcgtgacctggccgatcgagccggcatcgcattgcccctggcgtagtggcgaggtggcgcagtaacgagtcacgccatcgcgagccgatgatgcgaaatgcggaaccggtcgcggccatcaacggctatcatacatgcggaagcaacgatacgttggcgtcagcacatccatctgactccagaaagggacacgatatgaccacatcctccgtttcgccggtgaccactgaactggcgggcagcgaaaccggcatcacgtttatcattcacgccggagcgggcagtcgtggcaagcacagcacgcctgaacgcatcgcccaggtcgaacttgatctgcagcgcgccctcgatgccggataccagttgttggaatccggagcaccggcgcatgaggctgtggtcgccgccatccacgtcatggaagacgctcccgaattcaacgccggccgtggtgccgccctgaccagcgatggcatcgcccagatggacgcctgcctgatgaccggcgatggcgaggtcggtgcggtcaccggcgtaagcaccgtgaagaacccgatcgatgcggcgcgtgccgtcaaagagcagaccaagcatgtgctgttcgcggacccgaccgatgccgagatcgccgattggggcgtcgcgaccgaaagcaacgagtacttcatcaccgaacagcgtcgtcagtccttggccgaggctcagtccggtggcgatgagtgggagaagcatggcaccatcggtgccgtggcgcgcgatgccgagggcaatatcgccgccggcacgtccactggcggcatcaccaaccagatgcacggtcgtgtgggtgattcgccgctgcctggttgcggcacgttcgccaaccagtccacggtggcggtgtcctgcaccggcatcggcgaggcgttcatcaaggtggtcgccgcccatcaggtgtcggatcgtgtgcgtttctccggcgagaacgtcgaggatgccgcgacggccactttggacgaagtcgccgcgcatcatggcgatggcggcatgatcgttctgccggcggtcggccgtggcgtggtcgcctacaacagcgagatgatgaacttcggataccgtagcgcgcaaggaggtaaggtgcagggctgattgccccctgtattgcggcatatatcataatggccggtgtgctgcggattcttggtaaggaatccgcagcacaccggccattcatgtatgcggcaagtgccgccgatcagtgcggcagtgcgcgctacttggtgatcgtgttgtacgtgggcatgttcgtgtaatcgaactgcacgttcttcacgttctgtgcagacacggcggcgaaacgtttgaccgggaatactggggtaatacgcaacttcatcgctcctcttcctcgaatgaaactgtgttccattgctatgagccagccacgtacggtattcgtgtctggcctgccacacaatgatgcagccgtatatacgggcacagcattgcgcggcagttcattgtatggaagacatgcaaactcaatgtttccttgtccaaataaaaaaacgagcgcggctgatgtgcggcaccggtccaaaaactcatgtccgccagcgcaacgcgactacgtaccttatgctggtctgcgcgtaaaatagaatggctgcgatattgggttattcacggaggaatggatgcgacgctggctgatcaatgtagccaaaaatgagacgattctcatcgtcgccgcaatactcgccctgatttcgtgtttcattgtgccgccggacgccgattacaaaagctacattcacgccagcaccatcagccagctcatctgcctgatgattgtggtgtgcggattccagcgtatcggcgtgttccgcatcatcggttcgcgattgctggagaaggtcagcaccatgcgcggactggtcattacgcttgtcgctttgacgttcttttccgcgatgttcatcaccaatgacgttgcgctggtcacgtttgtgccgttcgcggtggccgtgctcatcatggctgggcaagaggataagaccatcctcgtggtcacgctgatgaccattggcgcgaacgtgggcagtatgctcaccccgatcggcaacgcgcacaacctgtatctcaaagccctgaccggcatgccgaccatggaattcctcggcatcatggcaccgtattccggcacggcggccgtgttgctggtcatcgtgatttccgtggtgtttggcggcaaaccggtcggcgacctgggcgacctcgaaaccggcgtgctggctcccgagcgcaacaaacaccagcccgacgagattcgtatcaccggctacggcgccggttatggcggctggcgcaccatcgtctactcgctgctgttcatcgtctgcctactggccgtctccgacgtgattcccctgtgggtgatgtgcgtgatcgtggtcgtcgtgttcctgttcaccgatcggcgcgtattcaaatacgtggattggggactgccgctcaccttctgcatgttcttcatcttcatcggcaacatgaagcgcgtgcccgaattctacgaactggcgcgctcgctggtcggcggccatccgctggaggtggcggtcggctccagccaggtcatcagcaatgtgcccaccacgattctgctttccggcttctgcgaccaatggcgcgatctgatcattggcaccaatttgggcggcatgggtacgctcatcgcctcgatggcctcgcttatttcttacaagaacgtcgtgcgccaatacccgcacaagaaaggccggtatctggccgtctactccgccgtcaacgttctgtttttggccgtattgctgaccttgagctggatcatcgagccgagtctctgagccgccgttgtgggttgggccggtctaccgcgcgtatacggtgggggagccggtcagtcggctcatggccgactgcgggatgtcgtggatgcggccgatggtggcatccagcgtggatacgccggatacgccgtctgtgttggctgtgttggctgcagaggtgatgctggatacgccgactgcggacgatgatacggccgcaaccatcggctgacgataggcgttggagttgcgggccagccgggcgagcgcagggcgctgcctgcggaacagattgataaacataccgcatactccttcatcgttggccggcggtcttctggccgccgtggtttccatcctgccctcccgtgcttgtattcgctatggggatagcccctattattccctgaatctgcacgattccccctcatccttgagggtgattctaacggcaaaggaatcggcctaatggccgatgtcgatcagcgcgaagccaccagcgtgacgctgtacggcttgatcttcatcgccagcaatgaagacggcgacggcaatgtgtaagcccgacgttccggcacaatcgcccccgaagcctcgccgcggtatccgatagtggttttcgccgtcggactggcgcttaacgtcgtcacctccaaacgcaccggtcgcgatggcgaggcgcccagcccggccagtccgcgcgcgatttccaacgtcacatccaccggggaatcggaggtattgacgattttgatgtaacggcaggcgtcatccccgtcatgcccggtggcactgacatacagatgtttggcggggcgtgacgcggtctgctcgatggacacggcatatgtcgtgtcgcccagatgcgtggaaaacagccgctccacctcataattcaccgtggggttcacatgcgccggattgagttcgataagattctgcgcccaccccttagccgggatatgcgcgagcagcggtgcataggaggtcatgcgcaccacgtcggaattgcgctcgcaaccggtcaggaacgcggcctcgccgagtgccgacttccacgtgttcgcgccctgttcggtctgcggttggccggcaaaatagccgttggctgaatattcgccgaaatagacgccggcgccgcaacgcgggtaagcgtcgaatcgtgacgcttggtatgcaaaccattcggggagtggtaagaatgttcgtcgatgataatcgcgtcaccggtggcggaatcatgtgccccggaatcggttgcggccaacgctcgcgcatggtcccagctgcgcttcatcgccggctggaaggggaacagtccggcgctcatcacacacagcatatccgggtatcgttcatgaatggcctcgctgatcatgtcaaacttggccacgtagtcagccccgaagttttcgttgcccacgccgatcatgtccaagccgaacggctcaggatggcccatatcacgccggaccgcggcccacgagctggactccggatcgccattcgcgaattcgatgaggtccaggtagtcctgaatcacattgttgcggaaggtggccgaattgatatccatgtggcgcggatctcggccgggcgactggcatgcgatgccggcgaacagagtaggcagcggcttggccttgaggtcctcgcacaggcagaaatattcgtagaaaccgatctgatagctctgcgaatagctggaaccatccggcatcttgaacgaccacatcgaatactgttggcgtcgcgcggccagagagccgacggtatccttccagcgatactcattgccgggcgtcacaccttcgacgatgcagccgccggggaatcgcagaaacgctggatgcaacgcctgaatggtctccaccaaatcgcggcgcagcttgccgtaacgccatttcgggtcgcccgcgccccaatagtccgcatccatgaactgcaccagatccagatcgaacgtggtgcgttcgccggcgtcaatggtgatacgcagcttgccgtaatcggtgttcagtccggttacgtcggcgttgaaccggtaccagccgtcacggccgatgacgatggcaccatccgacgaatccggactgatcgaaacgccggaatcctgcgcatcggccccatcgtcctgcctcagaccggtctcttccgtatcgtcaagcggatcggagtccacgatatacgacaatcgagtgatactggtgagcggcaggccgtacctatcgaccacgccgacggacagctcggcccgcccatgaaccggacgtaccgcgagactgacggaataggtgtggtcggcgacgatggagaacgcgggctcgcccccgttgtcgccgcctccgttatagccgaggttttccagatatgcagggccggtttcggaaggaacatcggacgtgatgcgagcgtatcggctatgtgcgtgaattggcggggcggggcagtcggtggtcacccgctggccgtgaatcccgcgtatctcactgccaaggccggcggcggaacagttgatgaaatcccagaaacgcagggaatcagcctgcgtacgccaccgttcggcaccggccatacgccacgtgtgatggtcgagataaacgccgtcaaaactgtagttgttcaccatgttggcgttcagcccgccatccgcaccatggttgatgtcctcgaagaacacgccgtacagtcgcccgcttgtgtgatgggtggggcttcccacgctaatccgcaccatggtttcgattgtagagggaatggagcggaaaggtaaacggaagagttcgctcaccgttcatgttgcggtcaatccaagtcgactgttcgccggtatacagccggtaacctcgaaacaggaatggaaaatacggacgactaggagcgcggctgtgcaatcctcggtgggaatacgtgagcgcatcgaccacgtgtatccgtcgctgcgtccggcggagcgcgccgtagcccagtatattcggaatcatatcgaggaggcggccgacctgaccgtcggtcagatggccgacatcgcccacgtcagccagccgacggtgattcggttcgcccgcaagctcggcttcggcggttaccgtgaactgcggtacgtgttgcgcaacccggccgccgaacacaaagtgaccttcaatccgctggccggattcgatctgaatccgtgggatggcgaagatgagattcccggtaaagcggccgatggcgcgaaggcgctgatcgacgagctgcacagtgcgttggaccccaaggcctatcgcaaggcggtcgccctactcgccgaatcggagttcatcgacattttcggcgtggagaattcgttgacaccggcgatggatctgttcaccaagctcggctacctgggactgacatgccgtctcaataccgacgcttacctgcagcagatcggtgccgggcacctgccccacggcgctgtggccgtcgccttctcccattcgggcagttcggcggatacggtcaaagcgttgcgattggcgaagtcgcatggcgcgaaaaccatcgccataaccaatgccatcggcgcgccgctggccagctgggccgacgtgacgttgctgacgggtcgtgattcgcacacgatctatggcaatgcgattttctcgcgcgtggccgataccgcgctcgtggacatgctgtacatgggcgtgattctgtccgactatggccggttctccaccgcgctcgacgaatccggtcgcatgattcgcgaccgcgtattcgagaactgagctgctgctttatcgcgccttgggccgtattgctctggtcgttgctgcttgggttgttgacgatttggtcgttgtcgccctggtcgctaccgtcctgaggcatgtgccagcgaatacgtagtggacttggcgtgcgtatgacgttcgatcttgccgctcaactccagctggtccaagagctgcgtcatctgatccttgttcaggccaagcgctttctgcatggttttacggctgagcttcacaccgcggaacgcgaggaaattgagcgtgaactgttccaacgtttgaggcgacggttccagcgttgccgtatcaagcgggcgggtactggcctgatcgtcaccgtccgggcgttcgccgaatccactgccgagaatcagcgtctgcagtggcgcgcagccgatgatgcgtgcgccggccaaagcatctgcggcgttatccgtcatgcgctgaatcgtggggaatgagtacattttggcatgctgtgcttcgtcagtggtgctgggcgcggcggaagcatcggcatcggtccgatgcgaggacgcggcctcggccgatacagggataggcagtaccattgccaccgaagtggggcccacgcgcagttgcggactgaccgcgctctgcgcgtaggcgtccataatgcgttgaatgccggtaccgcagttctcgcagaggcccaaatcggcgaacaattcagccaaacgcggggtgcgtggctggcatacgccgttgagtagatcgttgatttccaaaccatcggtcaggccgccgagcgacacgatttccaagcgggaatcgaagatattgatcagtgtggggccggagtacgtgtaatcgcgatgttccagtgcgttgaccaatgcttcgcgcagggctatggccgggtattggccggattcgttgatgccgttcagcagggcgctggcttggtcgagctggcgcagcaccgagccggtgaatgtgtgacgttcgcgaatggcgtttttgccattgccctcgaaaatggtggccttgataacgaacgggcattggttggacagcagggtggcaagcgacgattcggtggtgctggtgaaggtgttgttggtgccggtgttggtgatgctgccggcggggacattaccggcatcggcagagacggatgcagccatgttggtcacaaccgggctttcccaatccttgccttcactggcaaaacgatcctgtgcgtatgtgaaagtgagctcaccgctatcgcctgcgacggtctggcccgatgcggcgtgatctacgttgctctccgttgtccccatatcgccgatggtaccggtgcaagccgacgttacgccgaggtgttttacacccctacggctagacttacacgagtttggccccgtagctcagctggatagagcatgtgacttctaatctcaaggtcgacggttcgagcccgtccggggtcacgatgtaataagcccttggtccctcatcgtttgtgaggggcaggggcttttgaatattatgccggtctgggtccgtctggagcctgaactgtcgaccttgagattagaagtcacatgctcatcaccaccatccgggaacacccttaaggggtgcgtctcctgcataacggctatactctgacttgagatgtgctgaataataaccagctatcgcgcgtccgccaatggcgacgaacgagggaagaaggcccgtgccacgagcaatcatcgaggtaagaaacctacgcaaggaataccccgtcgaggatgagacggtggtggcgcttgaccgtgtcaatctcagtatcccgcaaggccagatctgctgcattttcggcgaatccggctccggcaaatccacgctgctcaaccagttggccggcatggaaaaaccgacgcgcggcggcgtgagaatcggcggcgtacccgtcagcaaactcgacgagcgtgagctggcggccttccgccagaagcatcttggcttcgtattccagtcgtacaacctgctgcccaatctgaccgcgctcgaaaacgtggcaatgccgctgatgttccgcggcgtgcccaaggaacagcgcgaacgtgcggcgcgtggcgtgctcacaagggtcggtctgggacatcgtctcagccattacccgcgccagatgtcgggcggccaacagcagcgcgtcggcatcgcccgggcgtttgtgaccaagcccgaggtggtgttcgccgatgagccgaccggcaaccttgactccaaaaccaaaaccgaggtcatgacgatgatctgcgcattcgcccatgacttcaaccagaccatcgtgctggtcacacacgatccgcagatggcctcatacgccgaccgcattgtcaccttgctcgatggccgcatcaccagcgatcggctcaacaccgacctttcccgcccaactgttccgtccacgccgtccgcccaaagaacccaaggagttgaccgatgaagcacctctcccaccgcaccatcgccatcatcgtcgcgttgctctccacgctgtcactggcacttgccgtcatctcccttccgcaccaggcgtacgcagtcgacggcacagacggcacaagcggcacgaacagtacgtctcagggaagcgacggcgattccgcgccaatcgccggcccggtgccgaacatcatcgtcaccaacttcacctatggcggcgattccgtggccgccggcgccgatttcaacctcgacttcaccttccagaacatgggtcaggtggcggtgacgaacatggtcatcaccgtggacggcggcgagagcttcgccatcgcgggaggcacgaacacgttctacgtcgacgcgctgtggggcggttacgccatgacgcaaagcgtgccgatgcaggcgctcgcctccgcgaaaagcggtgcccagcccgtgaccgtgaacttccgatacgagtatgtggacgccagcgcccgctcctcaagccagtccgatgtcaagatttccgtgccgatcagtcagcctgaccggttcgaaatcagtgatcccgtagtgcccgaccaggtgatcgccggtcaggaaaacacggtcacgatggaatatgtgaacaagggcaaaggcgatatcgccaacgtcgaggccacgatggagggcgaaggtttcgatgccacgatgaaaacccagtacgtgggcaatgtggcttccggcgccaccggcacgattggttacgcctttacgccgcacgcgtcaggcgagctgaagaccacgctcaaagtcacgtacgaggattccgacgggcagaccaaaaccaaggaattcccgctcgccatacccgtaaccgatatgcagccggtggatgattccgacatggccgatccgaacatggaccagagcgccaatcagggattgccggtgctggtgtatgtggtcatcgtcgtgatcgccgtggtcattatcgtggtgattgtgctgctcgtgcgtcgccggcgcaagcagaaggccaagaagaacgatattgatgaggactgggatgattggtccgaaggcaaggatgataagaccgataccgacgtgacggatggtgctgcggcagacaccgctcctattgcaccagcctcaccagcctcaccggccggcccgtcccacaaggcctgaaaggcccgaccatgcgattcggcgacatactgcggctttgcagacaaaacctatggcggcgtaaatcccgtacgattctgaccgtgctgggcgttatcgtcggctgctgctcgattgtgctcatggtctctttgggccagggcattaacgagcagaacgagaagatgctcaaatcgatgggcgatctgtccatcgtcaccgtgtacaccaacggttatgccggtccgatgggcggtggcggttcgtccgagatgggcgataccaagctcgacgacaaggccgtggaatccttccgcgcgatgagcggcgtatccggcgtgacgccgatgatgaacttcccttataacgtgacggccagagccggcgcgggcggccgttacctctacgattacgtgcagatcatgggcatcgacatgacccagttcgaccagatgggctacaagctcgtcggtggcgagaagccggtcaaaaaggatcaggtgcttgccggcgaatggttcgcctatggtttcatggacaccctgaagaacggcgaacaacgcaccagcacacgcggcggtcagtattcctcatgcacgtttgaccagaccaccggccagtgcgaggaagaccaggacgaggatccgttcttcgatccgctcgccacgcaaatcagtctgaccaccggcaccaattatcagggcgaccagtacaccatgaacatgtacggcggcggtggcggcacaggcggtgcgggtggcaacaccgcgggtcagtcggaaaacgtcacctttgatgtgcgggcttccggcattgtggcgggcgactacaacaaaggctatgccacctccgacggtctggtcatggatttgcaggcgttgaaggaactggccgccaaagtcgatccagccgccgccaaaaaagccaccgcctataatcaggtgctggtcaaggccgccgacctcaagtccgtgcccgaagtcgaatcacagatcaaagcgttgggctacgagacctcctcctatgaagacatgcgtaagtcgttggaagaacagtcgcgcgcgattcagctgattctgggcggtatcggtgcggtttcgctgttggttgcggccatcggcatcgccaacacaatggttatgtccgtaaccgagcgcacgcgcgagatcggcattatgaaggcgcttggctgctacgttcgtgacattcgcgtcatgtttcttgcggaggccggcgcgatcggattcttcggcggattggtcggctgcgtgctgagcggactgatatcgctgggcatcaacgttgtcggcgcgttgtatgcgggcggcatgagcggcggcatgtctggcggtatggtcagcggtgcaggcgggggctccggcgacggtaccggtggcggaacatctatctggaccatactctggcaggcgatagttggtggcgagaatgtgacccgttattcggtgattccgtggtggctgttcctgttcgtcgtactgttttccacgctgatcggcttgctgttcggcttcggcccggccaataaagccgttaaaatcccggccctagacgccatcaaaaacaacgagtgatcgcctctgtcacctgctccaccgttagtccataacgttcgttcagttcgcccagcggcacgcggtcggtaaattccttggctgcgccgaagttcagcacatgaggattacggctgccgtccgagacatgatgattcgcataatatgcggtcactttctcgccccagccgccttcaagctgcccgtcttcaagggtgatgacctgctggtggccatcacgcaacgactccagtacgtctgaatccagcgacgtgcactggcgcgggtcgataaccgttgccgtgatgccataatcggcagacaatgcggcggccgtctgctccgccaacggatacgcattgcccagtccgataatcgcgacgtgcgagcccgtctgattgacccgccaatccagcatgtgacgcacaccggcacgctgagccgttacgctaacggtcccgcggactgttgcggcagatatgcccccgctggcggagctgacggagactggcagcgaagttgactgggggcggtcagcgatctgcccacccgtcaccggcagcagcgtcgcatcccgttccgccgccagaatcgcctcgcccggcactcgaatcaccgccggaccagcaggggcgtccgccgaaccggccggcgcggtagcccatgccagatcagccagatagtcgcgagccgaagtcggcaccagcatcgtaacccctggaatattggagaacatcgtcacgtcatatgcgccggaatgcgtattgtccgaaccggacaggccgcccagaaaatcaagtaccgtgacccgcgaacggttcaggctcatctcctggaagaactggtcgtacgcgcgctggaagaaggacgccgtggtggccaccaccggcgtgccacccgcccgtgcgatgccggcagcgtacgccacggcatgcgattcggtgatgcccgtgtccacgtaatgtgcgcccgcgcgctctcggaactcatgggtgatgccgttcgagcccggcgtggcgggggagatgaccacgagtcctggctcggcggcgaaacgcggttcgagcgcggccatcgccattttgccgtaatgcttgcgcggatcgtccggcttgccgattgcggcatccggattctgccaatgcgaggcctcgcactggccttcatgtggttcatggtcggacaggttgcagtgatccgaatgccacggctcgctgtggttcacgttatcggtggggtgcacgccggtgggggagtcgagtgagaccggtaaggtcgaggcgttttgttgattggcgtgagtctcctcactgtcatatcccgcgcccttcaacgtatgaatatggaccaccaccggatgatcgatgccgcgcacctcttcgaaggccgagaccagcgcggcgacgtcgttgccggattccacgtaccggtaatccaagccaaacgcgttgaacagattcggctgggcggtgccaccggacgcgcgcaggcgggcgagcggaccgtacatgccaccgaaatcgccggcaatcgacatctcattgtcgttgaacacaatgatgagattgccgccctgctcagccgcgttgttcagtccttcaaacgccacgcccgaactcagcgaaccatcgccgatcacggcgatcacattgccgatgccgctgttcgggccttccatatcgcgggttttcgccaaaccgcaagccaatgaaatcgaggtaccggtgtgaccgagcacgaactggtcgtgtttgctttcgtccggattggtgaagccggtcacctcgctgaaacggtccgggtccagataggcggcggcgcggcccgtgagcattttatgcacgtagctttggtgggatacatcgaacacgatgcggtcacgtggcgaatcgaatacgcggtgcagggccaccgtggcctccaccatgcccagattggagccgatatgaccgccgtgttggtggccatatgccagcagcgtggtgcgaatctcacggcagagttcggcgagctcgttgggggcaagggccttgacatcggccgggctggcaatgcggctcagcagatgggagtcgtcgccatgggaaggggtaatgctcgggggtatgtcgtgaaggcgtgcggtcctctcggcagcgccggagacggcgaaggaatcgcttgaatcaaatccgtttcctgacgcgctgcgcataccctcgaatctcccttcgctagtctttccgaagttgaatgctaacgcccggcattgtccgaggtccacatgacgaagcaatgcccccaacatctccgtaaatgggtgattcgttcgctgcgcgatgtgggacaatgaatgcggtaattccttttgataccaaggagcgcgcaatgaaggccgtatacgcatccaccgtcaaccatgccgatccgcttgccgcgttggcagtgggcgagcagcccgaaccccaggcccgcccgttctggtcgaccgtttcggtgcgcgcggtgaccgtaaaccatcacgacgtctggtcgctacagggtgtgggtctcgccgccgaacagacgccgatgatcctgggcaccgatgccgtgggcattctggacgaggacatccccggcaagcatgggctcaaggccggcagcgaagtggtgctgtacacgttcgtcggcaccgatggcgcgggcgtggccccgggcgagcgccgcacgatcctctccgagaaatatcccggcacgatggccgagaagacttccgtgccgtccgccaacgtgttcgccaagcccgcaagcctcaccacggctgaggcggccgcactcggcaccagctggctgaccgcctactcgctgttgttcgatgccgccggcatcaagccgggcgactccgtgctcattcagggcgcgggcggcggcgtgtccactgcggccatccagctcgcccatgccgccggtctggaggtgttcgtcacctcgcgcgacgcggacaagcgctccaaggcgctgaaacttggcgcgaacgccgcgctggagatcggtgcccgcctgccgcgcaaggtcgatgcggtgatcgagtccgtgggggcggccacatggggccattcggtgcggtcggtgcgtcccggcggcaccatcgccatctgcggcgccaccaccggcgaccagcccggtgcggagctcacgcgactgttcttccaggacattcgcgtgcagggctgcaccatgggttcgcgcgaggatttcgcccggctgctgcgcttcgtggagcacgccgacctgcatccggcgatcgactccgtggtcagcgggttggacgccgcccccgaggcgttcgccagaatgatcgccggcgacatgttcggcaagatcgttattgagctgtaagcctcacagaattatgtattgagaacgattcgctgcgtggcttaactccgctatcaggagtacagtgggccttattctcaataactagggagtaaatgataatggcaaatgaatccaagcccgaagtcgcagtggtcatgggatcggccagcgactgggagaccatgaagcgtgcctgcgatattctcgaccagttcggtgtcgtctaccacaagcaggtcatttccgcgcaccgcacgcccgagctcatggccgagttcgcgcacaatgcccgcgccaatggcctgaaggccattatcgccggtgccggcggtgccgcccacctgccgggcatgatcgccgcgcagaccacgctgcccgtaatcggcgtgcccgtgcgctcccacgccctgtccggctgggattcgctgctgtccatcgtgcagatgcctggcggcatcccggtggccaccaccgccgtcggcaactccggtgccaccaacgccggcctgctcgccgtgcagatgctctccgccttcgagccggaactggccgacaagcttgaggattaccgtaacgaactgaaggaaaaggtggccgaatccaatgcccagcttgtctgaagaaacgggcggccgcgtctccatgctgatgccgggctcgaccatcggcatcatcggcggcggccagctcggccgcatgatggctctgtccgcccgctacatgggcttccgcgtcggcgtgcttgacccaacgccgaactgcccgaccggtcaggtggccgacttccagatcaccgccgagtacgatgacaaaaccgccatccatgatctggccgtgcagtccgacgtgctcacctacgagttcgagaacgtggacgccggcgccatcgacgaggtgcgcggcatcaccgccaccccgcagggcaccgacttgctgcgcgtgacccagcaccgcgtgcgcgagaagcagttcatcaacgaccacggcaccgccaccgcaccgtggcgcgctgtcaacaacttcgatgagcttgacgccgcattgggtgatattcattatccggccgtgctgaagaccgtgtccggcggctacgacggccacggtcagctcgtgctgcgttccgacgccgacttggagaagatccgctcccgctccgaccgtggtggtggcttcccgccgagcatcctggaaggcttcgtcgacttcgcattcgaggcttcgattctggtctccggcaacggcaaggacttcgtcaccttcccgattgtgcgtaacgagcaccgcaacaacatcctgcatatgaccatcgcccccgccgaggtgtccgaacatgtggctcgcgaagcgcatgaactggcgattcgcctggccaagggcttcgaactggctggcacgctggccatcgaactgttcatcaccaaggacgatcaggtcatcgtcaacgagctcgccccgcgcccgcacaactccggccactacaccatcgaggcctgctcgatggaccagttcgacgcccacatccgcggcatcgccggctggcccctgcccaagcccaagctgctctcgccggccgtgatggtcaacgtacttggccagcatgtggaaccgacgcgcgcgctgatcgccacccacccggagtggaatgtgcacgactacggcaaggccgaagtgcgccacgaccgcaagatgggccacatcaccgtgctcaccgacgacccggccaagacggtcgctgaccttgaggccaccggctgctgggacgacctgaaaaagaaggcgtgaccttaccgatggttgaacatatcgaacgccagaccaagcagaaggacgcgattcgcgccgccttggccgactgcgaggagttcatctccgctcaggacctgcaccgcaggctggaggacgaaggctcgaaaatcggcttggccaccgtataccgccagctcaacgccttggccgatgccggtgccgccgacacgatccgcctggacggccagcagctgttccgcctatgcggcgacgacggacatcaccaccacttggtgtgcaggcggtgcggcaaaaccgtggaaatcgacccgcccagcgaggcttggctgcgcaaagtggccgacggtcacggcttcaccgttgaatcccacaccttggaggtcttcggactgtgctctgattgccaaaaggagcagaaagcgcagaaggctcagaaagcagtgagcgaataacaaatgggatcggcttcaaagccgatcccatttgttattccgctgctattccactgacttcagcgcgccgagcatgctgtttctttgaggtcgtgttctgcacgatgcctttcacgccgtccagcttcatgagcttggcgctgcgcgactccacattggaggtctcgtggttcttgagccgcaccatataggcgttcgactggtgctgctcgccgaacacgtgcttatagccacccgaagtcatgaacatgaaatgcccgaagtagggaagccggcttgtcacgcagcttgcgtttggccgctacccaggccggtaccacggtgctcgcccaggccagcaggaacgccgccagggtgatggcagggtggaacgccagcatgacacgccgatgtaaatgcaaatgataataattctcaatacatgttattctgtcgtgttggtggctgggcgatgatgcagcaacagcagcatcgcccagccgttcggctaattagagaggaaaacccaatcatgtccatcatgtccaacgccaagcgcgcgctcgccatcgcggccgccgcggcgaccctgctctcgatggccgcctgcggttccagcaacgccgccagcggcaagtccgattccagcggcgccgcgtcttccggcaagatcgaggtcgtcgcctccatcaaccagtggggttccgtggccgaagacctcggcggcagcaacgtcgaagtcaccaacatcatgaccaagaccaacgtcgaggcgcacgattacgagcccaccagccaggatgtcgccaagttcggcaccgccaaggtagccgtagtcaacggcgccgattacgacccgtgggccaccaaggccgcccagccgaccaaggccacgctggtcaccgccgccgaaaccgccggcatcaaggaaggcgacaacccgcacgtctggttctccgccaaggtgcgttccaacaccgccgacgccatcaccgccgcctaccagaaggccgacccgagccacaaggacgactacgccaagctcaacaaagaatggcacgccaaggaagaccagcttgagtccaagatcaaggagacttccgccaagaccgagggcctgccgtacgccgccaccgaatccgtggcctggtacctggccgacgacctcaagatgaccgacgccactccgaagggctacgcccaggcctccgccaacgagagcgagccgaccccggccgacatcaaggacttccaggacaccctgaaggccggcttcatcaagatgttcgtcttcaacagccaggaagcaaactccactactgaccagatcaccggtgccgccaaggacgccaacgtgccgatcgtggagctcgccgagcagatgccgaagcagtacaccaacctgctcgactggatgagcgcactggtcgaccagttcgccgccgccgtgaagtaatgcggcagtagccgtcaatccgcaacagcgataaggggaataatcaagtcagatagcgaggcgttgtctaggggagaacagaacacttcgctatcagggataggctccttatatatcagggtgcttcggggatgtcccgaggcaccctttgcgttagggtgaatagttaggaaacggtaagaaaaatagtggaactatggattttccaaggttcagcggcaacaatatgcccttgaaaagtcacatacggaaacaggcgaatgagcgagaacactagtaataccaccacagtgaaaccccatttcaagctttgggccaaaaaggtcgaagccaatgaagtcacgccccaacacccccacaagcccttccccggctgggtgtatggcgtgctcttcgttatcttcgacatcattgtcgtgacggcgctcgaagtgggcgtttcgtccagctccacccgtgtgcagctgtccagtccgaccgtcggattcggcttcgtgagcaagatgtggaccgacggcaatttcgtattcgtgctcaacgtgatacttgtcgcgttgctgtacctcatgttgctgatgctgttcaaccggttctggacggcaagcatcgtgattctcgcggtcggaatcatcgtggccgccatcgaacatttcaaggtcgagatccgttacgaggccattctgcccgccgatctaggcttccttggctcgaacaccggcaacatgctcaccttcattccggccggtgcgcatgtgaccatcctcgtggcactcggcgcgttcgccgtactgctcgcgctgattctggtgctgcgtcatttcgatgggcgcaaaggtcgcatgattcgtacggataacctgagcctgaacctcacctcccgtctgattcttctgctgctgccgattctggtgttcgcgttgtactgcattcatgtgagcaccaccgattcgctggccaacaagttctcccgcgccttgggagacacgccatccatgtgggattccgtgtatgacgcgcagcgcaatggtccgctcgtggccttcacccgccagctcaacccgaagatcatggacaagccgagcaactactccgaggagaccatgaagaaggtcgccgctcgctatcagaaggaagcggagacaatcaacgcctcccgcaccaacaacctcactgattcgacagtggtgtacgtgttgtccgaatccttctctgacccgagccgcgtgccgggactgaagaccaataaggattcgatgcccaacatccgcaagatcaaggcgggcaccacctccggcctgatgctctcctccggctacggcggaggtacggccaatctcgaatacatgggactttccggcctgagcatggccaatttcgagtcctccctgtccagcccgtaccagcagctggtcccgagccagcattggactcccaccatcaaccagctgtggggcgcgcccgtcaactcgctcggctaccacccgtacgaatccagcatgtactcgcgtgccacgaactacaagaagttcggcttctcgcacttctacacgttgaccggtccggacgtgatcaagtatcaggacaagatcgacgagtcgccgtacgtctctgataagtcttcctatgattctgcgttggaaggcatcaagtccggcaagacgaacaagttcattcagatcattaccatgcagaatcacatgccctaccacgagtggtatgagaataacgactacaccgccgaatccaccacgggtacgccgctgggtgatgatgaacagcagtcgattgagacctatcaaaagggtgtggagattaccgatcaggccactcaggagttcctgaacgaactggatgcgctggataagcccgtcaccgtagtgttctacggcgatcacttgccgggcatctactcgtccgccagcgaggatgacaacaactccttggccctgcacctgaccgattacttcatctggtcgaataaggcttccagctcccaaggcaataaggcaagcgatgcagcctactcttcgccgaacttcttcgtggcacaggccgccgatcacatgaacgccaaggtcagcccgtatctggcgttcctgaccgaaatgcattccaagattgccgctatggaaccgcctgtggtcaacaaggtccaaggctgggatcgtattcccgaaggccagaacatctatctcgaccaaaacggcaacccgatgtccaccgatgacttcgacaaggaaaccaagcagttgcttgccgactacaagctcatccaatacgacatcaccgccggcaaaaactacctcaaagacacagattttatgacgctgcctacagacagcctagtaggctgtctgtaggcagcgtgcgagccgacagacgagccagcaaggcgcggggcgtagcccgtccaaaattgcagtagcgctgccgtaaagcagggggtgctttcatgacgaaccagactttcgaacaactgaagaagacttacgaatccggtcgtacccggccgctggcatggcgccgcgcgcagctgaacgcactacgccgtctggttacggagaaccgtgatgcctttgtctcctcggctatggctgacttgggcaagcccgcggctgaaaccgtgctcatggaactgaacctggtggctggtgaagcacagttcgtgcgcaatcgtctgagcctttggaccgcccggcatcccaaagcgatgcattggatgttgcagccggctgccggatggacgattgccgagcccaaaggcgtggtgctcatcatttcaccgtggaattatccggtgctgctggccttggaaccaatggctgatgcgctcgctgccggtaacgccgtctgcttgaaaccgtccgagctttcaccgaatacgtccaagctccttgctgagttggtgccgcaataccttgactccgaggccgtgcgcgtggtcgaaggcgggcccaaggaaaccggcgaactgctgaaatgcccgttcaaccacatcttctataccggtggcggccacgtcggcaaaatcgtcatgcgcgcggcggccgagcatctgacgccggtcacgctggaactcggcggcaagtcgccatgctttgtggatcgcactgcggacatcaatgtggctgcacgccgcattgcgtggggcaaattcaccaatgccgggcagacttgcgtggcacccgactatgtgctcgccacgccggatgtggccgaggctctggccgagcgcatcgccgtagccatcaccgaattctatggcgaagatccgaaggcctcgcctgattttggtcgtattatcaacgatcgtcattttgaacgactgtgcaagctattgccggtcggcaccgtgccgcctgaggagccgagctcgccgctggtgcaggtggcatcggcggtaggcgcggccatggatatggttgggcggcgcttcaatgccgtgactactgggcgcggtggcgcgggggagatggccggcagcgcgaacaatgcggcgaagccgacggccggttcgaatatggcagccgctgatgatggtgcgactgcctcggccgctgttgagccgagcgagattcacaaggtgcccggcgtgttcgacctggccggtcgaatcgtttgcggcggcaaggtcgatcgtgccgcccggtatatcgcgcctaccgtgctgtacggtacgtcgccagatgcgccagtaatgaaggaggagattttcgggccgattctgccgattctggtggtcgaggatgccgagtccgcaatccgattcatcaacaagcggtcccggccgttggctgcatatgtgttctcgcgcgatcacgaggttcggctgactttcgaacgtcagaccagctccggagccttgggatattcgctgccgttgggccatctgctgtccagccggttgccgttcggtggcgtgggcgcgtccggcatcggcacctaccacggcaaagcaggcttcctcaccttcagccacgtcaaaaccgtggttaccaagccgcagttccccgacactctgcgcctcgtgtacccgcccttcaatgaagccaaggccaaactgttcgacatcatcgccaaattcagctagcgtgatatcgctcgctgatattgggtgatggcgttgtcatagtgacgttcgctgtcccggtaattacgtcaatcgattgattcgtgtaccgggccagatttttctgtcctagtatttgatttcgggtcatttttgcttaccgggacaaaactgacgccggaagtatcgtccgcgtattacgaaaatggcggaatagtgcggtttcgtatggaagggaatttcaaatattcctatattcgaggggttcagctgtcctggtttgcgaaaaagagccgaaatcggctaccgggacagaaaaatctggcccggtagccacgtcaatcgattgacatgtctgccaggccaaaaatatgcagcagatgcgccgcttctgttacttcagggctttgaagccgatgtcgtggcggtaaaacagtccgcgcagctcgagcttgtcgatgattgcgtagaccttgtcctgggcggacttgatgtccggagcggaggtttcgacgagcagcacgcggccagagttggccacaaggttaccgtgctcgtcagaggcgacgccggcgtagtagacgtgcgaatcctcgtcgacttcgatttcgggcacacgggcacccttgatgacgttctccgggtagccgttggaggcgatgaccacgccgagggtggcgttggactcatcccaggtgaattcgggggtttcgccgtcgagaatggcggagatgccggcaccgaggtcggaggtgagcttcgggagcacgacttcggtttccgggtcgccgaagcgggcgttgaattcgatgaccttcgggccgtcggcggtggcgatcagaccggcgtacaggataccggtgaatggcgtaccttcctcggccatgccttcgacggtggggcgcacgattttctcgatggcctcgtcgaccacggactgcggaatctgcggcaccgggctgtaggcacccatgccaccggtgttcggaccctcgtcgccatcgtgggcgcgcttgtgatcctgggagatgggcatcggccagaaatcggtgccgttgacaaagctcatcagggagaattcctggccgtccaggaagtcctcgataacgaccttggcaccggcggagccgaagcgatggtcgatgaagatgtcttcgagtgcgcgctgggcggtgtgctcgtccatggccacggtcacgcccttgcctgccgccagaccgtcggccttgatgacaatcggggcaccgtgctcgtgtacgtagtcctgcgccatctcgagatcgctgaaggtcttgtattgggcggtcgggatgttgtgtcggtccatgagctgcttggcgaagtccttggagccttcaatctgggcggcggccttggacgggccgaacgccttgatgccggcggcggcgaaatcgtccacgatgccttcgatcagcgggacttccgggcctacgaacacccagtcataaccattgttcttcacgaattcgataagtgcggcgtgattcgactggctcagctgcgtggtgtggatgccgtccttgagcatgcccgggttgccgggagccacggtgacttcgtcgatgctcggtgccttgagcagcgtgtaggcaatggtgtgctcgcgcgcgccggagccgataaccaatactttctgacccatgttgttcctttcctgcggaaagcgagttacttcagtacgatttgcgtgccggtggtgtcggcggtgatggagccgagcacgtaggcgggctcgttgttgtcggcgagcagcttcagcgcctcgtccttgcgagcggggtcgatggccagcaccatgccgatgcccatgttgaagatgttgtacatctccttatgatcgatgttgccggccttctccagcacgtcgaagatcgggagcacgggccaggtgccgagctcgatttcggcggccaagccgtccggaatcatgcgcgggatgttctcgatgaagccgccgccggtgatgtgggccacgcccttgaccacgcccgccttgaacaggggagagagggccttgacgtagatcttggtgggggtgagcagcacgtcgccgagcttttcgccgcccagctcgtcgagttcggtgtccacggtgtagccggcctgctcgaacagggccttgcgcaccagggagaagccattggagtgtacgccggtggagggcaggccgatgagcacgtcgccttcagcgatggtggaaccgtccacgatggcggacttttcggcaacgccgaccgagaatccggcgagatcgtattcgtcttcgtcgtacatgcccggcatttcggcggtttcgccgccgaccagcgcggaaccggcctgtacacagccgtcggccacaccggccacgacctgctcaagcagtgccgggtcgttcttgccgcaggcgatgtagtcaaggaagaacaacggctcggcgccctgggcggcgatgtcgttgacgcacatggccacgcagtcgatgccgatggtgtcgtgcttgttggccagcttggcgaccatgagcttggtgcccacgccgtcggtgccggagatgagaaccggctccttgtagcccaaggaggccagatcgaacaggccgccgaagccgccgatgccgccgaccacgccggggcggttcgtgcgggccacgtgcgacttgatgcgcttgacgacttcgtacccggcttcgacgctcacgccggcgttctcatatgcttttggcatttggttggcctttctacttattttggctcccctctggaggggagctgtcggcaaagccgactgaggggaggcaagcgcctctggttcaaagaattgttattgagcggattggtggtgagctattcggcgtccggctgcacggtgttgtactcgttgccgatgtacttgctcttgtacagcgcgaattcaggcagacgcacacggtcctcgggcgtgagggacttcaggaagtcggcctcgtagtcgtcgagcgcagtggggtagtcgccgttgaagtaggcgacgcacaggccaccgtatggggcgtcggcgttcagtccgatggattcgaccagaccgtcgagcgaaaggtaggccaaggaatccgcgccgatgtattcacggatttcctccacgctcatcttggctgcgatgagttccttggtggtggagatatcgatgccatagaagcaggggtacttcagcggcggggagctgatgcgcatatgcacttcagcggcgccggcttccttgagcagctgcacgatgcgcttggacgtggtgccgcgcacgatggaatcatcgatgacgataacgcgcttgcctttaaccacgctgcgcacagcagagagcttcatacgcacaccctgctcgcgcagttcttgcgtgggctgaatgaaggtgcgggccacatactggtttttgattagacccatttcgttgggcaggcctgctgcttccgcatagccggatgcggcggacaatgaggagttcggcacgccgataaccatatcggcctccaccggggattcggcggcgagacgtgcgcccatgcgcttgcgggcggagtgcacgttgacgccatagatatcggaatccgggcgggcgaagtagatgtactccatcgagcagatggccagctgcgtgttgttggtgtactgcacgatcttgtagccgtgatcgttgaccaccacgatttcacccgggcgaatgttgcgcaccagctcggcgccgacgacatccagtgcgcaggtttcggaggcgagcacgtaggcgccgttcttcatcttgccgagggagagcgggcggaagccgttcgggtcgagtgcgccgatcatggcgtcttcggtcatcagcaggtaggcgaaaccgccatgcaccgtgttgagcgcttccttgagcttgtccataaaggtgcgctgcatcgaacggcgaatcaagtgcatcagcacttcggtgtcggagttcgaatggaagatggcgccttcgtcttcaagcttgcggcgcagtgacgggcagttcgtcaggttgccgttatggcacagagccacgtcgccgtcatggaagcggaagatgaacggctggatgttgtctgtggtgcccgagccggccgttgcgtaacgcacgtggccgatggcgcaattgcccttcagtcgttcgatttcgcgctcatcgccgaacacctgggtgagcaggccgagtccgcgatgaccgatgagatgaccgttatcgttggagacgatgccggcaccttcctgaccgcgatgctgcagcgcgtgcaggccaaaataggtgagtcgtgaggcgtcggggtggccccatacgccgaagatgccacattcctcgtgaatgtcttcgagttcagccgacaagccaaagctcctttttcaaacaggggattaactatctatcaaccctaccaatcggcggctacatcgcgtgttgtggggtggtggaacttgttggggtttgcggacgcggtttaagcaccagatcagtcaagtatgaatagtggcttaggattttggcctttcgctgtttgtggtgggtggttgtggtgtggggtgatgccgacgggtaggttggaagcatggatacctcttacctgttcaccgccgcattacctggtgctccactttgtgctcaagcgtgataccgaattgtcggtgtgacgtgatcggttgactttcgtcaacgcaatttgaaaggctccgacggtattatccgtcggagcctttcgtcgtatgaatccggtgcttgtttttcggcttcgtctcagtgcctgaaatggctgaagaactcgatggtctcgggatcctgcgactcgtccatcacctcagcgggtgtgccgttctcggcgatgacgccgtgacggagcagtacgatgcggtcggccgcttcgtgggcgaagctcatttcgtgcgtggccatgaggattgtggtgccttgggcctttaactcggcaaccatgttgagcacttcgccgaccagcatcggatcaagagcggatgtgatctcgtcaagcagcagcagttccgggtcggtcatcagtgcgcgcgcaatcgccacgcgctgctgctggccgccagagaactgatcggggtaggcactggctttatcgcgcatgccgatgcgttcaagcagttccatagcgcgggtttcggcgcgatccttgctccagtggtgaaccttgattgcggcaagggtcacgttcctgagcaccgacatgtgggggaagaggttgaactgctggaacaccacgccgatacgtgcgcgaatcttgtcctggtcggcacgcgggtcggtgatatcggtattgcccagccaaatctggccgtcatcgacctgttcaagcaggttgacgcatttcatcaatgtggatttgcctgaaccggaaggccccagcaaagccaccacctcatgttggtgaatgtcaaaggaaatgccacgcagcacctgcgtgtttccaaaggatttgcgcacgtcatcaagacgcagcaccgtcttgttgctcacgggggagtcactcgcctcggtggtgatattggtcatttcgctcataccgttcctccgctgagttcgcgcttacgcagacgttccgtgtaccagtcgttcagcaggatgaacggcacgctcatcaggatgaacagcaggctggcgaccacatacggcgtgaagttgtaggtgctggccacgtcgatctgtgcggcgcgcacggcatccaccgcacccagcacggaaatcaggccgacgtccttttgcatggagatgaagtcattcatcagtgcgggcgccactttgcgcaatgcctgaggaatgacgatcagtcgggtcgtctggccggaggtcaggcccaacgagcgggccgaggctcgctgagaaggatgtacgtcgttaaaaccggcacgcagcacctcggagacgtaggcgctgtatcccattaccactgcaatggtgccgagtaccgagggatcgatacggccgaacaagcctaggccgggaatgccgaaaccgattagatacagcacgacgataataggcacgccgcgcatcacagtcgtgtagatcaatgccaggatacgcagcgggaacagaataggggagcggctggtgcgtaccagcgcgatcagcgtgctcagaatcgccacgccgaccactgcgacgagcagaacgcggatgttgagccataggccgtcaagcacatggggaaacgatttgacgaagtattcgccggagaagaaggtctccttgactcgtggccagccgggggagagcttcaagccgatgacgatgaccaccacgaacacaatggtgctgatcagactggtaatcgtcgattgaatttgctgatgaacacgatattggcgtcgttcgagctcgacctgacttacctcgtgtccgtcaggggcattgtgctgcctggtttcggttggtgctgcggtcatgtgatgaatgtcgctcgcttcctgaatgccgggatggccgggtgccacaggaaaattcccgcagcgcccggccaaggtgttgtgaccttatgatgtaagcctacttcacttacttcttcagttcggtcaggtcggtggtgtactcggccagccacttgtcctgaagcttcttgatggtgccgtcggcgttcaggtcatccactgccttggtcacggctgcagtcagcttggaatccttcggcagcacgatgcccatgccgctcttgtcttcggagtcaggcagacggccgagcaccttggcgtccttgacctgctcggactgcaccatgtacacgcattccacggtgctggtgaccagtgcgtcgatctgaccggcgtcaagtgcctgagccagtgcggcatcatcattgaacgtctggatgtcgtccttgatgttcgccttggcgtagtcgtaggcaagggtgccgaccatgacgcccacggtcgcatccttcagatcggataccttggtggcgttggcgaacttgctgtctttcttgaccacgacggactggctgtcgttgtagtagctggacgagaagtcaacggccttcttgcgctcgtcggtgatgccgaactgctggatgttgaaatcccagtccttggcgccgggagcgatggcggtgtcgaatgcggtgcgggtccacaccacgtcgctcttcttgaaaccgagcttgtcggccactgcgtaggcgacggccgcctcgtagccctcaccgctttccggcttgtcgttcataacccacggctcgtaggccggctgtccggtggcgatggtcagcttgcccggcttgtacgtctgctgggtgatgtcgtccgaatcggcggaattggatgcggtggactggccggaaccgcaggctgcggtgaacgacagagccaggatgctggcggtggccgcaatggtacggacgatgtgtcgcttattgaacatgggtttcctctcctcaagtgttcgtcatgcacacggttcaaaccgtgcttgatgcattcgcgccaattgtatggctattgggttacaaaacatcgatattttcggatgctggctatcgccattgcttatggccgactagagccgcgcaatctggcgcgtaagcggacggatatctcatattggcgcagagcgaaatggcgttcactgttcgagtgtgaagccgtcgaatacgaatcccggactgaccacacaggagaccagcgcatcgccctggcctggcactgtgcgctgccagacgccagccggtacgaccgcatgtcccgatacggttacgtcggcctgatcggtggtgatgccggaacccaaggtgattacggttcgcttggattcgtcggattccggagtctcgtcgctgccgccgagctccagtttgaccgatgccgggccatgccacagccagacctcatccgcatcgaccttatgccaggcgctggcatctccctcgggcagcaggaagtaaatcagtgacgatagcggtcggcttgaggcctcatccgtgtgcggggattgccagtcacgcgtgtaccagccgccttcggggtgggtttccagtccaaggcgttccactatggaccgggcgtatggactcatgtcttgcaaagcgacgctcataatgagatctcctgttcttggcgggtttgctggtttttggcttcttgatatcaggtcaggtcagcggtgtcaccaggcgttgttgtaggcttcgcgcccggatatcaccgtggctcggttcgtgcctgcgccgtgcctcaccagtgtttccagcgtttcttcgatgccggccggagatgatgtgtcgacggggatgtcgaagaacgcgaaatcagccaatgcgcccgcgttgatttgtccaatgcggttgcggcccacgtgcatgcccatggaggcggcgccgcccagcgtcatcatacgaatcaggcgatgtgtcagatcgtcgctggcatagccttgttcgcgggccaggtcgtaaagcatcgacacgtcatcaagcagatcgagggtcggcgtgctggagagcgaatcggtgcccacgcttaccagattgccttcctcgaggtattcgcgcaccggtgcatctttgccggtgttggtaatgcgattcgatcgggggcacaaggccacgcccacgccgcgctgacgtagaatacgccgatcctcgccattggcccacacgccgtgtgcaatgtgcacatccggtccaagcgagccaagctgatcgacgaactggatggcggaggcacctttgcccacttccttgagctgccggtagctttcccaatcgtggtcactccagtcggccgccgaataagtggtgagcaccggcggataagtgccggcctcgagcggggtctccgccagatggatatgcagtcgcatgttcagctgacgagcaatgtctggaagatcaacgaacggttcggactccagcgtatacggagcatgcgggctgatgccgaggtttggcagctgctcctcgttcatccggcgcaactgccggatgagctcagtgcggcccttttccatccattcggcgttgtgccagcccattacctcccaataagcgatgccgtgcatgccctgcgaagccagcgcgccggcggcgtccaaatcggtgacgatgtctgcggcggccgtcgttcccgattcgaccatctggcgagcgccgtcctcggcccactgcttccatggctgggtcttctgcgcctcggcgtacacctcgttgaatgccagttcccaggcgcggaaccgatcgtaggtgccttgcccgacctgcaccatgccgctgtactgcagatgagtgtgcgcgttgatcaatccgggggtgagcaccccatcccaatgccgttcatggatggtgccgtgagccgtcatttcctgcttcagcgccttcagcacccagcggcgtttacctacatgaaccacgcggtcgccatgtatggcaactgcgccatcgatgatgacggggcccgtcacggggatgatgagtttggcggaatacagtgtcacatcatcgataagctcggtatcgacggtcggccaggtgttgtcggtcatattctcctcgctgcgttgtgttcggtgccgtgtctatggctatcggtcggcgttctctcggtcgttttccgcgaatctggtcagtcgccaattgtagccgttgtcctccacggcatggctggctcggtatccgcgcgccttgagcgcgctggcggcgatgcgctggtcggtcgctgcgtcaagtctgataagcgtgtgatccagtgtgcctcgatgttccagaagatatgcgacggcgctggcctgtacggcgaagctcagatccatgatctcgattggattgccgcctcccaccgtgtagttcacgccatcgccgtcggcgattagcgtgagcgttggtccgtcgggaacattgagttgcacggtgtccctgttgacctgtggggtgaagtcgcttacctcgtccaaggcgatttcgttggcgatgccgccgatcactgcgagcgccgcgccctcgtgcattgcgcgcatgtgctcaagtgtgaccgtatgtctcacgccagtggcggacaccaccatatccgcgcaagggagtgcctcgtcaatgtcttgtgcggcgaagccgtcgaacaccgctttgagtgaagccactggatcgatatcgcagatggtgacttcggcgccaagcgcgcgaatgcgccgtgcgaagccttggccgaccgggccgtagccgatgacggtgacgttcttaccgtcgaatgcatgctcgccgagaatgcgctgcatggtggtcacgcatgtctccccagtgccgtgggcgttgtcgaatccggttttcagcacactgtcgttaacggctacgaccgggtaggtgagggctcccgcttcctgcatctgctggaacgcgcgtacgccgctggtcgtttcctcggccactccaatgaggttcgccgtgagttcggggcgttcgagcgaagcgagacgggcgaagctggcaccatcgtcgatgatgatgtccggctgtatttcgtccagcaggtgcagggccgcctcgtgcgcctgttccgcggtccagtctcggctggattcgaccgtgattccttcccggcgcagctgttccgccactcggggatccgtggaatccgggccgcaatatacgccgacgattgcgccggcggccttaagcttgcgcagcagaatcgcggtttttggctccagtatcagacagacggcaatacgaatgcctgagaaatcgacgcgagtggtgaggctatccatggtgtcgcgtaataccggcatgtgctgttccgcgtactccattgcctccagtccgcttgccttgcgcatatcggtgatggaatcgatgctttgtgtgccgtcgcataggaattcctcgttgtgctcgtcggtcatcgtggcatcttcgacggtcatgccccattgctgggcctgagacttgatttcggcatgcttctgtggctccggaatcgcgagtcgggctcctgccagtgatcgattcgtcttctgggatcgggctgccgcccacgctgcaaaatcgctgtctgctgtaatgcttttcttcatattccccatggtacgcatgcatgccgctgctccgccgctgcgcgtgtggcgtgggtgaagagcgtgcttgggcgcgttgcgtgcgtcgacttcggcagcttcgaacaggcatgttgcatcgaacaaatgttcgactgtgttgatatgctggtcgggccagcggtggtaaggaggtgatggcgatgggcagcggaacggtatcgacgcaacgcgagcatacctatattgccattgatctcaagtccttctatgcctcggtggagtgcgtggctcgtgggctcgacccgttgaccacgcatctggtggtggccgatgaaacccgcaccgataagacaatatgtttggcggtctcaccctcgctgaagaactatggcattcctggccgtgcgcggctgtttgaggtaaaacagcgcctgaatggagtcaacatcgagcgcgcggtccatgctcccggcggccgattaatcggggagtcctgcgatgcgtgcgacctggaacgctcgccggggctcaaagcctcgatggtcatcgccaagccgcgcatggcgcactatctggaaatcagcgggcaaatatatggcatctacctcaaatacgccgcacccgagcacatccatgtctactcgattgacgaggtgttcatcgacgccacgccatatctgcgctcgctgggtatggggccgcatgcgatggcgcgaaccatcgtgcgcgaaatcctcaccaaaaccggcatcaccgccactgccggcatcggctccaacatgtatctggccaaagtcgccatggatatcgtcgccaagcacatgcccgccgacaaggacggcgtgcgcgtggccgaactgaatgaaatgtcatatcgtcggctgctttgggatcatcgtccgctcaccgatttttggcgggttgggcgcggctatgccaagaagctcgagcatgccggactgatgaccatgggcgatatcgcccgatgctcggtgggtcgtgcttcggattactacaacgaagacctgctgtatcgcatgttcggtgtcaatgccgaactgctcatcgaccatgcgtggggctgggagccgtgcgaaatcgcggatatccgatcctatgagccaggtgcgcacagcattagcagtgggcaggtgctcaccggccccgccgactatgccacggcccggctgatcaccaaggagatggctgatgcgctggccctcgatctggtcgataaaagcgtgctgacgaaccgactgacgctcgccgtcggctatgacatcggcagtcttgattcgtcaaagctcgattcgtgcgctgattatgcgatgaaacgtgccgctgagcgggcggcgaaaagctatcaagggccggtgaccatcgaccgatttgggcgcaaggtgcccaagagcgcggtcgggtcgattggtttgggtgatttcacctcgtcgtcggcacgtattcgtgaggctatgacgatgttgtacgagcgcattgtggattcacgcttgcttgtgaggcggttgaccgtcatcgccgatgatgtggccactccggaggagctggccgccggcaaacgctatgaacagctcgacttgttcggtgatgacggggcccaatcgtatggatccgattccaccagcgaaaaagatggagagcatgatatccagcgtgcgctgctggatgtgaaacgtaaattcggccgcaacgccgtcatcaaagccatggacatggaagacggtgccaccggtcaggaccgcaaccgtcagatcggaggccatcgcgcatgaccctgcaagagacccgtgcgtacgacgacatcatcaacctgccacaccatcagtcgcgcaagcatccgcacatgtcccgccaccagcgggccgcgcagttcatgccgttcgcggccctgaccggctacaaccaagtcatcgagcaaacagcaaaaaacgccgaaaccgccatcgctcaggccgaagcccaaggcgataccgatttcggcgcttgacaatcgctctcgttggaggaagtctcagattcgtcagcctacgtgacgttcgaagcggtggaagccggtgatcttgtcgatttcggccatcgcgtcagccggaatcacaaagcccgcggccttcatgttgttctccagttggctgggcttggaggcgccggcgatcacacagctgatctccgggtgctgcaggatccatgccatggaaagcaccggcaggttcgtgccgagctcgtcggccaccttgcgcagctgctcgaccttgtcgaggttctcatcggtcagcagatcgttgatctggtggtcggactgccaggtggcgcgcgagccggccggcagcggctggcccttgcggtacttgccggtcagcagaccctgcgcgagcggggagaacgtggtgatgccgatgccgagcttgcggcaggtgcccatgatctcatgctcgatgtaacggtcgtttaggttgtactgcggctgaaccacggtgatcgggtacaggttgtagcggtcgatgatgcgctgggcctcttcaaggcgagccgaaccccactcctcggaaacgccatagtacagcaccttgccttgggcgaccaggtcgctcatcgcgcgcaaggtctcggtaaggtcggtggtctcgtcaaaacggtggcagaagtacatgtccagataatcggtctgcatgttcttcagcgtctggtcgatgctctcgaaaatgtgcttgcgggacaggccgcggtcgttcacgccttcgccggtggggaagtagaccttgctggaaatgaccagttccttacgcgggtactgcttcagcgtcttgccgaggaagcgttcggccgcgccgccagaataggcgtccgcgcagtcgaagaagttgacgccggaatcgtaggcgagcttcacggtctccttggccacgtcctcagccgccgtgcccttgagatccgtgacccagctgcccagtgcgacctcgctgatcttcagtcccgacttgccaacgctgcgatacttcatgtgtgctccttgataatcaatcgtcaccgtcgtctcttcatggccggccgtgaacgctaacaattcttattgaaacagttcaaccccacttgaacgcaagttggcggctattgcgacacgccggtggtgacttcgcgggcgcaacgaatgaaatcatcaatgacgctccaccgatacgatgtggccggaacgccgaactgaatggcatatgcggtatccgggccgcaatccagcacgcgcaaagtacgcaaccgttcgccgtcaagcagcgctggcaggaaccgctccgggcataggcaggcacccatgccgtaatggcacagttccagcagagtcagtacgttatccgaacgggctgtgactttcggctcaaaaccggcacggcggaacagcagatcggcaatgcgtccgtcaatatcttgtgggctgcctaggagaaacgggcaatgctccagtgaggaaaggtcacctgcggcaatggcgcgctcgtccggcgcggttctgacggcatcgacttggccattcgccgcgccaccggtagcggccaaatccatccacagtgattgtgcgaggaccagcaccatgcgctcgttatagaaatccataagttcgatgccggccggtttcccggcgaagtccgccaccgccagatcaagatcgccgttcgccagccattgttgaatctgatcgttgcggccctcaatgagttcaacgatgatattcgggcagtcacgttgcatcgccttcacaatcggcggcatgatcgcccggctacgcgtgtaggcaacacccacgcgcagcacgccggcctgatcgccggcgatgtcgcgcatttcttggccaagtgcatcgcgatcgcggcggaatcgctgcgcatatcgcgcgaacaccgtgccggcataggtcaattcgagcggcacatggcgtacgaaaagcgtgcatccgagctcccgctctagggcggcgatgttcgcactcagcgtctgctgcgtgatccccaaccgtttcgccgccttgctgaagctatgttccgaggccacggcggcgaagtattcgatgctgagaaagttcatggcgatactcccgtgtgtatggcgtttgcgtggtgtgtgtatgacgtgtcgtggcgcgaatcaatgccacagtattaaacctgtaatagatatcagtttagtctgtatttctcctgttatcttaggtcatggctcgtgcgaatagcgttgatgtttgcgactgcgggtcatgagatggaatctgagatgaggctgtagccggaagaggagaggatcgcatgctggaagcgggcacgatgttgctgttctgtgcggtgctgtttgccagcgtcgccctcggctggtcgattattcccgcgctgttcgttggtgtgctgctgttcatggggtatgggctggttcgccggtgctcgttgcgcgcgatggcgagccgtgcggccggcagcgtacggtccgcggggaccgtggtggtggccttcgtgctcatcggcgtactgacctcgctgtggcgggccagcgggaccatcgccttcatcgtggcccattcgaccgcggtgattcacgccgccacggtgattccgctgtcgtttctactgtgctcggcgatgtcggtgctggtcgggtcgtcgttcgccagtgcggcgactatgggcaccatctgcatgtcgttgggattgtcgatgcaggcgaacccggtgatgctcggtggcgcgattcttgcgggcgtctatgtgggcgatcgttgttcgccggtttccaccagtgccttgctggtcaaacagcttacgcatacgaacctgttcaatactattgtccgcatgctgcgcacgggtgcggtgccgtttgtgctgagttgtgtggtatacgttgcggctgcggtggtggagtggctgtgcgcgagcggtggttccggatttggtgcggctagtgcggctgctacggctggctcggctggctcggctagagcggctgtttcaaccaacgcaagcagcataaccgatatcggcggattgttctcatcggccttcgatttgcattggcttaccctagttccagcattactggtcatcgtgttggcgttgctgcgtgtggatgttcggctgcttatgctcgccagcattgccgcctcggtcgcggtatgcgtgggcgtgcagcacatggaatgggcagaactgttgcggctgcttattttcggttaccatgcgcaaaatccgcaggtggccgcactcctggacggcggcggcatcctctccatgctcactgtgatggccactgtctgtatctcctccgcctacgccggcatttttgccgagacgcggatgcttgctcggctgcagcaggtcatcgagatgctcggtcatcgcatcggcgcatgtggtgccaccatgattaccgcgacttgcgcggcggcgctcgcctgcaaccagaccctcaccatcatgctcactcaccagttgtgcggtgggctgtacggcgacgacgaatccgaacgctccgcacaagctatcgatttggaagacagtgccgtggtgatcgctccgctgattccttggtcgatcgccggtgccgtgccgcttgccaccatcaacgcgcccacactcagcctggccgccgcgaccttcctctacctgctgccgctctcgcggatgctcgcctcggctgtacgccgccgctcgggatttcggactcggcatcgatcccaaaatcaaaacccgggactcgccatcccacaccggcccaaacccatgctccacatgttcgctcatggtttccatcctaagtcgggcgattgagcgcacgaggcaatcaggccgagaactgtttgccgaattccgagaagagctgacggcgggcgaagacgagcaggccgagcagcaccagcagggagaccagcccgctgaccatcaccagtacatcccacggagcccagccgagcggaatgaacgtcagaggcatcagaccagcgacgatgtcgaacgccagatacttggcgtactcgtcaatggccttggcccgcagcacgataagcagcaccacgtcaaagaccagcgaaaccagacacgtgatcggtatgacgaacatggtgacgacatgattcatcgtcgccacaaaccagaccagcgcaatcgccagcatgatatagaaatatcgaaacatgaggcgaagcggccgcggcacgtgcagaatcgcactattgatgaacagcacgctgatgatcagcgcggccgccgatgcactggcaatcggtatcggccacgaaaacagatagctgaagaagccatgcagcagcaaaatcgcgccggttacaaacgtgatgatttccaccgccaaacgcctcggacgcagatagatctgctgcgcggggaatgcggcgggggaggcctcgccgcgcaattcgttctggcagagcgggcaacgggccatatcgccggtgaaatcgacggtgcaggcatcgcaatgcttcatgccgacgctcctttctccacatgcacgccagcgatgttcatacggccgctgatgccctgcgcggcgagaatccgacacaggttcttgatgacgttcagatcatggtagatggtggagatgccgatgctcaggtcgtcgccgaacgagcagaccgtgaaattcaggctggccggtgtggtgaggaagctcaccgaacgtacatggcgcgcgagtcgttcgtccaaggtgactcggccaaggttcgagacggtggtcgtggtctcgcggtcggcgatgaaccgggccagctccagcacccagtccttggcaggggagggcgcaagacgcagcaccggattcttttccagcgcaatcatgcggttcatatgcgattcgacgcgctcgcgactggtggcatggccgagctgctcctgcacatggcgggcgatgtcggccaacggctcatcggtcagcaatccacccataccgttgccgtgcgcggtgcgggcggcggactgctggccgtcgccggctgcgtctgggcttgttgcggaagttttcgcggagtcctcatcggcttcgatttcggccggcgtgtacgccacgtaagtcatgccgtagaagttgcgcacggtctccgacctgaagaaggcgcgcaagtcgaccggaatatccacgcgaatcgcgcgattgcgggcgcgcgagggcatgacgtcgcgaatcgcgcacagtatcgcggcgatgaggtaggaggtgagactcactccgcactgatgcgctgcaccaagcaccttgctggcgctgacgtggtattccatgaacgtaggcgcggcccggtcgatggggccggccagccggtagatcttcgtgcctggcgcagcgccggccttgtctttctcgtagtatttgtcgaagctgttttcggctttgtcgctatccgaaccgtcgtaatccgaaggcacgcccggcacgtcgtatcgctcggcgatgtaggcgtgcagcagcgacttgaacaggttgatggcgccgcgaccgtccgaaatgatgtgcgagacctcgagattgacacgattgcggaaatagcttacgcggaacagcatgcttttgggcccgtaatgcagtcgcgagcatatcggcagatgttccggctccaccagcggccggccgtctgactgttcgaggtaatgccagaacatgccgttgagcaggtgcacgttgaagctcgggaactgggcgatggcatggtcgagcgcgtgctgcaggatgtccggatcgatgccgtccgccagctcggccgaatagcggaacacggtctgcgaggagcggccagcctgggaggagtagaacttgccgatgttgtctagtcggtaccaagtacgtcttgccacgcgtcgcctccctccggtgcgttggcggtggtgccggtgccgggagctggttccagcggtgtgccgtcgaggaaatgctcgatgattcggtaggtggtggccaccagtcccacggccgacgtattgagcaggtagccgtggatgccatcgtgaattcggtaacaggagacgttgtcgttcaccaattgcaggcgacgggcgtacgcttcgtcctcgtctctgagcgggcagtattcggcggacaacaccagcgtgcgcggctgattgctcaggtcgtgcgcggtgagcggcgcgaaatacggattggtcagatcggccacggacgaacggtacatgtcgatgtagtcggccatgtcctgtgcggtgaggatgtagtcggtgccgttggtccgcaccgattcgaacgggctggtctcgggattgtaatcgttgccgactaccgggtaaagcagcatctgcgtgcgcggcatgaactcgccgcggtcgcgggccatgagtgagacggcggccgcaagattgccgcccgcgctgtcgccaaacagcacgatgctgtcgggatccggtgctgggattgtcgcagatatatcgcccccgccggcgggggctgtcggcgcagccgactgggggtgatcaacatcaacagaaccacccaccccagaaatcggcaattccccagcaaacagctgccgggctacctcatagcaatcctcaacagcagtagggaagcggtattcaggagccagccggtactcgactgagatcacacggcgttgcagacgtacggccatatgcgcgcaagcctgcgtgtacaggttgatgccgcctgtggtccaaccgccaccgtggaaaaacaggatcgtgccacgcggcgtgactgagggaagttccgtgttggcattgccggaaataccgtcggcgttgccgctcgacgtgctttccttgatgagtattttgggtaggactttgggtaatacggcgggcagaatcgcggatattgccgaggccacgggcgtgccattggcggaagattcctccagggcttcgggcaggggcgctccataggcgaccagcggcgtgaacactcgcaatggtacggcatatccatccgccataggcgcgaaggcgtcctcgacacggcatttcggattgtcgggtgcctgcttggcgataagctcttccgccacgcgctgcaatttgtacgacttgcccgcgttgggcttgatgtagctggcggccttcatcgcggcgaacaatgcctcgttgatcggcatgacgacaggtcctttcagcggcggattcggtagtgcgaacaccccaaccttagcccatgaccggcatgaacaaaaaagggaaggaacccgagagttccttccctgtgtgccgtatcagacgcgatacgcgccgattatcaggcggtgaagtattccacgccggcctcgaagatcggctggtacttgttgccgggcacgttgacgtacaggccgttgccggaacgctccgagtgacccatcttgccaaacacgcggccgtccgggctggtgatgccctcgatggcgagcagcgagccgttcgggttcacatccaggtccatgccgggggtgccggtctcgtccacgtactgcgtggcgatctggccgttggccctgagctgggcgagcacctcgtcggaggccacgaagcggccctcgccgtgggagatggccacggtgtgaatgtcgccgaccgaagtcttggacagccacggggagaggtcggaggccacgcgcgtgcggaccagtcggctctggtggcggccgatggtgttgaaggtcagcgtcgggcaggcgtcggtcatcggcacgatgtcgccgtacggcaccagacccagcttgacgagcgcctggaagccgttgcagatgccgagcatcagaccatcgcggttcttcagcaggtcacgcacggcctcggtgacggccggcgcacggaagaacgcggtgatgaacttggcggaaccgtccggctcgtcgccgccggagaagccgcctgggatcatcacgatctggctcttgttgatctcgtcgaccaacgcctgcgtggattcggcgacggcggccggcgtcaggttgttgacgatcagtgtggtcacatcggcgccggcacgctcgaaggcggcggcggaatcgtactcgcagttgttgcccgggaacaccgggatcaccacatgcggcttggccacggaagagccgacgtacacggtcttcttcggcgcgtggaagtcgatggtctcgacggtcgcgcccttgtcctcgcccttggaacggtacgggaacacggattcgatgccggactcccaagcttcctgcacagcgtccaggtccagcgtctcgccggcggccttgaacacgtactcggaggtggtggtgccgatttcgccgatctcgaccaaattggagacggccggaagcttggcatcgtccgccagctcgacgatgaacgaaccgtatgccggggtgaacaggtcgtccacggcgatgctgttgttcagggtcacgccgatgcggttgccgagcgtcatcttgaacagggcttcggcggtggcgccatagcccggcgtagagacggccagggcatcgtggaagtcggtgagctcctcgatcacggagaacacctcaagcagcgcatccttgtccggggtcagaccgtcggccaggtagcgcggcgcgatgcgtacgatacggtgatcggcgtccttgaattcaggggaggtggcgcgcttcatgttgcccacggccacggcgaaggagatcagcgtcggcggcacgtcgagatcctcgaacgaaccggacatggagtccttgccgccgatggcgccggcgcccaggtccacctgggccatcagcgcgccgagtacggcggccgccggcttgccccagcgttccggctcgtcgcgcagcttctcgaagtactcctggaagctcaggtaggccttctcatgctcgaagccggccgcgaccagcttggccagcgactcgaccacggacaggtaggcgccggtgaactggttcttggacatgatgtacgggttgaagccccacgccatcgccgaagcggtggtggtctcgccgaacaccggcagcttggcgaccatggccatgttcggggtgagctgacgcttgccgccgaacggcatgagcacggtgcccgcgccgatggtggagtcgaagcgctccgaaaggcccttgttggaggccacgttgatgtcggtgaccagcttgttcatgcgttcggccagcgtgccctcgccccacggggtctcgtaggactgctgttcctcgacatgcacggtctggtgcttggaagcgccgttggaggccaggaactcacgggacagattcacgatcttgtcgccgttccaggtcatcaccatgcgcgggtcctcggtcacggtggcaatcaccgtggcttcgaggttctcttcgcgggcgtaggccaggaactcgtccacgtcctcggcggccacgtccacggccatgcgctcctgggattcggagatggccagctcggtgccgtccaggccctcgtatttcttgggcacggtgttgaggtccacgaacaggccgtcggccaactcgccgaccgccacggacacgccacccgcgccgaagtcgttgcagcgcttgatcagacggcaggcatcgccgcggcggaacagacgctgcagcttgcgctccaccggagcgttacccttctgcacttcggcgccgtcgagttcgagcgattccacgttatgcgccttggacgaaccggtggcaccgccgatgccgtcacggccggtgcggccgcccagcaggatgattttgtcgccaggggccggggtttcgcggcgcacatggtcggccggggtggcggccacgaccgcacccacctccatgcgcttggccacgtagccggggtggtagatctcgtcgacctgaccggtggccagaccgatctggttgccgtaggagctgtagccggcggcggcggtggtcacgagcttgcgctgggggagcttgccttccagcgtctcggagaccggcacggtcgggtccgcggcgccggtgacgcgcatcgcctgatacacgtaggagcggccggacagaggatcgcggatgcagccgccgatgcaggtggccgcgccaccgaacggttcgatttcggtggggtggttgtgggtctcgttcttgaacaggaacagccagtcctcgtcgtggccgttcacgtcaaccttgaccttgacggtgcaggcgttgatttcctcggactcgtcaaggccggtcaggacaccgttcttcttgagccacttggcgccgatggtgcccatgtccatgaggcagacgggcttggcgtcacggccgagctcgtggcgcatcgccaggtaacgctcgaaggcggccttgacggtggcgtcatcgatggtcacttcgtccagctcggtgccgaacgtggtgtgacggcagtggtcggaccagtaggtgtcgatcaccttgatttcggtgatggtgggctcgcggctctcctcgctgaagtacttctggcagaattcgaggtcggccagatccatggccagaccgcgctcgtcgatgaacttctggccggcttcggcgtccatctcgttgaaaccggcgatggtctcgaccttgccgggcaccggcacctgggtcttcagggtttccttggtctccaggctggcctcgcgggcctcgaccgggttgatcgcgtaatgcttgatggtgtccacgtcggcgtcggtcaggtcgccttccagcgcgtacagcttggcggagcggacggtcgggcgctcgccctgggagatgagctggatgcattcggcggcggagtcggcgcgctggtcgaactggccgggcaggaactcggtggcgaagaccttggcgccggcgaagtcgggcaggtcgtaggccacattgtccacctgaggctcgctgaacacggtgggcacggtctggtcgaacagctcctgggagatgccttcgacgtcatagcggttcacgatgcgcagggccttgaggccggtcagtccgaggatcgtgcgcagttcgcccgcaagctgctgggcttcgacatcaaagccgggcttcttttccacgtacacgcgaaaaaccatggaaatcctttcttgaaattaaagacaattggctcccctcgagaggggagccagataatgcattactcggcgacttcgatgccttcggacttggcgagttcggcgaggcgctcctcgatctcttcgtaggccgggatgatgctgccgagaccacggcggaacaggtccttgtcaaggtgctcgaccttgccggagtggtccttctggtcccacagacggcaggaatccggggtgatctcgtcggccaacagcagcgtgccgtcggtggcgcggcccatttcgatcttgaagtcgaccagcttgacgtcgatcttggcgaagatctcgatcagggcctcgttaatcttgcgggccagcggggcgatctcggcgagatcctcgcgagtgcatacgccgagggccaccaggtcatcgtcgttgacgaacggatcgtgcagatcatcgttcttcaggaagtactcaagtaccggctccttgagcggcaggccttcctccacgcccagacgggagcagaagtggccggcggccacgttgcgcagcacgatctccaacgggaacatgttcaccttgcgcaccagctggccggtgtcgtccactcgcttgataaggtggctgtcgatgccgcgcttcttgagcaggtcgaagatgatggtggtgatgaggttgttcagacggcccttgccggtgaagtcttccttcttttcaccatcgccagcggtggcggtgttcttgtattcgacccacagaacctcgggatcgtcggttgcgtacagttgcttggccttgccctcgtagagcttttccagcttctccatgactcacctttcaggagtggaatttctgggtgaactaacggtaaaagggtaccaatcgagggctacaacaacactcagcatgacgctacgatgcggccggcgcatcatacgtcgctgcatcgaacggccatacgctgttgggatggcggaggcggccgtcattggccagtacgatcagctcgtctccggtcgtgtagccttccggcatgaaggtatctgcagaagcgcgtgtgaatactcagatgttcgtcaatagacgaaacatgactcttcggccatatacacacgataatgggagtgacgaaatggtacaaggaggttcgtcatgatcgttcatccacgacccggacggcaataatattgaggccatgctgagctgatcaggccgtggactactccacggtaatcgtcaacgcatcggccacgaggccggccttggcacgggcgtcggcttcggactcgccgacggccagtgccacggccatgcggcggtggccatgcacttcgggcttggcaaaaatgcgcaggtccgtgccgggttcggccagagcagcggccacatcggtgaactcgacctcaccgtcgccggccaccacaatcgcatggcttgccgccaccgagccggccggaatcgtgagcgacacatgctcgggggtgatcggcaggccgagaatcgcgcgggcgtgcagcgcgaactcgctcagacgctgggaggccattgtcaccataccggtatcgtgcggacggggggagacctcgttgaacagaatcgagccgtcggtgagcacgaacagttccacgccgaatacgccccaaccggtttcgccggccgcctgagccttggccaccaagccttcaacggcggtacgtgcgatgtcgcgcgcccgctcggcctcaccatcgggttcggtagccggctgccaggactcgcggtaatcgccggactcctgacgttggccgatcggcgcgcacgtcacaatgccggcggacgaagaaacagtcagtaccgtcagctcacgctccagcggagcaagcgcctcaacgatcacgcgcgacacatcgccctcatcggcggcgcggcggccctcctgcgcttcggtccaagcggcatcgatggcgtcggcggaacgcaccaccgactggccgtgaccagacgagctcatcaccggcttgaccacgcacggatagccgacttccgaagctccggcgcgcagctcttccagcgagccggcaaaacgatacggtgtagtcggcaagcccaattcttcgtgggccagtacgcgcaggcgctcgcggtccatgcaaatcgcggcgatttcggcgctcggcaccacctgggcgcccgcggccgcagtaccggccagcacatcggtggcgatggcctctacctcgggcacgatgatgtccggcttgatttcatcgaacaatgcctgcaattcggcggcattcgccatatccaacgcgcgatattcatgcgccacctgctgggccggagcgccggcatacgagtcagcggcgcacacccacgcgcccagtcgcatgagctcgatggccacttccttgcccagctcaccagcgcccaaaaacagcacgcgggtggggtgcttgcccagcggtgtgcccagcgggcggttggctgcgcgagttgcgggggagacggcggaagtctcggcgggaattgcgggagaggaggtggaagtcacggcagtatttacggcgttctcagtcatacccacattctgccatgccgcgatgatttcgcctatgcggggctcggattcggcgacgtgcgctgcggagcgcgtgattcaatattgggcaaaatgcggcagcccataccatttcatacgcgttcaggcagcgcggccgacgccattgcagcgcggtggtttaggatgaggcaatgcgcgaaaacgggattgaagagagcattgatcgtccgctgactatcgctcttgtggtcgatacggtgggcaatcagggcaacggcacctccaattcggccttgcaatgggctgcagaattggagcggcaaggccatcatgtgaggcttgtcggtataggggcgcccgaatatccggcgcgcgtgaatagggtgccgctcgtctcgtgggtggccgccaagcagctcatgcaattcgccgaacccagcgacacgttgttccgcaccgcctttcaaggcgtggatgtggtgcatatctatatgccgttcaaattcggccgtcgtgccgctaaagtcgcccaccaaatgggcattcccgtgactgccggattccacctgcagccggagaacgtgctgtattcggccggccctctacgtcgcattcccggtatttccagcttcctgtactggctgttcaagcactggctgtacaagcacattgaccacatccatgtgcccaccgaaatgaccgcgagcctgttgcgcgcgcacgggtataaagccaagttgcacgtgatttccaatggttattcaccggtgtattcgccgaagaagccggccgatccggatgcctcggctcccgtgccgttccgcgtcatcgcttccggccgactggctagcgagaaagatcagattacgctgatcaaggcggtgtcgatgtcccggcacgccggcgatattcagctggtgatcgccggtactgggccgctcaagcagtatctcaagttccgcgccgggcgtttgctggcgcgcaaggccgatatcggattccacaagcacgccgatatgcccgatttgttgcgttcgggcgatttgttcgtgcattgttcgattgccgacatcgaatcggtgagcgtgatcgaggcgatggcgtgcggattggtgccggtgatcgccgcgtccgaactgtcggcggccagccagttcgcgctgatcgacgagtcgttgttccccgtgcgggacgcggccctgctggcccgacgcatcgattggtggatcgcacatcaggccgagcgcgccgaatggggcgaaaaatacgccgaatacaccaaggcgcattattccgtggaagcctcggtccacaagttcgtggatatggaacgcaaggcgataggggagtaggagccttctcgtttgcggagaggtctttccctcagtccgcctgcggcggccagctccctcatcagagggatctacgaaaaaacctccctctgatgagggaggtggcatcgcgaagcgatgacggagggagagattagcgaagggttttacaacaactcaataagttgatcgacctcttcaggcgtggtggcccagctggtgcagatgcgcatcacggtgtgcgtgtcgtcggccttttcggtaaagccgagcttgatctcgcgctccagacggtcgatggtcggctgatccatcgtcacgaaaatctggttggtgggcgcttcgaaagtgagcgtgtagcccttggcgcgcagggcctcgcgaatacgatcggccgcctcattggcgttgcgggcgatcttgaaatacaggttgtcggtgaacaaagcgtcaaactgcgcgcccagcacaaagcccttggccagcaaggcaccgtgctgcttgatgagggtcaagaagtgcttcggcgtgttgtgcttggtaaacaccacggcctcgccgaacagggcacccaccttggtaccgccgatgtagaacacgtcggcgatggtcgccagatccgcgagcgtcatgtctgaaccggtggcggtcagcgcgtagccgagtcgcgcgccatccacgaacagcggcatgtcgtacttgtgcgccacatcggcgatggcctgcaactcggccttggagtagatggtgccatattcggtgctttgcgagacgtacacggagcccgggaacaccatgtgctcgtagttgccgtccgcatagaaggtcttgcagaactcgtccagttcggtcgggtccattttgccgttgtgctggggaatcgtgagcaccttgtgcccggagaactcgatggcgccggcctcgtgcacgttcggatggccggaggcgaccgcgaccacgcctgcatacgccggggtgatggtgtcgatgacgacctggttggtctgcgtgccgccgacgaggaaccacacatccgcgtccggctggccgcaggcctcgcggatcttggccttggcctgatcgctcagttcgtcggacccgtagcccgaatacagatggttgttggcttcagccacggcttcaagcaccgcgggatgggcggcgcgggagtaatcgttctcaaaagacagcatgacggaccttttgtccttatgttcggtgaattggatatgccctgagtgtacaacgcggtggttcccggcatgcctatttggcctataacccaggagcggggaattcagggagaaaaaacaaaacccttccgcgaacggaagggttttactggggtggccaacgcggctcgaacgcgcgaccttctgaaccacaatcagatgctctaccaactgagctatggccaccatagtgccgtattcagcaagctgaattcgcgcaacaggtgaatactatacacaactttgcggatgtgtgctcatcggtgtgtcgcgatggaatcaagtggtcggtttcattcttggggccaggctgcgggctgtctcagatggcgggatgtggatgagtgggtcttgtgcggcgattgatgaaaagtcaaggcacacgacggtgtgatggtacgaccggggattgcagaaatgattacgtgagtgttcgcaatgtgagcattatgtttcatatcaaccgcgacccgcctagtttcatgcgatgttacctacaccaaacaagggaagagaaacaccatggaaaaggttaaagcctttgcagattggctgaccaagtggtttacggtcatcgtcatcgtctgggccgtcttcaactacttcgtgccggccgccagcttgtggggcaaggcgtacaccggctacatgctgggcatcgtgctgttcggcatgggcctgaccctgacgctggacgacttcaagcgcatcctgacccagccgctgatggtcatcgtcggcaccgtagctcacttcatcatcatgccgctcatcgccgtggccctgtgcgcgatcttccacctgtccggcccgctggccgtgggcgtgattctcgtcggctgctgcccgtctggcacctcctccaacgtgatgagctacctgtcccgtggtgacgtggccctcgatgtctccatcggcatcctctccaccctgtgcgccccgttcatgattccgctgctgatgcagctgctcgcttctcagtacgtgtccgtgccgactcagtccctgttcctcaacgccgtcaaggtggtgctcttcccgatcgccctcggtgtgatctgccacatgatcttcggcaagaagatcgagaaggttacggtcgccctgcctatcgtttctcaggtggctattctgcttatcatcggcgtggtcgttgccgccaacggtccgaagctgttcgtggccagctccctggtggccatcccggtggtcatcctgcacaacctgtgcggctactcgctgggcttcggcttctccaagctgatgtacaagatctacccgaagggcttccgctacgcacagcagaaggccatcaccttcgaagtcggcatgcaggactccgctctgggcgcaaccctggccctgacctccttcgcaaccaacccactcgctgccgtgccgtccaccttcttctccgtgtggcacaacatctccggctctatcctgtccagctggtggcgcaaccacgatgacaagcacgagatccactgggattccgacaatggcgagaagggctctgccaagagcaccgtttcagcggcccacccgttcgacgccgataaggccgccaaggtcgctgcctgaaatcctgaaatggtgagaaaggtcgggtaaggcacgactccagtcagtcggtcatccacctttcctacctcgcataacatagccgctcccgcttactcccgattgaggtatcgggcgtttcgcgagggcggttttgctataattggtaatgcagaaagcggcaaggtaatacggcaaagaggccgggtcgctagaggttcccatcggatatggaagagcacgaggatgtgctggaaacagataacacagaagcggatgtggtgaaaagaaacataatgtaacctccttggcggtgcccccgtgtgacatagtctccgcgggggcacctgctgtgtggcgttccctttttgcgacgcattcccgggaatattgcgttgggagaatagttgggtgtgtgttttgcgacgcattggaatattgcgttgggaggagaggaaaagtacgggggcgcaggaggtccccaaaccagtgagttgtggctcggcgcgtcgttgtccggaggaatcgtaatatagatattcgtgtgtgccaacagcacgccttatgtaacaggcgagcatgctgggatatccttcaaaccgctgatcgcacgcagtaatgcgccgacgggaggggcgaaggccatcgggccggtggactgggctatcttttccgattcgtcgggtgccgccaacaggcggataccaagcgagtgtgctgaaaagtgtgggtgcagtgcggcggtcacacaaaagcaagagaaaccactgaatcggagaattcaagttgcctactattgaacagctcgtccgtaagggacgtcaggcaaagccgaagaagtccaagactttggccctgaagggcagcccgctgcgtcgcggcgtgtgcacccgtgtctacaccaccaccccgaagaagccgaactcggctctgcgtaaggtcgctcgtgtgcgcctgtcctcgggcatcgaagtcaccgcctacattccgggcgaaggccacaatctgcaggagcactccatcgtgctcgtgcgcggcggccgtgtgaaggatctcccgggtgtgcgttaccacatcgtgcgtggcgcgctcgatacccagggtgtcaaggaccgtaagcagggtcgttccctgtatggagcaaagaaggcgaagtaagagatatgtcacgtaagggaccttccaagaagcacgtcgtgctgcccgatccgatctacggttccaccgtggtggcgcagctcatcaacaagattctgcttgacggcaagaagtcgatcgccgaagacatcgtctactccgcgctcgatatggtcaaggagaagtccgaccaggagccggtggctgtgctcaagcgcgccctggacaacatccgtccgtccctcgaggttcgctcccgccgtgtcggtggcgccacctaccaggtgccggtcgaggtcaagccgaaccgcgccaacaccctgtcgctgcgctggctgaccgacttctcccgcgcccgtcgtgagaagaccatggctgagcgtctcgccaatgagatcctggatgcctccaacggcctcggtgcttctgtcaagcgccgcgaggatactcataagatggcagaggctaacaaggccttcgctcattaccgctggtaatcactcgccctgagtaaaactaaggaaaaagatggctgaagagatttcggacctccacgacgtccgcaatatcggcatcatggcccacattgatgccggcaagaccaccactaccgagcgtattctgttctacaccggtaagaactacaagatcggcgagacccacgacggcgcctccaccatggacttcatggcgcaggagcaggaacgtggtatcaccatccagtccgctgctaccacctgcttctggagccgtcagtcccacgacaccaaggacaagttccagatcaacatcatcgatacccctggccacgtggacttcacggccgaggtggagcgctccctgcgtgtgctcgatggtgccgttgccgtgttcgacggcaaggaaggcgtggagcctcagtccgagaccgtgtggcgtcaggctgacaagtacggcgttccgcgtatctgcttcatcaacaagatggacaagctgggcgcgaacttctactactccgtcgacaccatcaaggagaagctgggcgctactccgatcgtgatgcagttgccgatcggttccgagaacgacttcactggcgttgtcgacctggttgagatgcaggcttacgtgtggaacggcaccgaggagctcggcgccaagtacgacaccactgagatcccggacgacctcaaggacaaggctcaggagtaccacgagaagctcgtggaagccgctgccgaagccgacgacgacctcatgaacaagttcttcgaggacggcgacctgtccaaggaagacatccgcgctggcgtgcgtaagctcaccatcgccaaggaagccttcccgatcttctgcggttccgccttcaaggacaagggcgttcagccgatgctggacggcgttgtcgattacctgccgtctcctgaagacgtgccggccatcaagggctacaagcctggcgatgagtccgtcgagatcgaccgtcacccggtcaagtccgatccgttcgcggctctggtcttcaagatctccacccacccgttctacggcaagctcgtgttcgtgcgcgtctactccggctccgttgtgccgggcgactccgtgctcgactccacccgcgagaagaaggaacgtatcggcaagatcttccagatgcacgccgataaggaaaacccgatggaccgcgctgacgccggtaacatctacaccttcgtgggcctgaagaacgtgaccaccggtgacaccctgtgcgccatcgacgatccgatcaccctcgactccatgaccttcccggatcctgtgatccaggtggccgtcgaaccgaagaccaaggccgaccaggagaagatgggcatcgccctgtccaagctggccgaagaggatccgaccttccaggtcacgaccgacgaagagtccggccagaccctgatcgccggcatgggcgagctccagctcgacatcatcgtcgaccgtatgcgccgcgagttcaaggttgagtgcaaccagggcaagccgcaggtcgcctaccgcgagaccatccgcaaggccgtcatggaccagggctacacccacaagaagcagaccggtggttccggccagttcgcaaaggtcctgatgaacttcgagccgctcgacaccaccgagggcaagaccttcgagttcgagaataaggtcaccggcggccacatctccgccgaattcatcggccccatcgaggccggtgtcaaggaggccatggagtccggtgttctcgccggcttcccggtcgtgggcgtcaaggccaccgtcactgacggccagatgcacccggtcgattcctccgaaatggccttcaagctcgcaggttccatgtgcttcaaggaagctgccccgaaggccaagccggtcattctcgaaccgatcatgaaggtcgaagtccgtacgccggaagagtacatgggcgaagtcatcggcgatctgaaccagcgccgtggcaacatccagtccatgaccgacggtgtcggcgtcaaggtcatcgacgccaaggtcccgctgtccgagatgttcggctacatcggcgacctgcgttccaagacccagggtcgtgccatgttcaccatggagatggactcctacgacgaggtgccgaagagcgtctccgaggagatcatcaaggcccagcgcggcgagtgacacgcgccactgcatgaagtagccagtgtcttcagtcagcggtaatatcgtataccgctgactgggttctggctcttcaaagtggcacataacccagaaacccagtagaataagcgagttcctgtgcgaaagggtgcaggaaactcacgagacgtccaggaggacaaaagtaatggcaaaggaaaagtacgagcgtactaagccgcacgttaacatcggtaccatcggccacgtcgaccacggtaagactaccctgactgccgccatctccaaggtgctgcacgaggagttcccggatgtcaacccggagtacgacttcaaccagatcgattccgctccggaagaggccgcccgcggtatcaccatcaacatcgcccacatcgagtaccagaccgagaagcgtcactacgctcacgtcgactgcccgggccacgccgacttcgtgaagaacatgattaccggtgctgcccagatggatggcgctatcctcgttgtggccgccaccgacggcccgatggcccagactcgcgagcacgtgctgctcgcccgtcaggttggcgttccgaagatcctcgtcgccctgaacaagtgcgacatggtcgacgatgaagagctcatcgagctcgtcgaagaagaggtccgcgacctcctcgacgagaacggcttcgaccgtgactgcccggtcatccacacctccgcttacggtgctctgcacgacgacgctccggaccacgagaagtgggtccagtccgttaaggacctcatggacgctgtcgacgactacatcccgaccccggttcacgacctggacaagccgttcctgatgccgatcgaggacgtcttcaccatctccggccgtggtaccgttgtcaccggtcgtgtcgagcgtggccagctggccgtcaacaccccggtcgagatcgttggtatccgtccgacccagcagaccaccgtcacctccatcgagaccttccacaagaccatggacgcctgcgaggctggcgacaacaccggtctgcttctgcgtggtctcggccgtgacgatgtcgagcgtggccaggttgtggccaagccgggctccgtcaccccgcacaccaagttcgagggcgaagtctacgtgctgaccaaggacgaaggcggccgtcactcgccgttcttctccaactaccgtccgcagttctacttccgcaccaccgacgtcaccggcgtcatcgagctgccggaaggcgtcgagatggttcagccgggcgaccacgctaccttcaccgttgagctgattcagcccatcgctatggaggaaggcctgaccttcgctgtgcgtgaaggtggccacaccgtcggctccggtcgtgtgaccaagatcctcgcctgattttcatcagacaagaatcttcgcttgaactagcgttataggaaatccccttcgaggaaactcggaggggattttctataaccgcagcaggatatggatatgtaccacgacttccggcctggatgcgctagtgttgcttttcaatagataaacggactgctgcactgcgaggatatgacactgatggcaggccgggaaagaaggtcgatgatgactggtgcacaggccgctcactgtggttctgtatccgcaatttcgctgggactgcccgtttccacggcgattcccgaagccaaaggcacactgccgaaagccttgttcgtaggcaaagcgccgatttccggcaaactcaagcagcgattggtgaacgagatcgaatccatcaccatgctggcgttggcccggtcggccaacacggggcttgcggacggcaaactgatcccggaagtgctggtcatcggactgaagcttacggccaaagccaccggcataccgaacgaagtcatcgacctgatcgccggacagcgcaaatcgggcatcgtgttcgtgtgcgtacgcgacgtgccgttcgagggcagcacgcgtgaggaatgcgcgttcgccgtgcgccgcgccataccggggcgtgccgggcacacgccgatctatcaggtatatgccggcgactggcagccggcgggggaggcccagctggagctggccggctctactattgatgagctgtgggcatcgctgtgctcacagaccattttgggtacgccggaggtcgagaatctggatgcgcgcatcattcgccatactgaaattgctcggctcgaatccgaagtggacaagctcactcgtgaccatcagcgcgtcaagaacccggcccagcgcaacgagatctatgccaaactccacaaggccaaggcgcagctcgcaaaactgcgcgaggcatagtgatgtgaaagccattgggcttccgctggcgggagctggctcgcgaagcgagactgagggtggtccaggtccgtggcctagggctacgcccaagctaattgaaatattcgtgcatcatacagcgtacagttaaaccatgttccctctgctcgaaaccctggtcgccgtatacgaggtgggtcagttcacgctggccgccgatgagctgaaggtatcgcagtcgacggtgtcgtcgcgtatcgcccaattggagcagatggtcggcgcgccgctgttcgtgcgcaatgcgaaaagtgacgtgacgcccacacaggccgggcggatgctgtaccagactgccatcggcatcgacggattatggcgggatacgcgtgagcagatcgcccgcgtgcaggaggcgcgtgagccgctggccgtgtcgttctcgcacacgaccgcggcgattctgctgccgaaggcgttgccggtgatggctcgggacatggacggtttcgacttcgctgtacacgtgatgaactcggatgcgattctcgaacaggccagcatgaaggccgtgcagctcggcgtggtggaaaagccgatcgtgaacgattcggtggaccgcgtcaccctgtgcgaggaccggctggtgttggcgggggagcctgacggcgtgtggatggtgcgcgaacacggttccggcgtgcggtattacacggatctgtatttcaagaccgctcaggttgtgcctgcacgcacgatggaagtgtccagtaatgcggcgattgtggcggcgctgtccgccgggttcgggcagtcgttgatttcggaagccgccgtgccggcgggcgtgccggtgcagcgggagcttggcgatgagtttgtgcggcggttctatgcgctggtgccgagatccggtctgacgcacgatcagcgggagttggcggagacgattattgctgcgctgcgcgggtagtcagatagtcgactgaggggaggttgcgaacgttgtttctctccctccgtccgcctgcggcggccacctctctcatcagagggagatcaattaggtatcgacaaaatcgatgatatgtattggttgcaatgatttgaccgatgtaaacgcttgagcttcaatagacatcatgagagagttctgtacaaaatggtggaagcgcattgccaccgttgacatgctgttcattggtgttctgactctgctggcctcgctgttcgcctcctggctcaagcagttccccggattcagcctgttcggcgcgctcatcatcgcgctgctcatcggtatgatcatccagttcccgatccgcagtgcctacgtcggttccaatgatggccgcaaggcaggcgtcaaggacgccgctggcctgatttccaacaagctgctgcgcctcggcatcatcctgctcggtttcaagctcaacctcgccgtgctgttcacgcagggcatcaagtgtctgccgatcgccgctgtggtcgttacgctgaccatcatcgtgtgctatgccatcgcccgcaaactcggtgtcgacccgatgctcgccatcctgaccgccggtggcaccggcatctgcggtgcggccgccgtcatgggcctggccggttccatcaaggtgcctgaggacaagcaggacgagaaggacaacgacgtgaccatggccgtggccatcgtagccattatgggtactgtgttcgcgttgctggagatcgcgctcggcccgctgaccggcatgaccaaggaccagctgggcatcaccgccggtgcttccctgcacgaaatcgcccacgcggtcgcgggcggcgacgcgttcggcgcggtggacatcgccaccatcatgaagctttcccgcgtgctcatgcttgtgttcgcggccatcatcatcgccatctggtgggagaagaagcattccgaggttcagagcaccggcaagaagaccgtggccttcccgtggttcatgctcggcttcatcggcgcttcgattatcggcaccttcgtaccgttcgtcacctccatcaccccgcagctcgtggactttgcgtacatcgtgctcggcatggccatggccgcgctcggcatcaacgtgaacttcaaggccatcgcttccaagggcaagaagccgatgctcgccagcttcctgacatcgattctgctcatgtgcttcgctgcaggtgttgcgatgctgttcttctgataagcgctccaaatacaaataggcgaaggcgaacgacagtgagcaattggaatgtgtcacctaaaaatcacgtacttgcacaacggataaccccagccgaactggcaggccatcgcaatgaacttcaccacatatggactcagcccggtcgcacccggcatccagccgatcagcagcgtgctgaacgtgaagttccagatccacagcagcacgaacagcgccacggaacgggtgaagttgctggacgatttgaatgtcacgttgcggttcatcacgaagttgtaggtcgccgaacacaccacggcgatgccgttggcgatctgtgagggtacgccgatcaagtgcagaatggcgaacgtcgcatactccacaatggtctgcgtggcggaaacacccacatacttgcccagcacggcgagtccattttgcttcggggttgccgtgcccacggtattttccgcagtattcgttgtggtcgaggtatttgcggcgcccacaccttgattcggcttcacatccgctccattgttcgccatgcccatatacctcccggatgtacctgtgacgttcgacctcgcaatgataccgctgaccgcgtcgggaatcggcgtggcggtcagacgagaaaaccgcaggccgcagcaacgaccggcacacccagcgacagcaccagataggccgctgcggtggggtagcggtgtttgcggaagagcgtcaccatttcgttgattgcggtcgagaacgtggagaagccgccgaggaaaccggtggccagcactagccgccatggttcatcaagtgtcccgccgagtgccagcgccgcgaccaaaccggctaggaatccggcgatgagattgatggtgaacgtggaaagtgggaatgcgcgctgccagtacgttttgatggtcacgtcaagcagatagcggcaggaggcgcctacgccgccgcacaggcagaccaagattggtaggaatacggtcatcacgccttacctcccttgctggtcgtagcggcattcgtatcagcggacgcttcggcggatacgttcgaggagccggccagatgcgttcctgcccacacgccggcagacgcacaaaccagacccagcgcgaacgtcaccagtagataggcaatgccggccgccacctgaccgtcgcggattgcggtaaaaccttccagcgcgagtgtcgacatcgtagacaaaccaccgcatacgcccatgccgagtccgcgactggcaagttctttggaacgtgcgccgaaccgggaagcgccggccaagtaagcggtcaaccctgcatagcagaagcaagccagcatgttggccacaaacgtgccggtatggaagctgccagccgcgggaatctgtgcgaacgcatagcggatagcggtgccgatcgcaccgccgcagaagacgaccaacacaatatcaagatgaatatcggggagcttgcgcgccgggggagtggtcgtgtgcgtaatcggccgggcacctgcggatggggattgcgaatccataatagcctttcctgaaaccgctgaatcctgctgaagacacaacgatttcatgcaatatcaaatcgtgtgtaggaactatcagcagtgtgcggttcgaaacgagttcaggcgggttccatcgccggttccttagcctactcgtggcggcgacaacaaacggcagcagtatctcggatattggcctatcgcggtggatttcggcaagagacttctgcaatgccgatgaacttggttgccgtgaggcgataaagcacgtagatgaattgcttggttgcttccatacctcgtgggtatggctcaacatggtttatggctattggctaatacagatcgattgtcgtttaatggaacatgaggataacgggccctaatcgctcggtgccggaaacaaggagttgtgaatatgtctgaaaccatgaaagccgcgattttcgttgagcctggcaagatgaccgtggaagaagtgccaaaggcggcacttcagcaggatgatgacatcgtgattcgcatggtgcgcacctgtgtatgcggctctgatttgtggttcttccgtgggctgagcggacaggccgcacacagtcaggtgggccacgaagccattggcgtggtcgaggagactggcgcggcggtcgaatccgttaagccaggtgatttcgtggtcgtgccattcccgtacagctgcggcaagtgcccggtatgcaaggccggcttcgaatccgtgtgcccgcacgggggctacttctccgcttgtcaggccgaatacctgcgtgtgcccgaggcggacggcaccgtggtcaaggtgcccggttcaccggaagattattccgatgaacagctcgcatcgctgctgaccatttccgatgtgatgtccaccggttatcacgcggcggtttctgccgaggtcaagcccggtgacacagccgtggtcatgggcgatggtgcagtcggcctgtgcggtgtgattgccgccaagatgcgtggtgccacgcgcattattgccatgagccgtcacgaggatcgcgcggcgctcgcccgcgaattcggtgcgactgatatcgtgcccgagcgtggccaagaggctattgacaaggtgctggagatgaccggtggctatggtgcggacgcggtgctcgaatgcgtgggctccaagcagtccttcgacacggcgattggcctgattcgccgcggtggcgtgattggtcgtgtgggtctgccgcacgacgtggagatcagcgccgaaggcacgttctacggcaacatcggcatcaagggcggcccggctcccgtgcgccactacgatattgacggtggtctgctggatgcggtgcttaaaggcgagattaaccctggccgcgtgttcaccgccgaatatgacctcgaccatattcaggacgcttatgaggccatggaccagcgcaaagttattaaggcgttgatccggttctaatcgcgtggtgtgacggggtttaccgcagtggtatttaacgcccgtatgtatgcgtcccctttgtagggccgcatacatacggacgttgtgatgtgtctgacgcggtttacgctgaacgattgtggtgacgcaaaccggtcacctgttactcggcgagcagtgccttgtactgtgcagcggactgggcgagggcctcgtcggtgatgccgaaagcgccgcacgtggcgaacggcttgagtcaggtcgcgccgatgtataagccgtgccctcgatcggaataagcagctgctcgatggggtagtggccggggtgccggtctggtaggccgattccggcgaaccggtggacactgcgcatcgcgtcgggaaccgtggccaaggcgtacaccgaactcgccgactgcggcatcatcgacaccggtgccggccgcgcggcgcgtgtaaaacgggtcaagccgattcccgaaccgctggtgcgcgcggccaagacctatgccgacgaggcccgccggcttggcgcgagcctcgatgacgccttcaacgccctgtgcgcgcagtggtaaagcgcgcaccgatgcgaagcctacacggggtgcaccgtcagcgaaaagtcgccgatggtgctgacggtcgagggtgaggccagattgcagacatctcgcaagcagtacgtggcatacagcggaagataggttgttccgccgtcctgcgcaatattggagcgggacagcaccacgccctgcgagatgcgatattcggcattggccaatacggcgtcgatggcggcgtgcgtgcggtagctgcgccccgacttgacctcgaacggcatcacagaatcggcgttcgtgtcagcgatgaaatcgacttcaccatgtttctttgccatgtagtaatacagcggaatgccttgcgccgtcagctcctgagcaatcacgttctcgtagatggcacccagattcggtgaggaatcatcaaggtatgcggcttgcgcggtcggttgcgggtatcgtgccatgagcataccggtatcagactggtacagtttgaacttcggtgattgcgccgtgcgtttcaatggtgttttcggctcggtgacgcagttggttttcaatgccacacccgcatcgacaagccaaagaaaatccttctgattgcggtcgtaccgagcaccggggctgatggaggagacggcgaatctgccgttaccgtcaatcagctgagtggggagctggtcgaagatctcctgcacctgcaatgcgcgattgcctgcgtactgcgaaatatcgtggcgatattgccggttcaactcgttctgtaccgcgcgcacagccgccaaatcacccttggtgtccagaaaacgttgcacgacttccggcatgccgccgactaccagataggtgcggaagttcgtcatcattgcatcgtgaatgtaccggtcgattggcgtgaccgaccggcaggattctcggatgttttcaagtgtcgacttctgtacgccgatggcccaacagaattcctcaaaatccatgggacgcatggttttttcgatgaccgagccaacggggtaggagcgtacgcccttgaactcagtgccgagcatggaaccggagaacacataatcgaaacggccatcggccaccagaaacttgaccatggtcatcacatccggtgcctcttgcacctcgtcgatgaaaatcaacgtatcaccgggaatgagcgttgaaggtgagaacaaggtaaggcggctgatgaactcctgcacgtcgttcgccgatgcgagcgctcgggccgcctgcttgttctcgtacaggttgatttcaaggtaatgggcgtattcgtgcttggcgaactcgcgtaccgcgtagctcttgccgatctggcgagcgccggtcagcagcagtgctttgccggtaccgctccgcttccattccagcagatcgtccgagattttgcgctcaagcatggcagctcctttccgaatcccttatgagggtagcattttctgccttgtatgtgcaaaatgccgcatttcaaaatggggctttggtgcaaaatgccgcattttaaagtagggttttggtgcaaaatgccgtgtaaatggtgaattggacgtgcttgtaaggggagctggatgatcgtgcggctggatgaccttgtaactaaatgattgaacgattgcgcggccgtcgtttgcgtggccgcaaagttgtgtgggctgttcgcgaattatgcgcggtcggccgtcatgtgcctgcgcttggggtgctcgataagtagcgctcgcttcttggcgtcctcggcggtcgaagccggtacgccgtcggaggaggcgtcgatgatgcgctgcaggtagccgtatagggtgtgcagctcgtcgtcattcagacagtccagcatagaggggcctgatcaaaaccagttcacgaggtcctttttgctttaatccccgctgagagcgcgtagcgccggaggatgatcggatgccgcgacgccgaatcaagattcagccgctcgccgaccagcccgaccagcaaggaaccggattcgcgcatcggcggcatgcgcgctgctattcgcgctgaaacagcatggcatgggtgcgctgacaccgcgccggcgcaaaggccatcagtgaaactggggaatcggattgcaggtggcggacggtgcccaagacgaaagattctcgtccggcgttcagccgctgtcgttggccgtgatgatactggagaccatgaaactcaggcggcggcagccaagggcgaagtcgagaaagaggtgacggcgtgacacttgaacagaggtcagatagcgcggcggcaggccacgaggcatgtgaccagccgatcaggagcctggaaatcctcaaccaatgcgttccgctgttcgagacgctgaaggatccgaaccggcagcagttgctggtgcaattggtgtgccatgggccgcagacggtgggggagctggccgaatcgtcggcactgtcccgcacggccgtgtcccatcacatcaaactgctggaacaagccggattcatcgaaatcagcaaagacgccacccgccgcatttgctcggtgcgtgcggatcgatggctgccgctgctcgatgaactgtcttccgccctgaaagccgaccttgcggcggcggagcagtgccgagcatgagcgacgatcaacggccgcaggcgattgaggtgcgcggtgcgcgcgtgcataacctcaagaacatcgacatcgacattccgctgggcgaactggtgggcgtggccggcgtctccggttcgggcaaaagctctctggcgctcggcgtgctgtatgcggaaggttcgcggcgctacttggaagcgctgtccacgtacacgcgccgtcgactgactcaagccagccgcgcccaggtggacgaagtgctgcatgtgccggccgcgctggccctgcaccagcggcccactgtgcccggcatccgttcgacgttcggcacgatgaccgaattgctcaacagcctgcgactcctgttttcccgcgtcgcctcgcacgtgtgcccgcattgcggggcgcgcaatgaaccgacgctgaacgtggcggccggcctgcccatcacctgtgctggctgcggcaaggaattccacgcgcccggcgccgaattgctcgccttcaactcggccggcgcctgcccgacctgctccggcaccggcatcgtgcgcgaagtaaaccgcgcggccctggtcccggacgagtcgaaaagcatcgacgacggcgcggtgctgccatggggttcgctcatgtgggacctcatgaaacaggtgtgcggcgcgatgggcgtgcgcaccaacgtgccgttcaacgaactcacacccgaagaacgcgacatcgtattcaacgggccggccgtcaaaaagcatattctttacaagccgaagaaaggcgacgatttcgccgaactcgacttcacctacttcaacgccgtgtacacggtggagaacgcgctcgccaaagccaaggacgagaagggcctgaagcgtgtggtccggttcctcaaggaaggcccatgcgccgactgcggcggcacacgactgagcgtcgccgcccgggccccgcatgtgcgcgggctgaacttggccgaagccggcgcgatgaccttggacgcggcggcggattgggtgcgcggagtgccggaatccctgcccgccgacatgcggccgatggccgccaacatctgcgaatcgttcttggatgtggcccgacggctgctcgatctgggcctcggctatctggcgcttgaccgcgccggcgccacgctttcgaccggcgaacgccagcgtgtgcagctcgcccgggccgtgcgcaaccgcaccatcggcgtgctgtatgtgctcgacgagccatccatcggtcttcatccctcgaacgtggacgggctgctcggcgtgatgcacgacttggtggcggacggcaattccgtggtggtcgtggaccatgatgtgcgtgtactcaaagcgtgtgaccatcttatcgaaatggggccggttgccggtgccgaaggcgggcatgtgatcgcgcaaggcacggtcggcgaggtggcggcgaaccccagtagtcgcattgcgccgttcctatccgaccaggtgagtgcgcgtatacgtgagcgtgtggccgaatcgcaagtgttcagccttggccacatccgcatgacaaccagtcagctgcatacggtcaaaccgttggacgttgatatcccgcgcggccggctcgtggcggtgaccggcgtctccggctccggcaaaaccacgatggtactcgaatcgctgattcccgcactcaaagcgcaggcggcgggggagctgttgccggaacacgtgcgcgagcttgagaccgagggcatccgtcgtgcgaatctcatcgatgccacgccgatcggcgcgaacgtgcgttctaccgtggccacttatgccgatattcacgacgaattgcggcgcgcctttgcccgatgtgaggcggctaagacgggcggctggaaggccggcgatttctcatacaataccggccgactgcgttgccctacgtgcgacggcaccggttcgatctcgctcgacgtgcagttcctgccggatgtgaccatcgaatgcccggattgctgcggctcccggtacgcgcccgaagctgatgcgattcggcgtgcggttaagggagaatctcgcctttcgttgagtttgccccaactcatggcaatgagtgtggaccaggctctggccgtgaccagcgacctcaagaaggttcacgcacgtctgaccatcctgcacgatctgggtctcggctacctgacgctcggcgaaccgaccccggcgctttcgggcggcgaagcccagcggctgaaactcgccagcgaaatgggcaaggcccagttgaacgcggtattcgtgttcgacgagccgaccatcggcctccatccgctcgacgttcgcgtgctgctgggcgtgttcgaccggctcgtggtgagcggcgcgaccgtcgtggtcatcgaacatgacctcgacgtgatcgccaatgcggattggattatcgatatgggtccgggcggcggcgaaagcggcggacgcatcgtcgccaccggaacgccggaacaggtcgcggccaatccgaacagcatcaccgggcggtatctgcgctgacttgtatggcggtcacgcgcctttgcataggaccctgcgcgagtaggatagccgtccatggtgcagattcatggcattagacgcgcaagcgcggacgcgaaatatcggcagatgaccgggcagccggtcaaaccgctgatcctcaaactatgcctgccggccgtcatttccaatctggtgactactgcatacaacctgactgatacctttttcatcggccagctcggcaccgcgcagtccggtgctatcggcatcgcgttctccatcatgaccgtgatgcaggcgctcggcttcttcttcggcaacggcgcgggcaactcgatgagccgcgaactcggcaagcagaacaatgatcgcgcctcccgactactggccgtgggctttgcgggcgcggtgatctccggtctggtgattgccacaatcggactgctgaccctgcggccacttgtcgtcatgctgggctcgacctcgacgattgccccatacgccgtgcaatatctgacgccgttgctggtcgccgcaccctgcgtgtgcggttcgttcgcactcaacggattgttgagataccaaggtcaatcggcgttcggcatgattggtctggtgtccggcgcgctgttgaatttcctgcttgcgccattgttcattttcgtggccggtctggggattttcggtgccggcctcgccaccgccatctgccagacggtgagcttcacgattctgaccacgatgagccgcaaattcggcgtgatgaaactgtccctgcgcaattgcaggccggatgtgctgctcatgcgcgaagtggccggcggtggcctgccctcgctgatccgccaaggcgccggttcgatttccgtgacctgcgtgaacattgccgccaatccgttcggcgatgcggccatcgccggcatggccattgtgatgcgcattatgttgggcgccaactcggtgatcgtcggcctcggccaaggtttccaaccggtgtgcggctacaactacggtgccggcctgttcgcgcgcgtcaaagaagggtactggttctgcgtgcggctcgccacctgcgtgctcgtggtgttggcggtgttgctgtgggtgttcgcaccgcaactggtcgagatcttccgctccgacccggccgtggtggcggtgggcgtggccgcgctgcacatccaatgctgcacggtgattctcaacggcttcaacatgatgggcaatatgatgacccagaccatgggccgcaccggcatcgcctcattcctggccctgtgccgacaaggtctgtttttggcaccgatcgtactgattctgccgatgatgttcggcgtgctcggcgtggaaatggcgcaatcggtgtccgacgtgctgacattcctagtcactatcccgttcatgcggcgaatcctgcatgaattgcggtgaatggtagatggcaactatgaataatcgaagtgcaaagcgggtgccgggcgttccttctcccgcgtatatcgaatcgctgtaccgcaccatggctgccgcccttggcccgaccggatggtggccggctgaaaccacattcgagattatggtgggcgcggtgctgacgcagaatacggcgtggggcaatgtgaatcgttcgcttgcggcgttgaacgcggagggtgtgctcgaaccccataagctggcgattatggggccagcgcatctgcaggaacttattcgcccgtccggcttttatgtcaacaaatccaagacggtacagtcactgagccgatggtatgtggagcgttgcggagcctcgcctgagggcgcggcagatattcccgacgccgaattgcggaccgaattgctcggattattcggtatcgggggcgaaacggccgacgacctgatgctatatgtgttttcgcgccgcacattcgtggccgatacttatgctcgccgactattcgccttccttggatttgatgtgccaaccggctatctggcattccacaaggcctattcgcccgtggtgctggatgcgagcctcagcgtcaaggatttgcaggaattccatgggcttattgacgagttcggcaaggcctaccgcgacgacgcggccaaaagcgagtcctttttgggtggatggagggcttgactgcacggcgaatcgttctcaataagaaaagtgtgaggcccgcacggtgccaatcgcacatctgaatccaagaaatggctgtttgatgctattcccgcgaatgcgcgattgagtgatattgtgcgtttgcctcacacttttcttattgagaatgattcgctgcgatatgccgcttacttgacaaccttaaaaccgctggtccatggggtctgattggtgacgccttcagccgctgctgctgcggccttgtccgggttgcggtcgatgacctgcacggtggcgccagccttgacggtgatgcctgtgacgccggcaatccgctctccaccgagcagatcgacgacccctatcgccgtggcatcatcgccgtgcatgacgccgagattgccgccgaacttgactggctgcgctcgatgctgggtgtcgaaaacgagtctgtgacagaatagttcgaccgacacaatcgccaaaacgccgaacaggagccaatgatgaccgaagacaagccgatcgccaagccgattatcgatgatgcgacgcgcgagaaaatggcgcttatgttctctggcgaggtctacctgccggatgatgtggacggcttttttgatctgcagggcgcccagcgtgatctccagctcgaactcaacgccacgccgctgaccaacccgaagcgccgtaccgaactcatgcaggcgttcttcggcgcggcgggggagggtctgtacctcgaatgcccggtgtatgcgaactggggctgcaatacttattggggcgagcgctgttacgccaacttcaacctgacgctggtggacgatggtgagatcttcatcggatcccacaccatgatcggccccaacgtcacgcttgtagccaccggccatcccgtgcgtccggacctgcgctatcagggtgcccagtattcgttgccagtccacatcggcgagaacgtctggatcggcgcgaatgtcaccgtgctgcccggggcaccatcggggacaacgcggtcattggcgccaactcgctggtcaccaaggacatccccgccaacacggtcgcctatggcagcccgtgcaaggtaattcgcgaaatcaacgaacgcgacgacgtctactactggcgcgaccgccaattcagtgagcgttttaagctcaaagagcagtagcgcgaaagctcactcccacacgtcgagcttgcgatttttgtagaaatactcgcggtccttgtcgccgatttcacgcacgacctcgcagggcgcgccgtaggtgacggagttggcggggatggaatgtgtcacgaccgaaccggcgccaatcacgcaattgtcgccgatggtcactcccggcagaatcgacacgttcgcgccgacccacacgttgcgcccgctgatcaccggaatgcaatacgtgtaatggtgctcgcgcagcaccggcaacacggggtggccggcggcgcattagcacggggaacggttgaacgagaagtggattggcatgtggtggtatcgaacatactgatgcgtgtgccgccgagcctgtccagatggctgcctatatgaaccagtgacagaaaagcacgggaacgcgagcgagaggagtgtgcatggggcagttcggcgtcatgattggccagttagtcggatttctgatcatgctgatggtcgggtatggatgtgtgaggcttcgattctacggtcagacggcgttggacggcatgtgctcgttgctgctcaacgtgctcatccccgtgcttgtgttttcgaacgccgtcgatggtgcggaccgcgcgcagcttgccgctaactggggcgtgatgctgctgaccgccgtgatgtacgcgctgctcatcctggtgttctggctggtcgccaaactgttgcggctcaaaggttcgcgtagccatgtatttcaggcgtcgcttattttcggcaacgccggattcatcggcattccgttgattatggcactttggccgcagaacggcgcgatttacgtggcgctgatgtcgatcatcgaccaaacgctgctctggacgtacggcgtatggctgtgcgagccggtcgacgaaacgactggcggcaacgcgattggcgcgcgaggtgcggtcgtgaacggttcggtgaacggcgccggttcggtgggcaatgctggttcggcgagcaatgccgcaaacggtggttctccggccatcgtccgcccctcgccaggcacccgcgtcctcggcctgcttaaacgattcgtcaatcccgccttcgtcggcgtgatgctcgccctgattctgattctgctcggcgtcaaggtgccggacatcatcctgaagccgctgcacaccatcggcaatatggccacgccgatgtcgctaatctacttgggcggcctgttcgcgctgaccaagtggtggggcgtcctcaaacgctacgaactctatgctggcctagtcgccaagatgatcgcattcccgctcgccttctacgcgctactgaccgcgctgaccggcgcattgccgcaactgccgatcacccatgacatggtgctgatgatcacggtcatcgccggactgccgaccatgaccaccatcgccatgttcaccggtcgcaagaacaacatgcccgagtatgcggtcggcttcgtgctcgtaagcacgctgttctcgctggcctccctgacgattgtgtcggcagttgtgttctgaattgtccccttcgacgaaaagaatgccggggcctccggcgcttggaatttcatcgacgccgccaacgactccaatccgaggcggccgtgccgtatttcaaggagatattcgattacgcgcgcacgctcgatccgcagcatcgcccgctgacctacaccaatctgctgatggccgccggaggcaaagacaagtgccatcagttcgcggatgtcatctgcctgaaccggtattacggctggtatgtgcaagatgggtatcagctcatcggagccaagaaggccttcatcaacgagatgaaccaatggatgaacaccgaacccaacaagccgtttctgttcaccgaatacggtgcggacaccgatgccggtgtgcacaagctgccgagcatgcaatggagtgaagagtaccaatgcgagtacctcaccatgcaacacgaagtgttcgacatgttcgaggcagtggtgggcgagcaggtatggaacctctgcgacttccaaaccggtgaaggtatcatgcgcgtcgacggcaacaagaaggacgtcttcactcgcgaccgtcagcccaaagccgccgcctatgtactcaaggagcgttgggagactaagtagcggcccgcccctggaatattccaggagcaacacacatcgcataacacacaacgcaacatacaaaaaagaacctcgtgaaacgaatttcacgaggttctttctagttacgctgaatgactcccattagactcccacgagggaagagcaatgggaattccaacgtggctaagctctcaaactcagatgtggaatctgatttctatggtttgaggcaattattgatataatgcagaaaatggcttgataatgccaattatgtggtgtatcgaaggtgggtatagacggctttagatttctttagattgccattgttggctacccttttggctaccctatggaatatcctggtcgtatggcacgaagaacacacggaagcggcagcgtttacccggaacgcaccggagggtttcgggcgacgtgcgagttgcctccggatccggcgacggggaagcggcggcgtctggtggcgcgtggacgcaccaaggccatagcgttgaaacgtttgaaggacaagaagctggagtatgagcgctccggtcgtatgccgagccagacgactccatatttgaaagattggctggataggtggttggatgagattgtcaaacctcgtctgcgtccttcgacgttggcgacatacagaagcaccgtcgaggcgttgatcaagcccgcgatagggggcgttcggttgggcaggctggagccgaagcattttcggttgatggaagagtacatcaccaaaggcgatgacacatgcgatccgccgaggaagccgcgaagcagcgcaacggcgggcagtgcatggcggacgttgcacaaggcgctcgacgatgccgtgaaggaggggatcattgagtcgaacccgagcgaccgtgccgaagctccgcgggttgtttatacggagcgtaagattttgacgccggtgcaggcggggcaactcattaatgccgagaacgatgtcatgtggcatctgatgtggcggctcgcctatgagacgggcatgaggcagggggagcgtcttggtttgacgaactccgagatccagctgatcgacaacgcggtatgcatcgtggtcgaatggcagctgaaggtctacaacaacgtgaagggcgtgcgggacattcccagttcactcggcgctcgacatgtgacgggcaaggcttatctggtgcctcccaagacgaatgccggaagacgtgtgatcccattgcccgaatcgctagcggttgagttggggcggtacatcaaaggtaccgggcgaacaaattcggacgatctggttttcgttcaggcggatggaacgccgctgaaccgtatgattgagacccgggcgtggaagaaggcgctgaatcgagtcggactgccggatgattatgtgccgcattccgcccggcacacggcggcgacggcgatggcccagttgggcatgagcgacaaggtgcgtgaatccatcatgggacatagcgatataagcgtcaccaaccgcgtgtacacacatgtcggtacggccgacgcatccaaagccatcaacggagtcgaaacgctgctggcgttggaacccgcgaatccgcgggttctagatagaagtgcaacacctgcctagggttggaagtgtctaggttccagctggaggtgttgcactcgtgggtacatgttattcgcacctgtccccggacgagcggatcaggatcgagaggctgcattgcgagcagggtctgagcgtcagggaaacggccaggctggtcggccgggacaaggccaccgtcagccgcgagctgaaacggggactgtggttcgcgtccaacgagaacgaatcgtaccgcccgtaccggccgcggcggctgaagaccggcccgtggacgtccatgccgttctgctccgccctcgcggcgcagcggagggccgacctgaggcgccacgggtcccgcaaaccgcggcgcatggactcggaccggctgcgctcgtgggtgatggacgcgctgcgccgtggatggagccccgggctgatcgagggcaggccgaagctggagtaccccggcgaccccgtgatgcgggtcagccacgaatgcctccaccaatggatccacgccaaaccccagcgcgacctggacctgcgccaatacctgccgcggggcaggaagcgccgcgccagacggaagggacgcaaggtcaggggccgcgcatccccatgcgcgtggacatcggccaacggcccagggctgtggactcgcgcgggcagttcggccaccgggagtccgacaccgtgataggcgcggcccctcgcgcgtgtgcatcgacacgcaggtcgaacgcaaaagccgcagaccgttcgcccgcctgatccccgacaagagcgccatggccaccgcgcgcgccgaatacgagatctacagggacctgccgccccgggcgcgcatcgaccggacctgggacaacggcagcgaggcctcctgccaccagctggtcgacgaggccctgggcatgcccgcctacttcgccgacccctactccagctggcagcgcggaagcaacgagaacaggaacggcaggatccgccgctacctgcccaagaaaaccccgttcgacgacctgacccaggccgagctcgacgacatcgtcaaggagaccgacgacacccccatgaaacagctcgaatacaaaacacccaacgaggcatgggacgaggagataacccgactacaatcgcaaaacaccaacccaagcacaagcgttgcacttacaagttgaatccgggtttgacgaaccgtgttttcatgtaggataattccatgggaggtggcatcggcgatggggttggtggataaggtgagacggctgttggggcgtgattgggagatcgccaacacgcggcttatggaggaacaatattcggcgtgcgacacgctgcttgccgcgacgacgacggattatgcggatggggcccgcgcccttgcccgcaagtacggacaggatgggcacgggtatatggaagcgcatggcgtcatcctccgttccgatcccgatgacgaggggaacgcgggcaccgtcctcgtcgagggaaaccgcatcggtcggattccccgctatgtggccaggcagcttgaattcgggccttccggcgaggagcccgtcgtcatacgcatgttcaccgaacggacggccaggggattgcgctgcgaggcgtggtactggttcggccgttccgaaccacgctggttctattctcgggaccatcgccctcccatgacgcccgaagccaaagccgaggccgcgcaacgggacacggagcgtatggtggaggaagctctcgaagaaggcgggccacgcgcagattccttccggctgggcatggttgatgggacgcattacctggagacggtcgagccgatcaaacagctcaaacgcgaagaccgcctcgaagaggcgcttgacttgtgcatgacagccatccaaggagccgagaacgaggcgcgggccgaaggacatcaacccgctccctggtatacggaacaggccgccatcatcctccgcaaactcaaacgccccgatgaggagaaagccatcatccagcgctggattgacgcctgcccagaaggatacatcaaagccaatcccgacgaaacgcttgtcgtccgcctccgccgcatacgggaaaaggaaaacgccaaaagatcctaatgccgagaagacgcgcctgtcatatgcgtgccgtgctgccggcgtcgtgcatatgacagactcccgcggatcacgcaaccattctcacgcccggctttagctggcgttcagtgctagcgaatcgtccgattggaataccgcttctctactcgacatcgcaagctataagaacggacttgccatgcagcggttcaggtctgtagaagatgatcccggcctccccgtactaaagattcgtgagcttagccagggctattgcggcagtgacgccgagcgatgccgcagcgacattgacgagtcggtcaccatccatgatggagacctcgtgttctcctggtctggaactcttcttctcgacttctggtctggaggcaatgctgggttgaaccagcacctctttaaggttacatccgatgcttatccaagctggttctattacatgtggaccaagaaacacatgcgccgcttcatcatgctggcgaaggaccgcgcaaccaccatgggccatatcaagcgcagtgcattgcaggaatccaaggtgctcatacccccagcagacgtgatggctgaactatccgcaaaaatgcagcccatagtggacgaaataatcggcttgaaggttcaatctcgtaagctaggcgagcttagggatgcgttgcttccgaagcttatgtcaggtgaaattgacatctcacaagtcgagttacctacaaagtcaaatgagattggttaattggcatgaacattgcaaaactttacaagaaaggttcacacatggatatcaggaccctaatgaagaggcaatacaacgtcgagcttcggatagaaagagatggcgaaagccatattgagcatggcgtagtgggtgatggaattatctctatgccagttgatgctgatatccaggagcgtgacaagatatttcgtcaaaacagttgcgggacgaatcaaaagtgattaccgttactcgccgtatgtctataactctttcgtgttcccctcgaacaatctagagagtattaaagaagccgcattagcggttgttaaatctcgtgcgatatacaccggcaaaaaccttgccgatatgtatgcaataaagaacagattcttttacccggaacttatgcaagctcaccgagaacttgacgaacaagtgatggcgggatacgggctacgtagcgacagcaatgaaggacagattgtcgatatgttgttcgacttgtatttgcgggtgactggcaaacgcggttattagccggtatggtcaccgatatgttagggcggcaggagtgactgttgttgttcctgccgcctttcttatgtggctctcagttgtcgttcatgccgaattcaattgtccgaagcacgcccttccagtaggattcccggtcaagcactgtatcacgggacgccttcttgtcgaatatttccagaatcgaatatgagaagtttcggatgatgtgctctgccccgtactggttcttcaactcgatcatctccttgttgccgccggtcgggtcggagaggttcgcgtaggatgaccatcgtgtccataggccatcggcgtcactggatgcgctccccacgtatagccgtcctgtgctccggtctgtaatcacatataccgcctttacgctggatagagcgtcatgccattccggttcgttgtggttgatgatgtcctgtaactcgccgtgcgtgagacacacgtgatcgtatccgttgaatgctccgagcttcgtccgtggcgagatctcatacacttcaggatccagttgcgcctgtatattcgcgtatttgcgtagatacaaatcacgcccaatgggtttgttgagacgaattacaagtcttttccgatattcggaatactcatccattagagttagctcatatccatatatgttccattgtcccggggctgcatctcgtacatggtatagaccgccaaagatgaagtactctggcccatatcgatagtattgggcgaacgcgaacaagtacttcctgcctcccatattgccgtttggttgcttggttttccaggcgttcatgatcagccaatccgggtcgtcatgtagcaatagattccatgctggtcgtgaccggtcgttcgggttcatgttgaacttaatctttgcctgatctggtttgtcgaagtggaacagatcagtgagttttattggcatttgctctgtcattttcatctcctaaggtaacgtttgaacttttcgtttgttgcagagtgcgctaccgcgccagttataaaagaaaacgtgagtctctctacctgagtatttcgtaaatgaatccgtcgtgtagcttgacggcgatcttgtcgtagcgggagtcatcggggtgctcttccatcgcatcgtgggcggcgcacagtcgttggatgtcgccaccgatcaggttccgtttgctgaagaggtcactggcgtgcttatgcattgccttggcgacgctgttcttgctgtctccttggtggattgcccatgcggcgactaccgccagttcatggtcgagggctttcttgagttccgatatcagcagcacttgggcgacgtgatggcatagtccgttgtcgtactccggagacaggggcatcactatgcggccgttctctcgttgtattggcatgacagccgtctctgcttccagctgtttggctaaatcagtggacgcttcatcgacttggtcgagaagatcgagaaccatgttgtgcatgagtttgctgtaataggcgctgttctcgatttccttgagaactcgcatgttatctcgcgtgtgtttctgcggtgattccagccgtgccataggagtcccttctccagaacaattctatatgaatatggtacccagaaaaactttggggaattagctgattgacgaaaggatggacatcgtcaagggagcgcacagagcgatcccgaaaaccagaaaggcggcggtcatatgccacgcaggaaaagctatacaactgtcgaaggatttcagagccttgatcagcatctcattgcccagcagatgattcccctgagggttgatgcgaagcagggcgattgggatgccgagaccaaaaccaatgcgcagaagaccaatgcggacggcgtaccccagtggctgatccagaccttgttccagccaatcgacggtgatgcagagcatgtgcccgaggtcgtgcccgttaccgtgacggccaaggtgaaacccgtcatccgtgtgggggctccggtggaatttgttggattcggcgcatgggtttacgtctcccacgacaagactacgaagcaggtcacgtcggtgaggcgcagcttcatggccgccgggttcaaacagaacggtggtgaatgatgatggggcgtaagaccagtatcacggtccgtatccccattgacctgctggaccggttggacgcgtacggggaatccgaattcggtcgtcgttttgatcggagcatgttcgtcgtggaagcggtaatggatcggctgaataatatcacggaaggaatccatcatgggtgacgtgttgttctggccggcgctgactttgattgtctgcgtcgcggccgtggtctttatcttggtcgtgcggttgcggaaactgcgccatacgattgagcatcacatgcctgaagcggtcgtgcgccgcgatggttggggctgtcgcgcgattgccctacccggccgtcggatctggctggtgccgaccgacatcgccgagcagcaggcgatggacgcgttgaaggagacggcgaaggcgtaccccggctggatcccctcgcatcggatgatgggacgtggtacgcgggcatactggttgctgtccgtccgccgtccggtgcggaagataatccgtcgcgaagatataccggcggagaaggatccggcccattacgtctgtatcggtctcaacttatctcgcaagccggtcatgatccgtagcgacgcgcacacactggtcatcggcttgacaggcagtggcaagggcagcatcatggcgacttacgtcgacggactttcgcagctgtatgaagacggcctcgtccagttctggggcatcgacctcaaaggcggcgtcgaaatgtcggtgtacggcactctctttgattcccaccacgcctatacgctcgacgacgccgtcgctctcctgcaagatctgtctaccgaatgcgaccacagaatggacagtctgcgtgggcgcgcgcgggagctgccgccgacgcccgagtatccacgaatcgtcctgctgatcgatgaagccgccgagctacacggcaaggcagataggaagaagagcgaattggtcacgcgcttgctggactcgatcctcagacgtgggcgtgcgctcggcatcgtcgtcgtggcgctcagtcaggatccacgtgtcgaatccgtcccgctgcgggcacggttcccgcagcgcatcgccctccggttgaacagcgaggaggaaaccgccatgttgctcggcaaggaggcgatagataggggagcggcaccttggctgatcgctcccaaccagcagggatccggattcgtctggaaccaaaacatgggaacaatcgactatttcagggcgccgtggtatggcgacgacgacctgatggaactgggcgcgtaggcgctgtgagaaccccgccgtcggagcgatgctcgcgcaggcggcggggttctctatacccaaaattcggtcattgaagcccggctgctcttgattattagatccaaatctcaccgaataccctgaaaggaggtgcattatgccccggataaccgtccgccgacacggcgcaagcgcatccattccacacgtcggggtgcataatggcacactccaatcagaccccacaaggacggcgaacaggggatggactcccgccgtcgcccggcggaatgcgcaattcctccagcgggtggatttcggcatgatggaaggcataccgtatgcgctgacgttgacgttgccggccaaaagcatggaacgtgtgacgcccgacttactgcaccgcctcatcgacgtcatgctcaaataccttgccagaaggggaatgaagcacttccactgggtcattgagttcaccgccaagcacatgccccacgtgcatatgaccgtctggatgtccgatacgcaccagcggtggaatccgaaaacccatcagcacgaaaccgtggacaacgaccttgttacggttaccggcatcgttgtcggcaagtggctggatgtgacagccgactgtgggatacatacctccggacaatcgcaggacgtgcaactgttggacggcaacgctgcatggctttcatatgtcgccaagcacactcaacgcggagtctggcactatcagagggcgttggagaacatgccttccacgtggaaggagaacccgggcgcgatgtggggacactcccggaaaattcctctgaccgaggactccgttcttcccgccgatctgcatgcctttcatcaattccgtcgtgaaacccggaaatggtgttgttcgcaggcctcacggatagctgacccgaaacgtcgggcaaaggccatccagcaagcgcggcgcatgaaccgatgcccgatacgggaactgtccgttgtgcgtccgatctcgatatggattccgcgaacggtgtcagcggcgatcattagaggattgcggtcgcgcggatacatgatcggtcgtgacgtttacgaatgggtgatatcagaaatggatcgattgcgtgcgaccggtgacgatcctgaccggatgcgggcgctccaacggacatttgcggaaatgatgcgggggtgaacatcatggcgatcgtcatccccgaaatcccactcaaggacaagctcacgctcacggtgccggaggcgtcggccctttccggcatcccatacaagatcgtcaacgccgccgtcaagaacggcaacctcgccgcatgctacgccggcagctccaccgtccggatccgacgttccgacctcgacgactgggtggcggccttgccatccgactggtgttgaaacacaagaagaccccggagaaatccggggtctctttgtatgccaattggctaccgtttggctacccttagaatcaagaatggctcaattccatggaaaattagccatacgggtcagatgtggaagtagagctcgtactcgagcggggtcggggccaggcgagcctggtcgatctcgtcgcgcttgaggccaatccaggtctcgatcaggtcgtcggtgaacacgtcgccggcggtgaggaagtcgtggtcctcttccagggcgtccatagcctcagccagggagctcggcacctgcttgatgccggcgtgctcttccggcggcagctcgtagaggtccttgtcgaccggctccggaggctcgatgtggttcaggatgccgtccaggccagccatcagctgagcggagaaggccaggaacgggttgcaggacggatccggagcacggaactcgatgcgcttggcagccggggaggtgccggccagcggaatacggatggcggcagaacggttacgagcggagtacaccaggttgaccggagcctcgaagcccggaaccagacggtggtaggagttcagggacgggttggtgaaggccagcacggaggaggagtgcttgatcagaccgccgatgtaccagcgagccagatcggacaggccagcgtagcccttctcgtcgtagaacagcggcttgccgtccttccacagggactggtggcagtgcataccagtgccgttgtcgccagcgatcggcttcggcatgaaggtcgcagccttgccggccagagcggcggtctcgtggacgacgtacttgtacttcatcaggtcatcgcctgcgtgctgcagggtgttgaagcggtagttgatctcctgctgaccagcgccggccacctcgtggtgggaacgctcgagaatcaggccgaccttctgcaggttggcgaccatatcgtcgcgcaggtcctgagtgtggtcaatcggcggaaccgggaagtagcccttcttgacgcggttcttgaaaccgatgttcggggtgccgtcttcctcaacgtcaacaccggagttccacggagcttcgatggagtcgacctcgtagaaggagcggttcatgccgttctcgaagcggaccttgtcgaagatgaagaactcggcctcaggagcgaaggaggcggtgtcggcgataccggtggacttcaggtaggcctcggccttgccagcaacctgacgcgggtcgcgggagtacggctcgtcggtcagcgggtcgacgatggagaaggccacgtcaagggtcttgtgcttgcggaacgggtcaatgaaagcggtctcaacgtccgggaccagcttcatgtcggactcgttgatggcttggaagccctgaacggaggaaccatcgaacggcatgccgtcggtgaaagcgtccttcaggaattcgctagccggcacggtgaagtgctgctgaacgccgataagatcggtgaaacggacggagacatactcgatgccttccttgttgataagggcctcggcgtcttccttggacttgagttcggtcacgggaccgctcctttcgtatgaaatataacggtatctatcgtaaaatcgagcgtttcgccggctcgaaacttgggttacgagaatgtttcgtgactgtggccgacaatcgcgcaggcgcgttatttcaacgaaacatcattacagaatggaaacggaggctatcgggggagtgggtagaggtgtccgcaacgtggacagtggatattgacaggtgacgtaggtggatgtatgtggacgcgattatgagacatatgacgaagccccggaaccgattgaacggattccggggcttctgtgcgatttggtggtgtgctgccgatcagcgaccgcgcatcgcgcggcgggagatcttctgcgggtggttcgggtccatgcccttggggatggcataacccttcttggcctgcagcgtgcgcagacgatcgttcagcgtttccatctcggccttggtcagcaggaagcgacgacgcggatgaatcttggcgatcagtgcgttcttgtggttcgtgggctcatagctcttggacttggtcaccgtgctacgcagcttgtccagtggcacctgcttggggccgtggcccacggagatgcggtacaccggaatggaggagccggcggtgacgcccttgatatcgtgttcctgacgatccatcgccttcatgatgcgaccgtattcgccttcgccgatcaggtagatgccgttcatcgaagtgccgcgccagatggcatccttggtcttcgggtcgatccacaccggttcctgcgggaagttaaagccggctttctgcatgttgctcagcacgccgatggcggcaccaggcttgccgtcaatctgcttgtagccgactgcatccgcgcggcgggtgagcatcatggtggccagtagcatgccgagcatgatggcggtgatcatggtgaagatccaggtcagccaggtccacttggcaatcagaccgatgatgatcatcacgactacaggcagcaggaaagcaccggcctcaagccacggcagggccttgtcttccttagccgtgtacttgtagatctggatgatctgcttgattgtgctctgcttcttcggcttcgcgtccttttccgccatcacttcttcctttgttgggacgaaacacactagacaacatcttatcaggtgcgctggtccgaacttgtttgtgctggttggtctcagcgtgtgtgtaacggccgtccgtcggccttgagcagcgcctcgccgagcgtttcactgaacgtgggatgcgggtgaacgaggcgggctgcgtcggcgagcggcacatggttgccgaccagctgttcggcttcggcgatgatgtcggaggccatctgggagaccatgtgcacgccgagcacgcgcggggtgtccgggttggccgcgtcgcagccggagacgatggtcagtgaaccggccgtgccgctcatcagcatgcgcgcgttcgccagcatcggatagttggtctccttgatttcaatgagatcctctctcgcctgcgcctgttcgacggtgagcccgaccgacgccgcttcggggaaggagaacacgatttgcggcacggtggcttcgtccaccggcttgggattgagtccggcgatggtctccgcgatgacgatgccttgctcaaaagcacgatgcgccagcgcgtgaccggccgtcacatcgcccaccgcccatacgcccggtttgtcggtgcggccgtacgcatccgtggcgacatgtccgtggtcgtcaatcgtcacgccccatgctgggtcggtgatcgggtcacgcccgatggcgacaagggcgatttcgccccagacgctttgttcgccgtcctggccttcgcacgtgtagtgcacggtggcaccaaggttcgcgccggtgtccacatgggtgacgctggcgcgggtgatgatgttcacgccatgacgtttgagctcacgggtcagcgtggtgccggctctccggtcccaggctgagagcacacggtccttgcgaatcagcaaggtcaccttcgaaccggcggcgttccacatcgaggcgaattcaagggcgatggccccggcgccgataatcaccgccgacgagggaaattcgttgacttccagcgcctgtgtggagtcgatgagggcgccggcgaacgggttgccgggcaatgggcgtggcttggcaccggtggcgatgacgatgttcgtggccgtgaggtccatcgtggggccgctgggctcggggacatcggccttgtgataggtgaggatgtcgctttggtcgggggaagggacgaggtggacgatgtggttggaagttgctggagcggtctcatccgcatggaacgcggcattggctcggaacacggtgatgccgcgatgggcaagcagtccggccagtcctcccaccatcgtcttgaccacgcgcaggcgatagtcgcgcagcgtgccgaagtcgatgccattcaccgaggcgttgacgccgagctcggccgcacggtgcacggtgtcgatggtgtgggtggcggtgatgagcgccttggaggggatgcagccacggttgagacatgtgccgcctacggtggcgtcacgctcgacgagtgccactttcatgccgagttcggcggcgcgcaaggccgtggaatagccgccggggccggccccgatgatgaccagatcaaactgttcgctcatgattgcctccttgatacatataagtatggctcccacgctagggagccatatgcggctatcgccgccacttcgcctaaaaacagtccactggactgttttctttacggctcagcccctcaacgaggggagccagagtatatatggacaatcagtccgccggccagtgaccgcgcttcgggtaacgcggcttgggaagcctccaacgacgcatctgaatcgaacggctccaagcgtaggagaaggagcgggagcccttggacacggaccgttcgccgtacttggcgatgagcttggccttgagcttgcgccacatcagccatacgtcgatgatcacggcaatcaggtaaccgtacataagcgccatcatgatgatggaagcccactggttctgcatcaaagaagtgacgaacatggaaacgatcagaatcgcgaaggccaccgggatgaaccattcaccaaggttgaaacgggcatccacataatcacggatgtagatacgccaaggcaagcgttccgccttgggcatgtggttgatatcgccattctgcatcgcctcgtactcggcgttctccttctcacgcagacgggctttggcggccttggcgctggccctgcggtccaccggaaccagcggacggataccggcggcctgagcctgcttcatcttcggggtaggacggccttttttctcagaaggattggcggccttcttcggggcctgctcaacaggagcctggacctcttcttttttcttaaacggattccatgtcatgctttgaggttacggtgacgttcagacacttgtacactggcgcagccattgcaatgacgccgctcacacatatatataaaggaggaccatcatgacaacgctcaccgctgacgagattcgttcgcgcgtcgaaaccgattggaaccgcatcgtcaaggtactggccgaaaaggtcgcgctgcagtcgatctccgccaagggcatcaccgccgaacaaatgaagcgctccgctgaattcgtggcagacgaactgcgcctcgtgggtgtggataccaaggtggttcaggcttccaatgccgacggcactccgggcgcatgggaggtcatcggctcgcatatcgtttctccggacgccctcaccgtgctgctctacgcccatcacgacgtgcagcctgttccggacccggccgagtggaacaccgacccgttcgtggccaccgaaattgacggccgcctctacggccgtggctccgccgatgacggcggcggtatcgccatccattccggtgcactgaaggccctgggcgacgacctcaacgtcaatatcaaagtgttcatcgaaggcgaagaggagatgggctcgccaagcttcattcccttcatcgaggctcaccgcgacgaattcgccgctgacgtgattatcgtggccgattccggcaactggtcggcggacattccttctttgaccacctcgctgcgcggcaacacctgtgtggacgtgaccgtgcagggccttgagcatccggtgcactccggccagtacggcggcccgattctcgactccaatacgttggccgccatgctcatcgcttccatgtatgacgagaacggcgatctggccgtacccggcgtggccgcggaagagccgatcggcggtttgcagcacgaccttgacgaaaccaccgtgcgcaaggattctggcgtggtggccggttacgagttcgccggcaccggttcactggcctcacgcctgtggaccaagccgtccgtgaccgtgatcggcttcgacgcccacccggtcgagggatccttcaacgtgatcgctccggagacccgcttccgtctgtcgctgcgcaccgcgcccacccagcgccctgaagaagcgcaggaagcactggctgcattcctcgaatcccacgcgccgttcggcgccaaggtcactgtcgaacgcggcgaaaacggcatgggctgggccatggacccgaccgccgtggccaccaaggacgcgctggaagccatgaccgaggccttcggcgttgagcccatcaacaagggcgaaggcggctccattccgttcatccccgaactgcagcgcattttccccaacgctcaggtgctggtcaccggtcccgaagacccgaaggccaacgcccacagccccaatgagtccatctccctgcccggcctcaagaacaacgtgatcaccgaggctttgctgctggacaagctcggcaagtagccgaaccgcatcggtaatggtagtgagccgccgtcaggtaggtcacagatgtggctattgcctttgacggcggcttgctttatagtcgggagttgacacgggagctgccgttgggcggctgagaggagactcatagtctcgaccgatggaacgtgaccggataatgccggcgcacggaaatgtcgctcttacctacccgtgcctgaaccaacccgcgcgtggccacgaacatatgcatcatgtgcgtacatatatccacgtatgttcggcctgcgtgcgagcagaagaaaggcacattcatgactgaagctgtggccaaagccaattacaagtggcgcgtcgtcgatatcgtcgtcgccgcaatcatcgccgtcgcatccggcgtcattttctggggctgggacattgtctgctccgccccgctggccctgtttgaaggcgtgacccccggtttcgagggtctgctcaacggattctggctgttcgccggcccgctcgctgcaatcattgtgcgcaagcccggtgccgcactgtttgccgaaaccctcgccgccttccttgagcttacgctgggcaaccagtggggcgtcggcggctcgctgatcgtcggcatcatccagggtctgggtgccgaaattgccttcgccgtcttcgcttggaagaagtggaacatcggcaccaccatcctgtccggtgcgctcgccggcgtgggctgctgggcctactactgggccaccaacccgggctggaacggcctgcgcgtcacttggtatctggtgggctccatcatctccggcgtcgtgatcgccggcgtggtggtctggtacttgtctcgtgcgctcgccgtcaccggggctctggagcgttttgaatccggccgcagcaaggcgcgcgtctgatgcagattaatccggctgcggtagaggccagcggctggggatggcggcacgccacgcgtaaggacttcgcgttgcgtgccgtcgatttcaccatccggccaggtgaacgtgtgttgctgctcggtgcttcgggcgcgggcaaaagcacgatgatggccggtctcgcaggcgtacttggcggcgatgaggaaggcgagcaggagggctcgctcaccatcgatggcgtcgatgcgcgcgaggcgcgaggtcgcgtgggactggtgcttcaggacccggactcgcagatcattcttgaacgactgggcgatgacgcggccttcggctgcgaaaacctcaacgtgccgcgcgaggagatttggcagcgagtgcgcgaatcattggatatggtgggactcggcggactcgaactggatcggtccacccgccatctgtccggcggtcagcgtcaacgtctcgcgttggccggcgtgctggctatgaagcccggtctgctgttgttggacgaaccgaccgccaacctcgatcccgaaggcgtggtcgaagtgcatgacgcggtcaaaaaggtcatcgaggccaccggacagaccatggttgtggtcgaacatcatatcgatgtatggctcgatctggtcgatcgcgtgattgtgctcggccgacccgatgcaagttcgcccacgggtgcggtcattgccgacggcaagccggacgaggtgttcgccgagatgggcgacgtgttggccgccggtggcgcgtgggtgccgggccgtgcgattcccgattactcaccgaagcaggagtctgcgcacgatgcgccggtgctcagcaccgagaacttaagctttggccgtggggccgctcttggcgttggtatcaatctggatttttatcccggcgaagtaacggctctgatgggtccgaacggcgcgggcaaatcgaccttggccttgaccttggccgggctactcaagcctatcgccggcaaggtgctcatcgccgacaacctcaagcccgcgcatgccgggcgtgagccgatcgactggaaaagcaaggaactgctgggccgtatcggcatggtgttccaggagcccgaacaccagttcgctgccaactttgtgcgtgacgaggtatccatcggccccaagtcgatggggcagagccaagacgaggcttatcagaccgccgaccgcatgcttgagcagatgaatctcacgcgcttcgccaaagccaacccgtacaccttgtctggcggggagaagcggcgactgtccgtggcctccatgctggccgccgcacccaaagtgttggtgatggacgagccgacattcggacaggatttcagtacgtggaatgaaatggtcaagctgatcgccgccatccgcgaccaaggctcgtgcgtgatcatggtgacgcacgatgaggcgctggtggatgcgctgggcgcacgacgcgtgatgttcgaggaggcgaaggcatgagtgacgtggtaaccgtcagcccgcaggaaacgcgcgtggagccggtcaaagcctcatcgccctcatggttcatcgcgcgcatcaacgcggtcagtcgcatcatcggtgcgttgctgctgtgcattccgatgttcatcagtctggatgtggtatccgcatccacggcgctcggcatcgaattcgtgctgctgtggattggtggcgtggctccgtggaccgtatgccgtaagacctggccggtatggatcgccgccgccggcagttttatctccgtgttcctctacggccgcacctcgggcgagatcctgtggcagggtggctggattgtgatcagcgaggggtccatcaatctggccatcgccacggctatcagggtggcggccattgccgtacccggcgtgattctggccttgggcctcgatcccactgatttggcggacggtctggttgagattctgcacttctcaccgcgattcgtatacggcggattggccggattgcgcatgtttacgctgctgcaggaagattggcgcgcactcggcttgtcccagcgttcgcgcggccttggtgacggtaacgccatcgcccgtgctctctcccaagcgttcggactgctggtgctctccatccggcgtgccaccaaacttgccaccgccatggaagcgcgcggcttcggctccggcgccccacgttcccaagcccgcatctcgcgtctgaagcctatcgactggatcttctacgtcatctgtctggccgtcccgctggcctccataggcgtagccgtcggcaccgggaattggcacttcgcctttcagggtgtctgaaaggcgacaggctggcacagtgcctttcagggtgtctgaaaggcgacagattagcacagtgcctttcaaggtgtctgaacgccttatgatgcccccgctggcgggggctgtcggcgtagccgactggggtggttccagcctcgaccaccctcagtctcgcgactgacgtaatgacccggcagtagggtagtggctatgcccatcaacgcccagattcttgataatccgaaatccgaccgcgtgcgccgcatcgccgatctgacccgcgccaaaggccgcgaacgttcgggccgttttcttatcgaaggcccgcaatccgtgcgcgaggccgtcacttggcggccggacgtggtgcaggacctgtatgtagaggtttcgcaggcgctggaacatccgcgtatcatctcctccacgttggagaagatcgtcgaaacctcgcaggatgccacgatttatgtgcactactgcaccggcgacgtgatgcgccgcatcagtccggacgcccaaggcatcgcggccgtcggcaatgccgagtccatgcacgccggagccgatgacgtcgaacttggcaagaacggtcgggccccgcagattgccgccttctggcaggtgcgcgacccgggcaacgccggcaccgtgatccgtgcggccgatgcggccggctgcgacgccgtaatcttcgtggacgactgcgtggacgtgctgaaccccaaggtcatccgctccaccgcaggctccctgttccatctgccggtactcgccatgagcaccgacgaattcttcacctggacaggcgaccataatatggacgtctgggccgccgacgtatacggcaccgaagaacgcaagccggaaagcctgcccgcagtactggcggacaaggcggcggtcgaggctccgaaagccgtgctgttcggcaatgaggcgcgtggcttggaaccggacatcctcacgcgctgcggccgcatcgtctccatcccgctttatggcaaggccgaatcgctgaacctcggcacctcggccgcggtgatgctgatgtcgctatctatgtcgggtcatgttgaaagaatgtgaaaccggtaaaaacgctgtgaaacgctgagaaaacatcagacgaaagggttctcgtggcagaacaaatggtgttcgacgccgaccaggtgaccgctgaggttgccgagggcatcgagaaaatccagaacgcctccaacctggaggagctcaaggccatcaagacaacgtacgcaggtgccgattcggcgatgaccaaggccagcaaggccattggctccctgcccgccgaccagaagaaggaagccggcaagctcatgggcaagctgcgcgccgacttcggccgcgcctatggtcccaaggaggtcgagctcaaggaagccgccgagaaggccgcgcttgccgccgaaaccgtggatatgacgctgccggtgagccgtaagcctctgggcgcccgtcacccgctgcctaagctgatggaggacgtcgaggacttcttcatctccatgggctggcagatctcctccggcccggaaatcgaagccgaatggtacaacttcgactccctgaatttcggcccggaccatccggcccgccagatgcaggacaccttctacgtcaagggcaatcaagccaaggacgccgccggtttcgtcggctccaacatggtggtgcgtacgcagacctcctccgatcaggtccgtgccctcctgacccgtggagtgccgctgtacatcgcgtccccgggccgcgtgttccgcaccgatgagctggacgccacccatactccggtgttccaccagtgcgaagccctcgccgtcgacaagcacctgaccatggccgacctgaagggcgtgctggacaagctcgccgtcgccatgttcggccctgaagccaagacgcgcctgcgcccgagctacttcccgttcactgagccgagcgccgaactcgacctgtggttccccgacaagaagggcggccccggctggctcgagtggggcggctgcggcatggtgaacccgaacgtgttgaagtccgccggcatcgacccggacgtctacaccggtttcgccttcggcgtcggcatggagcgcacgctcctgctgcgcagcgacatcaacgacatgcacgacctggtcgaaggtgacgtgcgtttcgccgaacagtttgtgatgggggagtgattcagccatgcctatgatcgatatcgattggctcaaggaccatgtcgaggttcccgaaggcctgacctacgaacagctcgccaaggaccttgtcaaggtgggtcttgaggaagaggagattcactcctctcaggtgaccggcccgattgtggtcggctacgtggtcgacgccacccccgaaccgcagaagaacggcaagaccatcaactggtgccacgtggactgcggcgacgaatggaacgagaccgacgaagacggcaacaaggtgccgcgcggcatcatctgcggcgcgcccaacatgaaggccggcgaaaaggtcgtcgtcaccctgcccggtgccgtgctgcccggcgacttcaagatcgaaccgcgcaagacctacggccacatctccaacggcatgtgtgcctccgaacgtgagctgggtctgggcgacaaccacaacggcatcatcctgctgcgtcagtacggcttctccgaggctgaatacgaggctctgaagcctggtcaggatgccatgcacctgctgcacctcgaccagcctctgcttgagatcaacatcaccccggaccgtggctacacgctgtcctaccgtggcgtggcccgcgagtaccaccactccaccggtgccgcctacaccgatccggccgtggcactcaacgagaaggccccggaacctgctgactaccagcccggcaccccggtggacatcgatgttgaaatcgacgataacaatccgattcacggcgtgcccggttgcgaccgctactacgcgcgtatcgtcaaggacttcaatcccaacgcccacacgcccaactggatgcgccgccgcctgattcgcgccggcatgcgctccatctccttggccgtggacgtgaccaactacgtgatgcttgacctcggccagccgatgcacgcctacgacctcgacaagctcgaaggcccgattgtcgtgcgccgcgccaacgagggtgagaaactcaccaccctggacggcaaggaacatgacctgagcgtcgaagatctgcttatcaccgattcgccgaacggcgaacgcggctcgcgcatcctcggccttgccggtgtgatgggcggtctgtatggcgaagtgaccgccgacaccaagaacattcttctggaggccgcgcacttcgatcaggtgaccattgcccgttcggcccgtcgccacaagattccatccgaggcctcccgtcgcttcgaacgtggcgtcgacaccgcgctgcagcctgccgccacccagatggccgccgagctcatggccaagtacggcaacggcgagcccagcgaacacccgaacgacgtgaacaacacgccgcgcgccaaggccatccacttcaaggcctccgaagtggcccgcgtagccggcctcgacgtggacatcaaccgcatctccgacatcctgaccgacattggctgcacggtggccggtggcggcaacggtgagttcgccgtaaccgcgccgagctggcgtccggacttgaacgagccgtgcgacctggtcgaggaggtcgcccgactggtcggctacgaccagattccgatcaccgtgccgccggcaccggtcgagggtctggtgggcctgaccccggaccagcagcgtcgccgtcgcgtggcggacgagctcgccgagttcggcatggtcgaatcgctgagctacccgttcgtgggtgacgacgattacaaggccttcggcttcgacccggaagccaccaagaaggtcagcgtcgagatcgccaacccgctctacggcgaccgtccgtacttgcgtcgcgagattctgccgaccctggccaccaccgtgcagcgcaacatccgccgcggcatcgaaaacgtgtccctgtacgagctcggccacgtctacctgtgggatccgaacgcgcccgccatcccggcactgcccggcggcgtgcgccccaccgacgaacagctcgccgcgcttgacgccggtctgcccgaacagcccgaccatgtggccggcatcctgaccggtctggccgaggacgacggctggatgggcggcaagcgcccggtcgactggtccgacgccgtcgaggccgtgcgccgcatcgccggccgtatcggtgccgcaatcgaactcgaccagcccgccgctgacgatgtgcccgtccaatggcaccccggccgcgccgcccgcgtcatggtgggcgacgtcttcaccggctgggttggtgaactgcatccgcgcgtcaacgaggcgctcggcttcccggcccattccgcggccttcgagctgaacctcaccgcgctgttcgccacgctgaccggcaagcccgtccaggccaagccgatctccacgttcccgccggtcaagcaggatttggccttcaccgtggacgagaccgtgaccgcaggccagcttgagaacgtgattcgcaaggccgccggcgcgaacctcgaatccatcgaactgttcgacgtgttcaccggcgaacaggtgggcgagggcaagaagtccctggcctatgcggtggtgttccgttcgccgagcaagacgctgtccgccgaagacagcgacgccatccgcaaggccatcgtggctgaggccgccgaaatcggcgcccagctgcgcgcctgacccaaccaatcatccgaatcgaggagcgccatgagccaaccggagcaggacaagccgaaatacgggcagtaccagcagcctgaatatggtgctatgtctggccaatacgggccgaattacaacccgtatatttatggcgctcccgagccggatactaagaaggattccgccgcagccgctggcgataacggtggcgcggcacaatctcagcaggctggccagccgtatggtcagcagccggcgtggcccggcaatcagcaggcgggcggctggccgtacgctcaaggcggccaacagtccggtccgggcgcatatccgggcgggtacccgggcatgcagggccagccgtatggtcaacagccgaacggtcagcctcaccagccgcattattaccacggcatcgacctgaacgatccaaaccagaacccactctacgggcactgggattcgtatgcgatcatctcctttatcctcgccctgttcttcccggtgccagtgctctcggcactgatgggcgcggtggcaatgtggcgcacgcgcactttccatatgaagggcttcggtttggccgtggccgccgtggtaatcaacgtgctgtacaccatcgccgtcatctggatggccttcaatggctatgacgccatgagcctttaccaggaagccctccagcaactgaccggcggcaccggctcctcctccgactccatctccgcataagtagcgttcacataccaacacacccactgcataaatatgcaatagtctgcataatcgcgtatactcatccgaagacacatcagtgaaaagagatgagtatggcgaaatatacagtggccgtggccggtgccacgggctatgccggcggtgaagcgctgcgcattctggccgcgcaccccgacttcgacatcacctgcgtggcaggccattcctcagtgggggagtcgatggccaagcacatgccgcatattccccaactggccaatctggtcgttgaagataccacgcccgaagtgctgaacgggcatgacgttatcatcctcgcactgccgcacggtgcttcgggcaagctcgcctcgcagctcgatccgaatgccgtggttgtggatttgggcgccgaccatcgcctcgaagaacaggccgcttgggatgagttctacggcggcgatttctatgagcattggacctacggcatgcccgagctcatcaccggcaaagctgcggacggctcctacacccgccagcgtgcggcgcttcctggcaccaagcgcatcgcaggtcctggctgcaacgtcaccgccaccacgctggccctccagcccggcatcgccgaaggactggttgaatcgcaggatatcgtggccgatctggtcgtcggatactcgggtgccggcaagaatctcaagcgcaccaacctgcttgccgccgaggccctgcaatccgccctgccgtattcggtgggcggcaagcaccgccacattcccgaaatcctgcagaacttcgcccacgcggccggcaagagcgcggccgaagccagcgaattcacgctcggcttcacaccgattctcgctcccatgtcccgaggtatcctcgccaccgtgtccgcccgcatgacggacaaggccaagacactgagcgatgaggagattcgcgccgtatggtccaaggcctatgaaggtcaggacttcatggtgctgctgcccgagggcacgctgcccgccaccggcaacatcatcggatccaacgcagcccacctgcaggtcgtcaccgaccgcaaggccggccgcatctacgcttttgccgccatcgacaacctcaaccgtggtaccgccggacaagcggtccaatcactgaacatcgcactaggcctgccggaagacgcgggcctgaccaagatcggagtagcaccgtgagcgttacatttgcacaaggtttctccgccgccggcgtggcggctggtatttcatccgtcgaaggcaagaaggacttggccctcgtggtcaacaacggcccgctcgacgcggctgcaggcgtgttcacctcgaaccgtttctgtgccgccccggtgcagtggagccgtaaggtcgtcgccgacggtcacgtcaaggccgtgattctgaactccggcggtgccaacgcctgcaccggcgaggccggttacgcccagtccgtcgccaccgcggaaacggtcgccgggctcatcggcgccgaaccgaatgatgtggctgtctgctccaccggtctcatcggtgaactgctgccgttggacaacgtgctggctggtgccaagagtgcccatgaggctcttgccgccaccgccgaagccggcaccgacgcctcccacgccatcatgaccaccgacaccaagccgaagacggtcgaactgaccggctccaacggctggaagatcggcggcatggtcaagggctcgggcatgattgccccgcagctggccaccatgctgtgcgtcatcaccaccgatgcggttgtctccgccggtcagatgcaggccgcactcgctgtggctgccgaacattcgttcaaccgcatcgacgtggacggctgcatgtccaccaacgacacggtcctgctgctcgcctccggtgcctctggcgtcgaaccggacaaggacgaattcaacaagctggtgcgtgaggcctgcgcatccctgtcccgccagatcatcggcgacggcgaaggtgcctcccacgacatccgtatcaccgtcaccggtgccaccagcgaagacgcggcacttgcctgtggtcgtgccgtcgccgcctcgaacctgctcaagtgcgccatctccggcaacgatccgaactggggccgcatcgtcagctccctgggcactgtgccgcctgaagtcgcgccttacgattcgaacaaggtgaccgtggacgtcaacggcgtgcgcatctgcgagaacggcggtgccggccgcgaccgtagcgaggtcgacatgaccccgcgcgaagtccacattgacatcgacctgaacaccggctcggacgccgaggccaccgtctggaccgacgatctcacccacgaatacgtccacatcaacgccgactacgaaagctgacaaacagcccagtgggctgtttgtagcagccggcagcgatagcgtcgccggcgtcgcagaaaagagaaaaattgtctacagaattgaagggacctgggttccatttcgacgtgcacaccgatttgcgcgccgatcagaaggcagaagtgcttattgaagcgctgccatggctggaggagttcgccggccagcgtatcgtcgtcaaatacggcggcaatgccatggtcgatgaccatctgaagcagtgcttcgccgaagacatggtctttctgcgtcaggtgggtctgcacccgatcgtcgtgcacggcggcggtccgcagatttcccacatgctcaaggccctcggcatcaaatccgaattcaaaggcggcctgagggtcaccacccccgaggccatggatgtggtgcgcatggttctgaccggcaaggtgtcacgcgaactggtaggcctgatcaacgcgcacggcccgctggccgtaggcatgtccggtgaagacggcggcctgttctcggccatgcagcgcaggcccgtcatcgatggcaagcccaccgatatcggcctggtcggcgacgtggtttccgtcgatgcctcggcagtcgaggatctggtggctgccggtcgtatcccggtcgtctcttccgtggctccgaacgaagaagatgccactgaagtgctcaacgtgaacgctgattccgccgccgccgctttggctgccgctgtgggcgcgcacaagctcgttatcttgactgatgtggatggtctgtacgccgattggccggataagaattctctgattggccggatcggtgtggaaaacctgcgcgatatgctgccggacctggaatccggtatgcgacccaagatggaggcctgtgtcagggccatcgacggtggcgtgccccaagcccatgtcatcgacgggcgcaagccgcattcgattttgaacgagatattcacctccgcaggcatcggtaccatggttatgcccgatgaaggactggaaatgaggagctcttatggctactgagcatgaggaaaaactaggtacggaagacagcaagtggctgggagagtactctcaggtccacatgaatgtgttcggtacgccgttgcgcgtcatggatcacggccaaggtgcccacatctgggatgttgacggtaacgaatacctcgatttcctggcaggcatcgccgtcaattccctcggatacgcccaccccaagtgggtcaaggcggttgccgatcaggctgccaaggtggctcatatcagcaactatttcgcgtccgagccgcaaattgagctggcatccaaactggtcaagctggctggtgcacctgaaggctccaaagtctacttcggcaactccggtgctgaaggcaatgaagctgccctcaagcttgccaagctgtatggccgcaccttgcctggtgccctgccttccatcggcggcaagcccgcacgcattctcgcaatgactcacggcttccatggccgtacgatgggtgcgctgtccgccacatggaaacccggtatccgcaagccgtatgatccgctggtgccgaacattgaattcgtacgcgccggcgacaaggtcgccctgcacgacgcttttgcacagaccggtctcggccgctatggcaagggtccggtggctgctgtgattctggaacttatccagggcgaagccggcgtacagccgttgggcgccgattacgtcaagttcgtgcacgaactgtgcgatatcaaccacgcgctgctcatcatcgatgaagtacagaccggtatcggacgtaccggcaagtggttcgcattccagcgtgacgatctgtccggcggcgtgacgccggatatggtgactttcgccaagggcgtggcaggcggattcccgatgggcggcatgatcgctttcggcgagaaacttgcggctctgttcactcctggttcccacggctccacctttgccggcaatccgctgggtgcggctgcgggactcgccactcttggcgtgattgaagacgagaatctggtggccaacgccgaagctcgcggcgaacagctgcgcgatggcattatggccaccggtaatccgctgttcgtttccgtacgcggtcgtggtttgctggacgccgtcgagctcaagcatccctgctcccacgcggtgatgaactactgcctcgaacacgggctcatcgtcaacgcggtggctcccaatgcgctgcgtttcgcaccgccgctgattataaccgcacaagacgtggatcaggcacttgccatcctcaaggatgtgcctacggacctgcccgacgactgatttctctccgtcactgccgccccaccgatccaaggagatcatcatgaccccagaacttcgccacatgctgcgtgacgacgacctcaaccatgaggaacagaagcaggtgctcgaacttgccatcaagttccaccacgaccgcttctacaagcagccgttcgccggtccgcaggccgtcgccgtactgttcgacaagccctccacccgcacccgttccagcttctccatcggcgttgccgagcttggcggttacccgctggtcatcgacaagtccggctcccagctgggccgtggcgagcccgtggccgataccgctcgtgtgctcgaccgcatggcttacggcgtggtgtggcgcaccttcggtcaggaccgcgtcgaagaaatggccaagtactccacccatccggtggtcaacgccctgaccgatgacttccatccctgccagattctcgccgacttccagaccatcgccgagcaccgaggcggcgtcgacaacctgaagaaccagaccatcgcctacctcggtgacgcggccaacaacatggccaactcctacctgctcggcggtgccgtggccggcatggacgtgcgcgtggccggcccccacggctacctgccccgcccggacatcgtggccgacgccaagcgcatcgcggccgagaccggcggctccatcctggtcaccaccgatgccaaggaagcggtgcaggacgccgactgcgtgttcaccgacacctgggtctccatgggcgaggaagccgaatacgccatccgttccaagccgttctgggattaccaggtcaacaccgaacttatggcattggccaagccggatgcgctcttccagcactgcctgcccgcctaccgcggcaaggaagtcaccgctgaagtgatcgacggcccgcagtccgtggtgtgggatgaggccgagaaccgtctgcacgcacagaaagcgttgctgacttggttgaccggcaaggcccgtggagacgaaagcctgctcgcatgagtgaaaccggtccgtccctgcagcgccctgccaccagggcggcgcggctgagtgccatagaacaggcgctcgccacgcatatcatcacctcgcaatcacagctgtccaaaatccttatcgacgagggcattgcggtgactcaggcgacgctgagccgcgaccttgacgagatgcacgcggtgaagacccggttgaaggacggtacggtggcctacgcggtgggtcgcagcgtcgttgcttcagaaggtgaggatgtaggggagcgcggtgaggcacagatgtcccgcgtgctgaacggactggtcacctcggtggccgccgccggaaatctggttgtggtgcacacgccttccggtgccgcacaatacgtggcctcggtgattgacaggcagccgatcgaaggcgtgctgggcaccatcgccggagacgacaccgtcatggtgatttgcaccaatgacgacaccgccgtctcccgctccgactggctactaagcctcgcctccaaatgaccaacacgccgtgcataaatatacagtcctctgtatatacttgcatcagtttgtttttcagaccttgaacgaaagggaaccaatggcagataacaagcgcattgttctggcctactccggcggtcttgacacatccgtcgccatctcgtacctgaaggagcgcaccggcaaggacgtcgtggccgtgtccctcgacgtcggccagggcggcgaaagcctcgagaccatcaagcagcgcgcccttgcctgcggagccgtcgaatcctacgtggtcgacgcccgtgacgagttcgccaacgaatattgcatgaaggccctcaaggccaacgccatgtacgaaggcgtctacccgctggtctccgccatctcccgtccgctgatctccaagcacctcgtgcgcgccgcccaccagttcggcgccgacaccatctcccacggttgcaccggcaagggcaacgaccaggttcgtttcgaggtctccatcgcctccatcgacccgacgctgaaggccatcagcccgattcgcgacctgtccctgacccgcgacgtcgagatcgcgttcgccaaggagcacaagttgccgatcacccagaccgagaagtccccgtactccatcgaccagaacgtatggggccgcgccattgagaccggcttccttgaggatccgtggaacggcccgaccaaggactgctactcctacaccgacgacccggccttcccgccggtcgaagatgaagtcgtcatcgagttcaaggaaggtgtgccggtcaagatcgatggacgtgacgtcaccccgctgcaggccatcgaagagatgaaccgccgcgccggagcccagggcatcggccgcatcgacctcatcgaggaccgcctggtcggcatcaagtcccgcgagctgtacgaggctccgggtgccgtggctctgatcaccgctcaccaggaactcgaaaactgctgcctcgaacgcgaacagcaccgcatcaagcgcgacatcgacaagcgctggggcgagctggtttacgatgcgcagtggttctccccggcaacccagtcgctcaacgccttcatcgaagacacccagaagtacgtgtccggtgagattcgcatggtcctgcacggtggccgcgccgtggtgaccggccgtcgttccgactcctcgctgtacgactacaagctcgccacctacgattccggcgataccttcgaccagaggtcctccaacggcttcatcgacatctatggcctgccgtcccgcgtggccgcagcccgcgacgtcaagttcggcaacggcatcgaggtcccgaagaacaccgtcgagtaatcatttactttggctcccctcgttgaggggtcgcgccgtaaagcaaacagcccagtgggctgtttgcaggtgaggtgcgaacgacagtgagccaacaatcagcagccgtcaggctgtccgtaattacaggacgctgtcgccgcagatgactgaggggagtacgagcaaagattatgctcgtgctcccctcgttttttttttgccgatgacggaagaagctcagtgctctccgtaatgagttcggcagacggctatttccaggttttgaacatcgttacccgtaatgcggtatacgatgcggttcttttcatcaatacgacgtgaccagtatccctgacattgccgccatggaatacgaacaacttgaatccaccggtatgtagcccaacgctgatagtctgacaagcagtctgatttgtttgcaatccatggtttcaaggagccttcatgactgagaacaacgaacatctggccctgtggggtggtcgctttacgtctggtccgtcgccggaattggcccgactgtccaagtccacgcagttcgactggcgcttggccgacgacgacatcgccggttcccgcgcccacgcccgtgctctcggccgtgcgggacttctgaccgccgacgagctgcagcgcatggaggatgcgctcgacacgctccagcgccacgttgacgatggctccttcgcccccatcgaagacgatgaggacgaggccaccgccctcgaacgcggtctgattgacattgccggcgatgaactcggcggcaagctcagggccggccgttcccgcaacgaccagatcgcctgcctgattcgcatgtggttgcgccgtcactcccgcgtaatcgccggactcctgcttgacctcgtcaacgccctgatcgagcagagcgaaaaggccggccgcaccgtgatgccgggccgcacccacatgcagcacgcccagcccgtgctgctcgcgcaccagctcatggcccacgcttggccgctgattcgcgacgtgcagcgactgatcgactgggacaagcgcatcaacgcctccccgtacggctccggcgcactggccggcaacacgctcggcctcgacccggaggccgtggcgcgtgagctcggcttctcccgcgtgaccgacaactccatcgatggcaccgccgcacgtgatctcgtggccgaattcgcgttcgtggccgccatgaccggcgtggacatctcccgcctgtccgaggagatcatcatctggaacacccaggagttcgccttcgtcaagctcgacgacggctattccaccggctcctccatcatgccgcagaagaagaacccggatatcgccgagctcgcccgcggcaagtccggccgactcatcggcgatctgaccggcctgctggccaccctgaagggcctgcccaccgcctacgctcgcgatctgcaggaagacaaggaggccgtgttcgaccaggtcgatacgctcgaagtgctgctgcccgccttcaccggcatggtcaggaccatgcacttcgacggcgaccgcctggaagaggaagctccgaccggcttcgcgctggccaccgacatcgccgaatggctcgtcaagaacggggtgccgttccgccacgcgcacgagctctctggtgcctgcgtcaagctcgccgaaggccgcggccaggaactgtgggatctgaccgacaatgacttcatcgagaccttcgccgcgttcctgccggccgacaaggctccgggagtacgcgaagtgctctccagccacggttcggtcgactcccgcaacggcaagggcggcaccgcttacggtcgcgtgcgcgagcagatcgccgacgccaaggccgaggtcgaagaactcaagctcttccccgcatccacgtcggatggctccgcctacaaagcccccggcacgttctagtcccaatgaagctccctctgatgagggagctctattttgttgttgtcactgcaacggcatacactgagaaaccgtaacgaacgggagccgtgaggctgagaggaagtcgccagacttcgaccggggaacttgacgcgggtcatgccgccgtaaggaatcgttgtcgcagatttgccgggttctccgatacagctttcattccgtttgcataattcagccgtgagacggtcgtgatggagccaatacatcacagcggtcgaacggtcgcatgattgggttcatgaatgggcgcaccacttaaggtacggttcgtttcgtgcacccttttttactatctgaaaggatattatgcaggtcaacggagagcaggtcacgctcgagacgccggtcagcgtcgccgattatctcgaagcgcacggattccgcgccgagcgtgtggccatcgaactcaatggtgagattatcccgcgcgataagcgtgccgacgccatgctcgacgaccagtgcgtcatggaaattgtgcagtttgtacagggtggatgaaaggaaaagctatgagcaatattaatccggttactgaagcatctgttgaggcgactccgctgccgccgcagcccgccgtcaccaatccggtcggcaccgccgcgccgattctcccggtggaagacaagccgctgaacctgggcggtcacgagttccagtcgcgattcattctgggctccggccgctacgacctgaacctcatcaaggctacggtcgaacatgcaggcacgcaaatcgtcaccatggcactgcgccgcgcgcagaccaccgagaacagcgtgctcgactacattcccgaaggcattacgctgctgcccaacacctccggtgcgcgcaacgccgaggaagccgtgcgtatcgcccgactggcacgcgaagtgtgccacaccgacttcgtcaaggtcgaaatcgaacacgagaccaagtacctcttgccggacaacgccgaaaccatccgagccaccgaaatgctggccaaggaaggcttcgtggtcatgccctacatgttcccggacccgattgcggcccgtcagctggaggaggccggtgccgctgccgttatgccgctcggttcgttgatcggctccaatatgggcctgcgcatgcgtgacttcatcgaaatcatcatcgccaacgcgcatgtgccggtcatcatcgacgctggtatcggccgtccgagccaggcctgcgatgcgatggagatgggtgcggatgcggtgatggcgtacacggccgttgcctctgctggcaatatcccgctgatggctgaggcgttcaagcacgccatcgatgctggtcgtgcggcgtatttgtctggccttggcaaagtgaccgagggacaggctgtgccgtccagcccgactacggggtatttgcactgacacttttattagctcccctctctgaggggagctggccgcgtagcggactgaggggagatggaaacatggagaaaacatggcattgactgatgaacaggtggagcggtacgcgcgccatctgattttgaagggtgtgggggtcaaagggcaaaagcggttgctggcctccagcgtgctcatcatcggagcgggcggtcttggttctccggccgccctgtatctggcggcggccggcgtcggccatatcggactggtggacggcgatgtggtggatatgagcaatctgcaacgccaaatcatccataccactgcacgtgtcggagcgcccaaagtggaatccgcggccacagccatccgcgcgctcaacccggatgtgacggttgatacctactacgagctcgtcgacgcgagcaacatcgccggcctcatcgaaccgtacgatctggtgatcgatgccaccgacaacttcgccgcaaaattcctcatcaatgacgcctgcgtgctggccggcaagccgtatatccatgccggcgtggtcggattcgccggtcaggtgatgaccgtcattcccggcgaaggcccctgctaccgctgcatcttccgcgacctgcccgccgccggtgagattccgacctgcaaggaagccggcgtactgggcgcggtggtcggcgtgatcggcagtctggaggcgactgaggccgtcaagctgattgccggcgtgggggagccgctcgtggctcgcatgctcactgtggatgccctgaccatgaatattcgacgggtcccactgccaaagcatgtgccggattgcccggtgtgcggtgagcagccgaccattactgctattgatccggccaactatattcagccggcctgcgcgatttagagctatgtggtgcccctccttgaggggtgccaagatcagaacgagaggggaagaacatgcctattgctttgcataatgcggtcgatgacgatgagagcagtgaagcatcgtaccgccgcatcacgccggcggaatttgccaagctcgacccgaatacggtcacgctgctcgacttgagggaaccagccgacttcgccgcccacccggtcgaaggtgccatcaatgcaccactcgaccctctggcccatgtgctcaaaaccgtgcccacagatcgaactgtcgtagtctattgtgctcaaggatggtggagcgaggaagtagctgaaatccttgccgatcgcggctacgatgtagcaagcctcgatggcggttttcaaggttatctcgactatcttgaaacccaccacgattaacggttcccgttgtcgttcttttggatgagtgtgcacggacatatttgtgccctacaatcggtcacggtattactcgatggattcttgaatatcgccgggtaatcgtaattcacaacaggggattgcactgaaccaacccaaaacgggaaggaccgaaaatcgtgggacatctgctcacccgaacgcagattcaacgcctggtcgccaagcacggccgtgaggtcatcgagcatcgccacatgcagatcgaacgctgctgctaccagcacggcaatgtcaccacgttcgaacattccgtgcgtgtcgcctgcctggctgtgtggatggccgaccgcgcacacctgtggtaccgcgtcgacctcaaatccctgattcgcgcggccctcctgcacgattacttcctgtacgactggcacgactgggataacggcgaacaccagtggcatggcttcacccatggccacgccgccctggtcaatgccctgaaggacttcaagctcaacgatatcgaacgcaacagcatcgagaaccacatgttcccgatgaccccggtgccgccgcgctatatcgaaggctatctggtcaccttggcggacaaatgctccgccaccgccgagaccttctcgttcgaccggttcaacaagcgcgcgttgcccgccgcgaagccttacgccgagatcgaagcccgtcgatgatcatcacactcgaacattatttcctctggtttctgttctacagtttcgtcggctggatgtacgagtccattctcgtctcctgccaacagcaccgcttggtcaaccgagggttcctcaacggcccgctgtgcccgatctacggcaccggcgcgatactcggcgtcgccattctcggcaacgtacataacccgatcatcatcttcctgatttcgatggtgggcgccacgatactcgaatacacaacctcgtgggtcatggagcagctgttccacgcccgctggtgggattactcgaacttccgcttcaacctccaaggccgcgtctgcctgctgggcgcgttgattttcggcctcggcggcgtgggcgtggtacttggttcgcagccatatgtcgagcgggtcacggatatgattccgctgccgatgctgcatacgctggtcacggtactggccctgatcaccatcatcgacttggcggtcacggttgcgggcatgctcgaattcgagcgggtgctcgattccgtctctcaggtggtgcaggatgtggcggcacgcgccggtggcacgtggcagtggggctccagtgcggtatccgacaggatgcgtgagctttcgcaggatacggttgagcgtctgcgctgggccgtcaatggcgtcatcaacgcacagcagaagcgtatgctcaagtccttcccgaagttccaggtgccggatcgtcaggacatcatcgactctttgcgcgaacttatgggcccgcgccgctagaataaggcgttttactgaatcgcgcggctcggctggtgtccggcactgtcgccatgttctgcgaaacttgactgtgcccaattgggcagtcttattcacaattcgatagggagaagcgacaagctatggctcacgtcaccgacttcaaggaagcgggtttcaacaccctgcttgaggaactggaatggcgcgggttgatttcccagtccacggaccgggatcgactcgcagaagcactgaacggcgagcccatcacctattattgtggcttcgatcccaccgctgcatcgttgcatatcggcaacctcgtgcagctcatcaacatgcgtcacctgcagcttgcgggccatcatccgatcgctttggtcggtggcgccaccggactcatcggcgacccgcgccagtccggcgaacgtacgcttaacccgaaggacgtggtggccggctgggccgatcgcctgaagaatcagatcggcggcattctggacaccgaaggcgcgaacgccgtacgtttcgtgtccaattacgattggaccgcctcgatgaccgtcatcgacttcctgcgtgacgtcggcaagaacttccgtctgggcaccatgctcgccaaggacacggtcgcccgccgcctgaactctgaggaaggcatctccttcaccgagttcagctaccaggtgctgcagggcaacgacttcctccacctgtttgacgaataccactgcacgctggaactcggcggctccgaccagtggggcaacctcacctccggcctggacctgatccacaaggtgcgcggtgtggacgtcaacgtgttcaccagcccgattatcaccgatgcttccggcaagaagttcggcaagtccgagggcaacgccgtctggctcgacgccacgatgctcagcccgtacaagttctaccagttctggatcaaccgcccggacgtggagatggaaagcctgctgaaggcgttcaccttcctgcccaaggccgaaatcgaacgactggtcgaggaatccaagaccaaccccggcaagcgcgaggcccagaagacccttgcctgggaggtcaccagcttcgtgcatggcgaggccgctacccaggctgccatcgatgcttccggtgcgctgttcggccgcggtggcaacctcgaagacatcgacgaggaaacgctggaatccgtgctcgacggtttcaaggtggtcgacgagaacggcgagcacgtcttccccgtctccaagcccggcgatcgcgtaatcgacgccgcccaggctgccggactgttcaagtccgcttccgaggcacgccgcgccatcaagtccggtggcgtgtatctcaacaacaaccgtatcgaggatgaggagcaggtgctggccgaagccgacttcctggcaggccgcttcgcgcttatccgtcgtggcaagaaggcgctcggcgccgtggaaaaccgttaatcaacaacgaattaaggaaaacaagtaatggcagaaggtaacgagcgttccggcaagtcttacggcggcggccataaggggtatggcgatcgccgaccgggcaaccgcggcggcaagggtttcaagccgcgcggcaagggcggtttcaagccgcgtcatgatggtgagggtttcaagccgcgtcgccgtgaggatggcgagggctacgcgccgcgccgtgacggtgatggcgagggccacggcggctaccgcaagtcgtacggcaagtccggcggcttccacaagggcggccgctccggcttcggcggcaagggcggttaccgcggcaatggtccgcgccgtgacggcgaaggcttcaagccgcgccgcgaaggcggctaccgttcccacgaaggcgagaacggcgagaatccgcgctaccagcaccgtgataacgatcgtcgtgatttccgccgcgatggtgagcgtcgcagcttccgccgcaacgacgaccgccgagatttccgtagggacgaccgtcgcgatggggaccgtcgtgacttccgtcgtgacaatgaccgtcgtgacttccgtcgcgatgaccgcagggataacgatcgtcgtgatttccgccgcgatggtgagcgtcgcaacttccgtcgcgacgacgatcgccgtgatggcgaccgccgcaacttccgcagggacgaccgccgcgatgatcgtcgtgacttccgccgtgacgatcgccgcgacaacaaccgtcgtgacggcgaattccgcgagttttcgcaggaagagaagcgccagtaccgtgaggagaagcgctctgaatacatgaggcgcccgcgccgtaactccgacggcacgatgagcttcccctcgcagaacccgtacaccgaccgtcgtcccgacgagcccaagatgcccaagggcatggaatggtcgatgctgtccaaggatgagcgcgaacgtctgcgcggcctgtccaaggagcacgcggagaacattggtctgcacatcctcgccgctttcgcgctggaggagagcgaccccgaacttgccttggagcacgccaagtgggtggcccgtcaggcctcccgcatcgacttcgcccgcgagacgcttgcgttcgtggcctaccgtcagggcgactacaagctggccctgcgtgagttccgcaccgcctaccgtatgaacggcttcctcgactacctgccgttcatcgctgactgcgagcgtggcgtcggagagccgaagaaggccgtggaactggcgctgtccgatgagggcaagcagctgcatggcgctcccaaggtcgagatgttcctggtgtacgccggtgcccttggcgatttggagatgtgggacaaggccattgaagtggttcacaccgtcggccgttcccaggggctgccgggtgagtaccgcatgcgtgccgtgcaggccgagcagtacttccttgaagaggccggccgcagcaaggaagccgagcagctcaacgacctgctggaccgtcttgaggaccagtatgccgacgaggagattgacgaaaacagcgacgacgtggtgatcgatcacgatctcgaagacatcaccgacgactccgacgtgctcgaaaagctcggcatcgatccggatgaggcgcagtacgccccggatccggagcaggaatacggcgatgaggatgacgaggctgaagacggtgatgccgagtctgatgaggccgacgagaccgagaccgattccgccaatgacgccgaggctgacgattccgccgaatccgccgactccgactccaccgaacccgaaaccgaaaccgaaaccgaggagtgaacggcgtaatgacccgtttcctcaaaggcaccgatcgcccgctcgccgaggcctatcagcttgcgctgctggacctcgacggcgtggtgtatcgcggcaagaatccggtcgaatacgcggccgattccattcgtgcggccgaagccgccggtatgaccatcgaatacaccacgaacaactcctcgcgcttccagcacgtggtggccgaccagctcaagggcttcggcttggacgtggagccgtggcaggtcatcacctcttcggtggtggccgcccgtatggtggccaaggcgttgcccgccggcgcgcgcgtacaggtattgggcgccgagcatttgcgcgatgaggtcacccgcaacggcctgaccatcgtggacggtcctcaggaccgcccgcaggccgtcattcagggctggtatccggatatgacttggcagatgatggccgatgccgcgttcgcggtcgaggccggagccacgtatttcgtgaccaaccgcgacctaacgattcctcgtgaactgggcatcgcccccggttgcggatcgatgattcgcgccgtgatcacggccaccggcgtcgaaccggtcgcctccgctggcaagccggaagcgtacatgtacgatgaggcccgcgaactgaacgccgccgaaggccacgatttggtgcccaaggaggcgtccatcgccattggcgaccgcctcgacaccgatatcgaggccggtaaccgcggcgactacgattcgctggcggtgctgaccggtgtcaccaacccgaccgaactgatgctggctccgtcacacctgaggcccacattcatcgcccctgatctgcgtgaactcggcgaagcccaaccggagccggtccgcgatgagagcggtacttgggaatgccgcaaggctagcgcttggtttgaaaacggccaggtacacgtcagcgaccccaccagtatggacggcctgcgcgccgccgtatgcgccgcatgggaagccgccgaccaaggcgcacagcttagcgaggccacggtaccggtgttcgccatcgaggcatagtcctatgcctacggatagcgaacatgcgccggtcaccgagcgataccccgaacttgcggatatcgatgaacaagacaacgaccgcaagcttgagacctatcgcaacgtgctggaatccttacaacacgagcttgataacagccgcagctagcagaggtgattcattctcccgccagcggaagatgacgtgaagtgctggatggtggctccatgccgagccaccccgttggtggatggtgggccgaaaggaagatatatgaccgagcagcatatcgatcccgcgactccacttgaccgacttgacatgatgctcgtggcttcgggactggtcgaatcgcgggccaaagcgcagcgactcatcaaggccgggcatgtgcgcgtggacggcgagaccatcaccaagccatcgttcatggtcaaagccgggcacagcgaactcgccgtggataagggcgacgactacgtctcccgaggcgcttacaaactcttgggcgcgttcgaaacctttgccggcaatggccttaccgggccggaaggcttggaatgtctggatatcggtgcctccaccggtggcttcaccgacgtactgttgcgcgggggagcggccaaagtcgtagcgctcgacgttgggcacggccagctcgacccgcgcatcgccaatgacgagcacgtcatcgaaatgagcggcgtcaacattcgcgaagtagaggccgacgacctgccttaccggccggcgatgatcgtttccgacgtctcctttatttccctgacctatgtgatcccggtaatcgcgcgcatcgcggctcccggtgcgcagattgtgttactggtcaaaccgcagttcgaggtcggccgggcaggactcggcaaaaacggcatcgttgaagatccggcattgcgggagcgggcattacacgacgtggtcgcctgtgctgaacagcacggacttgacgtggtggccactgccgatagtcccatcatcggcacccacggtaatgaggaatacctgctttacgctgtcttgagatgaatgcgttggcagtctccgttcaccagcagcacgctggaggtacggtcgatgcctagtgcggtggcacacgtggcgctttccaccgcactgccgttgcgtagcatggcggagtccgccgtcaaagtccggcattgcagatggttggcttcaaccgtgacggctgtgatatggcgaaccgtgctgccatcctcatacccatccatatcaaaacgggaaaacatcgtactgcggagtggatgaacttccagagccctgctgttgacgtcatgacccttcaacacgccgttcaagcggactgtctgaccgctaatatgacgggtgcctagggagccattgacggacagatttccggaacaaacgatatcgccgttgcatcgtagtttgccggtaaaggttatttcatcgcaaataatgtcgccgccgacttcgatgtcgccgctgccgctgatgctggatacgcgaatatcaccatcacaccgcacaatgccacttttgatgaccagtttgtccccttctataactgaggcctcgagggtgctggtcacaatcatggtgtgaaaatgcgcgccatcggcaagacgggaacgttggtccactcctatggtgccgtagactcctttgcctatcagcgtgcaattctgcgtatgcttgcccatgatgataaaactccccttattaatatggacgtacagctttatggcttattgccacaataatgagcgcatccatgttgagggggttatatcggtcacgatgtgagcagatagggggtatagcgagcgcagttaggggggctagccttggatgaagtggtcgatctgatcctgcttgcccatgaggatgagttcgtcgttgcgatgcatgaccagttccttggagccgtactggaactccttgcctggggccttgaggcccaccacggtcacgccgtatttgccgtgcacctgcacgtcctcgatgctgcggcctaccgcgtacaggggcgtgtggatcttgacgacggtgtacggcccgtcgatttcgatgtaatccagataattgccggccaccagatgacccacgcgcttgccggcatcggtctccgcattgatgatgtgacgggcgccgatgcgctgcagaatgcgcgcatgctcctgggacacggacttggtccacagatcggaaacgccggcgtccagcaggttgccggtgatgatcaccgaagcctcgatgctgtcgccgatggccacgacggccgtgtcgaactgggcggcgtcgatctgctcgatggccagcacatcggtcatgtcggcctgaatggtgggcagatgcgcggaccaacgggccacaagctccgggttcttgtccactgcgagcacatcctgacccatctggtcgagggtggcggccacggacccgccgaaacggcccaagccgatgaccagcacgcttttgttgccgctcggttttgctgccatgatgatggtcctctctatgtcagattgctgggcgccgattgaatggccgatcagccaacgataatgttttcctgcggataacgaataggttcgggagccatcggtcggctgatggagtaggcgatggtcaacgggccaagtcgtccgacaatcatctcggcggacagaataaacaggctggccggattgccggcgcttgccacgcccaccgaataaccgcccaacgagaaggccgagcaggcttcgaacacggcgtccacgaacgcgcagccggtggtgaacatcagcatcatcgcaccgaccataaccaacgcaaagcaggccgtggtcacggacacggcggtcatctgaatacggcgggggatacggcggcggaacacggtgacatcgcgatggccggtgaatgcggcgcggcaaatcaagagaatcaccgcgaacgtggtgacacggatgccgccagcggtggatgaggaacctgcgccgatgaacatgagtatgctcatgaacaccttggtctcattcgtgacttcgggcacccaggaaatatcgaaaccggcggagcggggcatgacggcggcgctcatcgcacggcgcatcttcatgccggggtcatctgcggggaacaggccggtattgctccactcgaccagcaggaaccaagccagtgaggtggccaccagcacagcggtggtcaccaaagtgagtttggtgtgcaatgtccaacgtttcgggctgagccgccggcgtgcgcactgcaccagattcagcaccacggggaagccgagcgttccgatgaatgcactgatgagaatcggcagccccacgccccaacggttcacatgcagaccagtggcatccggcgtgaaaccggtgttgttataggccgacaccgcgtagaacagcgcctgccacaaggtacgccccatattgccatggttcacgcggaacaggtcgggcagcagcagcacgaaggtcagcacctcggcgatgatggaggtgcccagcaccacggtgagcacgcctttgacctcggaaagcttcgtggtgcccagctcgttcgcggtgagcatacgctgggagaccttgagtctgcgggaaacgccaagagccaccatcgaggcgaaggtcatgactcccagaccgccgaactggatggagaacaggacgacgacctggccgaacatcgaccagtattcgccggtgttcaccaccggaatgccgcaggtggacagggccgagacggcggtgaagaacgcgatcgggaaattggtgaagatgatgtccgatgtggagatcggcagcagcagcaaaccggtgacgatgatgatcagtgcgccgaaatacaccatggacagacggcccgggtgcctgagcagacggtcggtgatgctgatacgtcgaatgcgcttggcggttttatcgcttttgtctcggctcagtacatcggctgaataccaccatgacagtcccttcgaggcctcctcattggcggaggattcgtcgaagtcattggccatgggtcctcaagctcctcaactgatactgctgtacggtcatacggcatgccatcgcgctgcgcacggcacgcgtacggtgattgcgcggctgtacgccattgtatgccgaagccttacgataatcgactctgtggaacgttgccggcgacgcgccacgaagcagcatttttcgaacacctgtacgactgatgacggtgtctgcggctagaataatgagcagtgcgaccgaatcgacaggaggatgccatggccaagcgcaacgcggtggtggtgacgcataccaggctcaggcagaccggaaccgtagtggccgaggcggtgagccagctgcgagtggccggtttcgaagtcaccatcatcgacaacaccgaggcccccgatttcggcgtgcagccgccgtgcgtatcggacgacaccgaaatcgtcgtggtcctgggcggcgacggcacgatactgcgcgccgccgaactcgtccactgcacccaggtgccgattctcggcgtgaacatggggcatgtcggcttcctggccgaattcgaaagcttccagatcgacgaggcgatccgccggatcgccacccacgactattcgatcgacgaacgcatgatcgcccatgtggacgtctggctgcccggcgccaccaagcccattgaggattgggcgctgaacgacatcacactggaacgcgccgaccggggcaagatggtcgaactgtccatccgcgtggacgatgtggagatgaactcgttcggcgcggacggcgtcatcgtctccacgcccaccggttccaccgcctacgccttctccgcgggcggtccggtcatgtggccgaacgtcaaggccctgcagttgattccgttggccgcgcacgccctgttcgccaggccgctgatcatcggctccggctcgaccttcaccatcgatattctggacgattccatgtccgaaggctggatttgctgcgatggacgccgtcagcgcgccctgccgcagggtacgcgcgtcatggtgcgcgaatcgcgcgataccttgcgcctcgcccgactctccggcgtgccgttcaccaaccgtctggtctccaagttcgatctgcccgtggtcggttggcgcgagcacgcgcgcaacgaggcctcgagccagtcgctgcatcacgggcacacgttcccggcggccgcgtatgcggctggcgttgccgttgccggtgacgctggcgtcgctggtaccgagcccgacaagccgggcgaacgtgacggcaaggcaggatcctgatgctcgaagaactcgatatccgcaatctggggccgattcgagaagccaccattgcgccggccgcaggcatgaccgccatcaccggtgagaccggtgccggcaaatccatgctgctctccgcgatccgactggtctccggcggggccgccgaatcctcgcgcgtctcggccggggcggacgaggcttgggcccaggcgattttcgcgctctcggatgatgccgtcgcatctgaacattccggcgacaccaacgatgccggttctggcgatgccgacagtgggttcaccggtgctgccgcggccgtggccaaggcccatgacgcgggcgtcgaccccgaagacggcgaactgttcctttcccgcaccgtacgcgcttccggacgttcgcgggctgtgctcggcggcaagtccgtaccgcgttcggtgctgggggccatcgccggcgaactggttaccattcatggccagaccgatcagctgaaaatcgcggcctcctcacggcaacgcgagtttctggaccgggtggccggagacgaagccgaactggccgcctaccgcaaggcgtgggatgcgctggccgccatggatgagcggctggaacgcctgcgctcgcaggaatcctctgcccgccaacaggccgactacctgcgcgaatccatcgaccgcatcaaccgaatcgacccgcagccggggaggatgaggagctgaaggcgcgccgcgaacgcatcgaaaacgcggccgacatcgcccaaggcgtgggttcggcgctgggcgcgctggatgcctcgcaggtggatgtggacgccgccgacggcgcttcggccgtggaactcatcaatcatgcggtgacctcgttgcgcgcgattcgcgtcggcggcacgttcgcagagcaggccgatcggcttgaatccatcaatgccgatttgggcgacgtggtgttcgccctgagccaggagctgggcgacgaaggcagcgtggaggatctggaccagatcaacggccgtatccacgagcttggcgacctcacccgtcggtggggccccaccttggccgacgtgctcgcttggcgggacaaggcggcgttcgatctggaggatctggacgcctcgccggaaaaggtcgccgaactcgaatccgaacggcagacgctgtacgatgcggccctcgccgccgccgacgtgctgagcgccgcgcgcgtggctgccgctgccgacttgggcgcgcgcgtcactgaagaactcggttcgctcgccatgctgggcgcctccttggaagtgcgcgtcacgccgcgagacaaggccgatgatccgctcggcccgtatggtcgcgacgatatcgcgttcctgtttacgccgttcgaggggtcgccgcagttgccgatgggcaaaagcgcttcgggcggtgaactgagccgactgatgctggccttggagctggtggccgccgacacgcgcggcggtgccgaccagaccttcatcttcgacgaggttgacgccggcgtgggtggcaaggccgcggtcgaactgggcaaacgtctggcacggctggcccgcagcgcgcaggtcatcgtcgtcacccacttggcgcaggtcgcctcgtgggcggacgcgcagttcgtggtcaccaaggagccgccggatgccgatgacgacgatttgggcgtggtcaccaccatcgccgaagtcagcggcgaaacccgcgtccatgaaatcgcccgcatgctctccggcagcgaatccgaagcctccctggaccacgcccgagaactcctatccgattctcggcttacgctcccgctggcgcgagctggcgccgcaggcgactgagggtggttgaagaagatggagattagcaaatgaccaaggccgccatattcgacctcgatggcaccctcctagactccatgggagtctgggaccaagtcgacatcgacttcctgaacaagcgcggaatcgaagtaccgcctgactacatgaccaaagtttccgccatgcaattccgccagatcgccgaatacaccatcgcacgcttcggccttacagacgcgcccgaagagctcatgcaggaatgggacgacatggccagcgtcgcctattccaccacggtcgaagccaaacccggcgcgcttgactatctgcgcgatctgaaagactccggtgtcaaactgggtgtcgccacctcgctgcccccgcgtctgcgtgagccggcgctacgccacgtcggcatgttcgatttgttcaacgatatcgtctccgtcgatgacgcgaacgacgtcggcaaggaccagcccgacgtctacctgctcgccgccaagcgcctgggtgctgcaccggccgactgcacagtgttcgaagacctgctggtcggcatgaagtcggccaaatcagtcggcatgaaggtctgggccatgcacgacgactcctccgcctccgactggcccgaaatctgccacctagccgacggtgtcctcttcgacttccacgacgccccgcgcgtgctgtgataaaaaagttacgcccccgctggcggggctgtcggcggaacggcgttgttcggcataggtacccctttccgaggccattgtaggcacggcccatgtttcgacactataagttggcgaggtgtttgttcaccgtttaactgttatgtaacacaccttgacagttaagcagaacagttatactgtgttgtataacagctaaacagctggggtgctagtcaaccacaaccgaaaggggcatagatgaaactgatcatctcatccgtgtccggtgagcccatctacgagcaaatcaaaacccaaatccgttcggcggtgctcggcggcgagctgaaggcgggcgaggccctgccttccctgagaaaactcgccaaggagttgcgcatctccgtactcaccgtcaccagggcgtacaacgaactggccgatgagggcgtggtgcagaacatccaaggcaaaggcactttcgtgatggacaagggcaacgaactgatgcaacgtcagctcgaaacccagattcgcgaaagcctggccgaggcaagccggggcgccaaagccgccggcattccgctggacgcattgggccacatgctcgaagaggaataccgcaaggaataacctcaagaaaggaccatggccatgaccgccatatccgaatccgacgcgatggcgttgcaggtcaccgacgtcaccaaacactatgattccggcttcacgctggacgacgtgaccttcgacctgcccaagggctacatcatgggactgatcggcccgaacggcgccggcaaatccaccctcatcaaactcatcctcaacatgatccaccgcgacgccggttcgattcacgtgctcggcctcgacaacatcgccgacgaggagcccgtcaaggaacaactcggcgtggtattcgactccagctacctgtgtgaacagtggcaagtcaagaacattgaacgtatcgtcgcgccactgtattcatcatgggacagtggatgctatcgcaagtatctggatactttcggccttggtggcgcacagaacggcaagaaacatatcaaggatctttcccgcggtatgcagatgaagctgatgctcgccatcgcattgagccatgacgccaaactgctgattctcgacgagccgaccagcggactcgatgtgcttgcccgcgacgaactcatggatatcctgcatgcctacattgaggatggcgaacattcggtactgttcagcacccatatcactgccgacctcgaacgtgccgctgacttcattacctacatcaccgatggccgtctctactacaccggtccgaaagacgagtttgaggaatcgttccgcctgattaagggcggtccagacgaactggcacaactgcctgcggacgtggtgctgggctcacatatgtatgccaccggattcgatgcgctggtccggtcagacaggctttatgctgttgcgtcggtggtttcggggcttgccgttgaatcggcttccattgatgacatcattcgcttgaccaatgcccatgattccaatcgtgacttgagcgggaggtgagcggtcatgggggcaatactgagggtgccgcggtctcggcaacatgcattgaccactgcattgcgcgtcgatatggcctacctgtgcgtcggcgtacagactgtgttctcgttgttgttggcaccgttgttctccgccatctttcaaggtgaagtttatggtgatggtttcggctatcgcatgggtgtcatcatgacggtattcacctgcgccatgtgggtgctcaccatggctgttgctgacctgcagaacggatatcggcttcgtggcattattccgtcttcaaggaagaaccaggtggccgcgcgatatgtggttggattggtgatttccgtattgtcggtagcgatgattgtgttgattgacgggttgcaagtgctggtcaatccgaattggtcattcgcgggcaatctgtgggcggcgccgttgggaggtttctgcaccgcgctgatgatcgcgcttatcgtgcccacgggttatctgtggaccaaactaggcggtcttcaagtcacgatgatggtgatttatgtcgttgtattggctggatccatactgctatctattttgcctgcttcggtgaccagaggattggcccatgccgcgaatgccgtcatcgcgcaacgattgtggctggttattgcggtattgacaacgacggttgtggcatatgggatctcgtatgtaattgcctctcgcatatttgcttcaagggagtggtgacgatgagctggaaatccgtagtaaagcaatgtcgattcgattgtgtcgggacgggtctgttcagcgtggcgaatatggtgtttctgctggttttcccggtgctgtctatcgtggtatcgctggtgatgatatcgacccatgtcgatgaacacgttgccagtggtctgatgggcggactcggaggtctggcatcggtgatggcatatatgagtgcattggggcctgctgcatccgaggaatctgcagggcacagtgccatgcgagggctgattcctgtttcacgcactgcgcaagttgtaggtcggtacctctttctgttggtggttggcctgctctgggctctggatgtggtgatatgcggtggcatcttcattatctttggcgatatagcagatatggggtggattggtgccttggcatcaggtgcctccatcttcgctttggctatcattcttgggtcggtgctgctggcctgtgcatgccggttcacattccgcaagatgatgatggcctttggcgcggtcatggttggcttgtatgccgtcattgcgctgctggctcgattgcctgtcgactggcaatggctattgctgaatattgccgatttcctgacgatctggtggcatacggcgcttgttctcgccgtgttgtgtctgctcgcattttttggctccatgcttatagccatccgcatctaccgagccaaagaactctagccgcgcatttgtccgaccgcgaatgaaaagagaccgacaggaatctgtcggtctctttccgttatcggtgtgttatcagtccaccagatccagagcgattggctggtgcggttgctgggaatcgctttcattggccgtgcggcgcgcgcggatggcggcggctgcgcgcttgacggtcttgataacttcctgcagcaccaccacgccgaaaccgaccgcgatgattttcagccacatgtcgatcggcagcggcacggtgcggaacatcgcgccgccgaattgcaccactagcacctgaagtgcgaacatcagcgcgaacacgccgatcatcaccttattgcgcagcagattggcgaacaggctggcgttgcccagctcgcggctgttgaaggcgttgaacagctggaataccacgaacagcgtgaacagaatggtcgactgctgttcggcggtgccgcccatgaagttcgtccagctttgcgccatgaacaccacggcgatgaacgcgccggagacgatgatgcgctccagcatgccgcgcgagacgatgccggcgtcacggcgggtgggcctgcggtccataagattgtcgcgaatcggctccataccgagcgtcagcgcgggcgggccatccatgatgatgttgacccacagcagctgcaatgcggtgaacggcgcggccagaccactgaacagcgaggcgagtaccacgaccaccgaagacaggttcacggtgagctggaactggatgaatcgctggaaattctcgtaaatgccacggccccagtgcacggccttgacaatggtggcaaaggaatcgtccagcatcacgatatcgctggcttccttggacacctcggtgccggcgatgcccatggcgatgcccacgtccgcgttcttgatggcgggcgcgtcgttgatgccgtcgccggtcaccgccaccacattgccctgggctttcagagcgttcaccacgcgcatcttgataaccggcgtgctgcgggcgatcacgcggatgcggccgatttcgcgggacagttcctcgtcgctcatttcctcgatctggcgcgcctcgacggcgatatgccgctcgtccagaatgccgagttcgttggcgatggccgtggcggtcacgatgttgtcgccggtgagcatcttgagctcgatgcccgccttgcggcagcgctccacggcaccgggcacatcctcgcgcaggggatccacgatggccacgaagccgtcgaacatcatgccggattccaagccggcgcggtcggcagcgtaatcgagagccgcagtgtcggcgtccttatcggaaatatggcggtgggcgaagccgagcactcggcaggactgcgcctggaacttcgcgatctcccgttcgatttcgccgcgcgtcttggcgtcgacggcgcacaggtcgagcatcttctccgggctgcctttggcgaacacggtaatgccgtcgccgtcacgcaccacagtggtcatgctcttggtctccgacgagaacggatacgtgtggagcaccgtcgcgcgctcgcggcgaatccggtagtcgagtccggccttgtgcgcggcgaccaacagtgcgcattcggtggggttgccgatgaattccggcatcgcgccggcctcggcttcggtggcgcccgggaaggtcacgtcggcggtgccgttgacgcagaagttctccagcagcatgcggttcctgatctgctcgggcttctccaaggcgcggcccggtgcattgtacgcctcgatcacggtcatgcggttctgggtcaatgtgccggttttgtccgagcagatcacgttgatgcagccgatggtctcgcacgccaccatcttcttgaccagcgcgttctgcttggacattttgatgatgttcaccgcgaggcacgcggccacgatggtcggcaggccttcgggcacggcggccacgatcagcgttatggaggtgatgaacgcctcggaaatcgtgtcgaacgaggcggtgccggaagccacgaaccgggccacctgaagcacgaacaccagtgcggccacaatcgagcccaccacggcgatcaccttgccgagcttcgcgagcttctcctgcagcggcgtcataccggtgttggcggcgcgcagttcgcgggcgatcttgccgaactcggtgtcgtcgcccacggcggtgaccacggcacggccattgccggcggtcacgaagcagccggaatagagcatgttcgtgcggtcggccaccggggtcttcgggtcggtgaacacggcgtcggtggctttggcactcggcacgctttcgccggtgagcgcggattcgtcggcggtcagatcgttcgattcgatgaggcgcgcatcggccggcagcttgtcgccggtgctgatctgcagcacatcgccgatggtgatgtctcgctgcgacaccagcgtgacctcgccatcgcgcaccacggtgacggtcgtgtcgtcattgatgtcgttcagcgcttcgaatgccttggcgctgcgaccctccatcaccacggtgattgtcacggacagggcgatggcgaagaagatgcccacgcattcgagaatgtcggcgtggccgccggccatggcgcgggtgatgttgacgcccagggtgatggccgccgcgatcataagcatgatgagcatcgggtcggcggccgtcttgacgatgcgggaaagcatcgattccggcttcggcttggtgaaggcgttgggaccgtactggttcaggttgtgcgcggcctgttcgctggtcaggccttgatgtgcatcggtgtccagcgtgctgatgactgctggcgcatcctgcatgaatggtgcgggcgtctgcccgttggccgtggtcatatgttcctctcgtttggttgacacaccgcactgaaacccgcgtaatatcactcgcgtaccgcgcaacatggcggcacgcagccaaacgaatcgttgacgaccatgtatcgcatactccgcggtacatgagtctcgtcatttaaggcaaagccagaccgtaacggaactgccgacggccacgatgttgacttgccacattgcggtttgggccgagcccttcgccgcaatgctgtctactccctcatgggactattcagttgcagaaacagaacctaacaaaccacatggattttcccgttcgccggcagcatggcgattcccgccttcctagaaaaaacaagcaacacgccattggctcgttgcaggtgaaaagccgcaagaaagccgcgcgtgacaaggctcggacatgcttgaacatgcctggaccttcgacttgtgacatcagaaaacaaaaaaccgatacatgctggtaaagcatgtatcggttaggaattgtcagttagtgccgtcagcggactatcacagcgcctgggcggccttctccacgtagccctccatgccgtcgatggccacgacgtccttgaaccgcacgtcggcggtctcaagaccacgcagggcggccggggcggtggtgccggtctcgtgggccagcacatccatgcactcgaagtcggtgccggtggcgtcgaagcccaatgcctcgttcaccacgcgcgggaacttgtaggggctggcggtggagagcagcacgcgcggggtcagcgggtcgcgcggcatctgctcaagcaggtagtagccgcaggcggtgtgcgggtcgatcacgtagtggttctcgtcccaacagtgcttgatggactcgcgtacctgatcctcatcggcccaaccggtgccgaagatctgacgaatcttggccagcagttcttccgggatctcgtacgtgccccacttgttgaggtcgttcatcagcatggagatcagacgggtgtcgccctcggacaagtagtacagcatgcgctccaggttggaggagatgaggatgtccatcgagggggagatggtctggaagaacgggcgctggcggttgtaggtaccggtggtcaggaagtcgaacagcacgttgttcttgtcggaagccaccacgaggtgcttgaccggcagaccgagcagcttggcatagtagccggcgaggatatcgccgaagttgccggtcgggaccacaaactcgacctcatcgccgacgttgatcacctggtcggcgagcagttgggcgtaagcggagaagtagtagacgacctgcggcaccagacggcccacgttgatggagttggcggaggaaagcaccacgtgcgaattgccggcgagacgctcggccagggcgcggtcgccgaagatgcgcttgaccgcggactgggcgtcgtcgaagttgccttccacggcggccacctgcacgttggagccggcctgcgtggtcatctgcagctcctggacctgggagaccttgccttccgggtagaagacggtgatcgcggtgcccggggcgtccgcgaagccggccagcgcggccttgccggtgtcgccggaggtggcggtgaggatcatgatcttctcgtccgcgtcgccatcggccggcgtggtgtgcgccatgaagcgcggcaggatctgcagcgccacgtccttgaacgcggaagtcgggccgttgaacagttcgagcacgtaatcgtcgcccaggggcttgagcggggtgatgcgctcgtcggaccactgttcgccgtaggcgtcggcgatgcactggcccagctcctcggccgtgaagtccggcagcagcgcgcccagcacctcggcggcgatttgctggtacgacttgcccggcagggaggccacgtccaccttggtcttgcccaacgcgtccgaaacgaacaggccgccgtcatcggcgatgcccttacgaatcgcctgcttggcggtcagcgaatcggtggtgctacgggtggaatggaaggtggttgtcacgatgaatccttctgcctgaaagggatgatgaatccacatcagtctagcgtgggccgtgggcagaagggccgtccgtctcgcataaccgaccggtcgcaccggcgaaaatcaccattgccatcgaacggggaccggccatatcatgaaacaggccggctgcaaacgggccatacggtaaggcgacaacggcgaatcaattgtcgcttataccaaagagcacccatgaccgcttcaccccttgcgcagaaggcaaccgatgctttcaacgcgccgatctgcgaaaccgatcctgagatcgccgaactgctggactccgaactgggccgccagcgcagtggccttgagatgatcgcctctgagaacttcgtgccgcgagcggtactgcaatgccagggctccgtgctgaccaacaaatacgccgaaggctaccccggccgtttctaccacgccgaggcgtacggcgtgaaccccgagaccttccgcaccgacccggagatcatccgccagcgcacgctcgacggtgccaagatccttgccgaacgactactggccgacgacgtcaaggccaacggcatctccgtgctgaccggcggcaccgatgtgcatctggtgatggtcgacctgcgcaacagcgagatggacggccagcagggcgaggatctgctcgccgcctgcggcatcaccatcaaccgcaacaccgtgcccttcgacccgcgcccggcctcggtggcctcgggcctgagaatcggcacgtccgccctggccacccgcggcttcggaccgaaggaatacgaggaggtggccgacatcatcggcaccgcgctcgccgccggcccgtccgccgacgtgaccgcgctgaaggcccgcgtcgacaagctcgccgaagacttcccgctctaccccgacctggaccagattcactgattttttgcggatgtacgcagctccctcatcagagggagccgcgcttatatccccggctatcttcggtgcaatatgggtcgaaacgggcaatgcggcccattgtgggttactcttgttttttatgagcgatgaattgagtcctgaggtgttcgacgcggtgtgccgccaggccgatcaggccgcacgcgcacaggagcgtcttgcacaggcaaataccgaagccaaaaacgaactgttgcttgccattgcggacgcgttggacgagcatgctgcggacatcgaagccgccaacgcgctggacatgctcgaatccaaggaaaacggcatggatgcgggcaagctcgaccgcctgctgttcgacgtgccgcgcgtggccgccgccgcccaaggcgtgcgccatgtggccaccctgcccgatccggtcggcgagatcgtgcgcggatacaacctgcccaacggtctgcgccttacccagacgcgcgtgccgatgggcgtcatcggcatgatctacgaggctcggccgaacgtcactgtggacgtggccagcctgtgcctcaagtccggcaatgccgcgttgctgcgaggcggccacgccgccgaacgcactaacgccgccacgttgggcgtcatcgccccggtgcttgaagcccacggtttcgaatccgcactggtgcaatccgtcgaccagtacgggcgcgccggcgccaccgccatgatggaggcgcgaggccatatcgacgtgctcgtgccgcgaggaggagcgggtctgatccaagccgtcgtgcgcaactccaaagtgccggtcatcgaaaccggtgccggcaacgtgcatatctatatcgacaagtccggtgatctcgccaaggccatcccgatcatcatcaacgccaaaacccagcgcgtgggcgtgtgcaacgccgccgaaaagctattggttcataaggatgtcgccgccgaattcctgccgcagatcgccgccgctctggccgaggcgaacgtcgtgctgcagaccgacaccacgtcgtacggcatcatctccggcgcggcaatcgagggccttgacctcaaccacgccgccgaagaggattgggacaccgaatacctggccctcaaaatgggcatcaaggtggtgtcggacctggacgcggccatcgaccacatcaacacgcattccacaggccacaccgaatccatcatcgccgaggattatgcggccatcgaggaattcaccaagcgcatcgactcggccgtggtcatggtcaacgcctccacccgcttcaccgacggcggcgtgttcggctttggtgccgagcttggcatctccacgcagaagatgcacgcacgcggtcccatgggattgcgggagatgaccaccaccaagtggatcggttacggaacaggacaggtgcgcgcatgaacgaggacggcaacatgaacattacggctgacacggcaaacaaggcaagcgaactgcggcccgacatcgacctcaacgatcccaagctcggcctgaagatcgcggccgaacggctcagcatcgtccgctacgtgttccttgtgcagatcgaggacggcatcgcctccgccgcccagcgtgcgtcgctcgaatacgcggacgccgtgctcatcggttggcccgagaccgattcgcccgaagtcgcggacctcgacgatgcccagctcaagatcgtgcgcgaacacatggagctcatggaaggctacatcggcaaatacagccagatggagcacgacggtgaccttgacggcatgaccgacacgctcatccgcatcaccgagcgtgtggccgaggtccgccgcctctaccagccggacttcccgctgcccaccttcgccgaaattcgtcgcgtggtccaggacgaatgggatgaagacatgggcaagatcgatcccagggaagacaatcccaccgccggcgaaatcgaagaggaaaccgaatcagccgatgacgccgccggcgagggcgaccaggcatgagtggtgttaccgacagccacaaaacggctgcgtcagttcagtccgaaaaatcagtggaatccgccgagcccgccgaaatcgttgccgtcacccaaggcgaaaccgaacggcgcatgtctgacctgtccgcgccggccggggccagcagccatggcaaaggcaggctttccgcacgcggcaactggcatacgcgcctgcgcgtcggcatcatgggcggcacgttcgacccgattcacaacggccacttggtcgccgcctccgaagtagcttgggtatacgacctcgatgaggtgattttcgtacccaccggccgacctgtgttcaagctggacaagcacgtcaccaacgccgaagatcggtatctgatgactgtgatcgccaccgcatccaaccccaaattcaccgtctcgcgtgtcgacatcgaccgtccgggcgtcacctacaccatcgacaccctgcgcgatatccgcgcccaacatcccgacgccgagctgttcttcatcaccggcgcagacgccgtggccgaaattatgcagtggaaggacgccgacctcatgtgggacctcgcccacttcgtggccgtcacgcgccccggctactccagtccggacggcgtgaccttgcccgaaggaaaggtcgatacgcttgagatcccggccttggccatctcttcgaccgatgtacgccgccgcgccgaacacgacgagccggtctggtatctggtgcctgacggcgtggtgcaatacatcggcaagcatggtctgtattcatacgaggactgacgattcgtacgaggactagtgtgcatttgtacgagggctggtgaggattagcgcgaatcagtgcgcatcaatcctcaccagtgcaaaggataagcagtcaggccagtcccatcttgattttcaatgccattacgcgagtcgccgccgccgtcactttcgaagcgaaagccggatcggacttcgcccgttcgttgaggccgtccacaattggctttacgtaatccgtctgaccgatgcaggacatgtcgccgcccgcctcgacaagctttactcccaattggcttacatcgtagctgcttaacgcttcggcagacatcgaatccgaaatcaccacgcccgtgtacttcagggcgttgcgaatatgaccgtcgataatcgtagaagaaaacaccgccggattattcgggtcgatggattgatatgtggccaacgacatcatcaacattgcaggatcggccttggtaatcgcctggtcaaaggcacctgcctcggccccgtccaacgtggtggtcgtatccagaatgccttcggtggtgaagtcggtattgccgcttaccgcgcccaacccaggataatgtttgaccgccgcaccgacttgagcgtctcgcaaaccttcaataacggcgatgccatgttcggcgttgccggccgcatccaatccgaaatcacgatccagcgcgccaatcggagcatttgaggcacgattgccaaccactgtgccaagcaccggtgccaaatcgacatttatgccagcagcagctaattgcgaaccccacgtgcctgccgattggcgcaatgcgtcagcggacattgtgccctgctcaacggcactgggcattgtgtcgaaaccggtaccagtcagatgctgtacctgaccaccctcctgatcggtggcgatgatgagacgattgccggccggcgcatatccttggagttgcgcggtcgcggtcttgaccgtatcgacgccggtattccaattgccaatgagaatggccgagccaatgtgttcgtcggcgattgttgaagccaacgaggagggttcggaaccggcgaacaacggcaccatcactaactgtcccacacgttcctcaagcgtcatggcggataccgcacgttgggcttgtgccgccggatcgtcgttcttcttcggggaaggaacgtcggtgcgcggtaacgcactcgtctgggaggtctggggagtggtggtgttgccgtttgatgtggatttggcgaaccatccgacatgccatccgtagactgccacaccggccaacaccaccgccaaagcacatattgccgccacgattggaatgctcctgtgccgaagttggcgtgtggcgtgtgctgagggacgcatatgttgtggccgttgtctgttcatagcggcaagcgtagaacagagcgtagaacaggatgttgcctcattctgtgctcagggcataaccgacctcccgccctttcgataggcttgagttatgtcttttaacgatcctttctcagtactgttcggcaatggcggcgattcacgacgcaacaatgcgaacaatgacgatccgatcatcctcgatgtcgaggccgatggggacggtccggcccacaacaccaacgctggcccctccgggtcatcccgccctccacgtggtccggccaatccgcgtatcacccgtaagccagcgtccggtggctcaggagccagccgtggcagcaagattctgatcggcgtggtgctggccttggccatcatcgtcggtctgttcttcggcctgtcccgattcatcaccgatctgatgtggtacggccagctcggcttccagtccgtggtctggacccagctcggggtgaaaatcggtctgtgggtggcctacgcgctgctcatggccctgaccggcttcgtttccgcctggctggccattcgagcacgccctgattcggccgacggttccaccattcgcattaacggcgatgtggtcgaggtcggcaaatccgtcagctcgaaaaccgctcgccgcgtggccgtggtgatttcgctgatcgtcggcgtcatcttcggttcccagtttaacgcgaactggagcgagattctgctcatgttcaacgcgcagtcgttcggcaccaccgatccgcagttcggtctggacaacggcttctacgtgttcgtgctgccgggcctgaagctcgtgctcgccgccgtggccatgctgctgggcgtgggccttgtgttttccgtggtcacgcatgtgctgatgggcggtatccgcattaccatgccggttaacggacgcggcctgttctccattaccaagcgttgccgtcgccagcttggcatctggctgatgctcaacatgttcgcttgggcagtgcgccagatgattggcgtcttcgaccagctcaccgtgcagggttcacgcatcaccggtgcctcctacaccgccgtacatgccaacatccccgtcaccttcatcatggccgtgctgaccgccatcctcggcgtggtgctgggcatctggctcatgcgctcccacacgctcgaaggccaggcgtccatcggcgtgcgcgcttccgccgcgctcaaggcctggcgtgtgccggtgacctccattgccgtcgtggtcgtggtgggtcttgtgctcaccgtggcatggccggtgctgttgcaacgcttccgcgtcaacccgaacgcacaggagatggaatccacctacatccagcgcaacatcgacgccacccgcgccgcctacggtcttgacaagctcaagaccgagcaatacaaggtgaccgacaagggtgagcagggcgctctggccaaggaggccgacaccaccgcgcagatccgtctgctcgacccgcaggtcgtcagccccacgttcaaacagttgcagcagtccaagcagtactacaccttcgccgacaccctggcggtcgacaagtacgagattgacggcgtctcccaggacaccgtgattgccgcccgcgagctcgatctggccggcaatgacaaccgcaactgggtcaatgaccacaccgtgtacacccacggttacggcgtggtggccgcctacggcaacaaggtgacctccgacggccagcccgaattcttcgaatccggcatccccacccagggcaagctcaccgaatccgaaaagtacgagcctcgcatctacttctcgccgaacaccaccgaatactcgattgtcggtgcccctgaaggcacgcaggcttgggagttcgactacccgaccggttcggaaggtgctctgaccacgttcaagggcgacggcggcccttcggtcggcaacctgttctccaggattctctacgcgatccgcttcggctccgatcagattctcttctccgaccgtgtgaccagcgaatcgcagattctctacgatcgttcccccaaggagcgcgtggccaaggtggcaccgtacctgacgcttgacggccgcgtgtatccggccgtggtcgatggccgcgtcaagtggatcgtcgacggctacaccacctccgacgcctacccgtactcgcaaataaccgacctcggctccgccaccaaggattccaccaccgtctcttccgcaacggtctcgtccctgggctctcagaaggccaactacatccgcaactcggtcaaggccaccgtggacgcctacgacggttccgtggacctgtacgtgtgggatcaatccgatccggtgatcaaggcatgggagaagatcttccctggccagtaccaccagctctccgatatctccggcgacctgatgagccacatgcgctacccggaaagcctgttcaaggtacagcgcgagctgctctccaagtaccacgtgacctctgccagccagtactactcaggcgaagacttctggcagacgccggtcgatccgaccgaatcccagtcccagcaggaccaggacatcctgcagccgccgtactacctgaccttgcagaccggtggcaccgaggaaccggtgttctcgctgacctccacctacattccggctggccagtccacccgtgagatcctgaccggcttcctgtcggtcgactcggatgccggcaatgagaagggcaagataggctcgaactacggcaccatccgattgcaggagctgcccaaggattcgaacgtaccgggccccggccaggcgcagaacaacttcaacgccaacgccgatgtatccaaggaactgaacctgctgcaatccggcgacacgcaagtggtgcgcggcaacctgctcaccctgccgctcggtggcggactggtgtacgtgcagcccgtgtacgtcaagtcttcgggtgcgacttcattcccgctgctcaagaagacgctggtcgcgttcggtgatcaggtaggatttgcggatacgttggatgaggccttggatcaggtgttcggtggtgattccggcgcggccgcaggcgatgccgagaacgtgtccggtgacggatcgtctggtgaccagtcgtccggcatatccggtgaccaatctggttccgataccaatggtggccagtccggcaccacggacggcaagtcggattccggctcgtcttccgaccgtagccccgaactccagcaggcgctgaacgatgccgcccaagccatgaaggacagccagtccgccatgaagaacggcgactggaccgcctacggcaaggcgcagaaggagcttgaagacgccctcaacaaggccatcgagctcgacaagtagttccgacaggaattggctcccctcagggtgaggggagccatcgccgaaggcgactgaagggagtcggttacctcaactgacatagcccgtccttatcataaggacgggctatttgcgtattcaaaggaacctcatgccatacaccttccgtccggccgtcgaatccgacgtccaagccatcgccgacatctacaacgcctcagtgatggccggcggtgcgaccgccgacctcaccccgcgcaccttcgaccaacgccgcgcctgggtcgaatcccatacgccgccctacggcgtttttgttgtggaatcggaagacggttcaatcattggcttcggtgcgctctccgtgttctatgaccgcgcaggatatgacggtgtcaccgatttggcctattacatcgatccggcatggcaaggcaggggagtaggcacgttcatgcttgacaggctgctcaccgaggcgctggcccgccacatgcgcaaggcctgcggcatcattttcgccgataacgccggctccattgccctcatgcaccgcttcggcttcacccaattcggactcatgcccgccgctgccaccgactctaccggcaccatgcgggacatgtcctactggtatttggacctgcagccttgcagtaagtcatttcagtcaagaaaagtgtgaggatgccggagcaaacgagcttgacggcggcgttgagtacaatcttgacggttggatccggccgggcatgggccagtgcgcgaggcgaacgcgcgcatgacgtacggaacgtacagaacgtgcatacgggaataaaggaagacggacgaggagcggattatggcatcggatttctggctgattgcgggactgggcaaccccggcaaaaaatatgaggacacgcggcacaacatgggcttcatggccgccgacgtgctcgccgaacgttggacggtgaacttcgccgatcacaagggcttggccatgctcggtaaaagcgtgatgaacctggacggccgcaccgtcaagttctttctggccaagccgctgacttatatgaatgattccggcaatgcggtggcttccattagcgcctattaccagatcgagcccgaccatattgtggtgattcacgatgacatggacttggaattcggccgtatcaaggtcaaggcaggcggctccgcaggcggccacaacggcatcaagtcgattgaccgttccctcggcacgccgaaatacgcgcgtgtgcgcatgggcgtcggtcactccaagcgcggtgcgaacgcgcatgacaacacggtgaactgggtgctgggcggattcggtccggaccagcgcaagcagctgcccgaattcctggctgacggcgccgacgccgccgaggacatcatcttccacggtcttgccaagacccaggagaagttcaatggccggtgaggcgacgcacccggacctgatcaacggctcactggcaggcatcctgtctgagctggaacaggacaagaccttcctgaagctcgccgccggcgacatcgaggcttcggacgacgtcgacaactccgtcctggccggcatccccgaaggcttgcgcccggctttggccgccgccatcgggcagggtgtggccggcaaacccggcaagccggtcgtgctggtcgtggcctccggccgcgaagccgaagagaccgtgggctcgctgcgctcctggtatgatggcgacccgaacgacatcgcccagctcgaagcctgggaaaccctgccgcacgagcgtctgagcccgcgcgcggacaccgtggccagccgcatggccgtgttccgcagactcaagcatccgagcgataccgattcgatgttcggcccgattcgcattctcgtcatgccgatccgctcgctcatccagccagtcgtccaaggactgggcgatgtcgagccgctcgtgttcaccgtgggggaggacctgcccctcgacgaagccgccaaacgtctgatcgaaaacgcctacacgcgcgtggacctggtcatggaccgtggcgagttcgcggtgcgcggaggcattcttgacgtattcccgcccaccgcaccgcacccggtgcgtatcgaattcttcggcgacgaaattgacaccatcaaggaattccacgcctccgaccagcgtacctacggcgacggcctcaagaccatctgggccaccgcatgccgtgaactgcagctgaccgacgccgtgcgcacccgcgccaaagccttggtcggttcgattcccaatgctgaggacatgctcgaatccatcgccaacgccattccggtcgaaggcatggaatccctgatgcccgcactcgtggaccatctggaaccggtgggctccatgcttcccaagcacgccgtgatcctcctgagcgacccggagaaactgcgccgctccgccgaagacttggcaaaaaccgcgaacgagttcctggccgcaagctggcatgtggccgcctccggccacggcgccggcgcgcccatcagcttcgacgaagccagcttcctcgactatgcggaaaccatcagctccctcgaatactccgaacatccggtgattcgcctcaccagtttcggcgtggacaccacgttgaccggccatgtgcagctcgacgcccagaacccggccgaattccgaggggatgaggccaaggcctcccaaggcatcgaaggcctgctcgatgccggcttccacgtcaccatcaccgccgctgcggccggcaccttggccaggctcaagcgtgcgatcaacactaccggcatcgccaatttcgacgtcatccgctctcaggccatcgacggcttcgtggacaaagccgccaaaatcgccctgctcaccgaacgcgacctgaccggccgcacttcagccgtggccgtggccaaaacgccgaaacgccggcgcaaggccatcgacttggtggagctcaaaaaaggcgattacgtggtgcacgagcagcacggcattggccggttcatcgaaatgcgtcagcgcaccatcggcaccggcgccaacaaaaccactcgcgaatacctggtcatcgaatatgcgccttccaagcgcggcgccccggcggacaaactgttcatccccaccgaccagctcgaccaggtcagcaaatacatcggcgccgaagcccccaagctcaacaagctcggcggctccgactgggcggccaccaaggccaaggcccgcaagcacgtccacgagatcgccgacgacctgatcaagctgtactccgcccgccagcgcgccaagggcttcgcgttcagcccggacaccccatggcagaaagagctggaagacgccttcccctatcaggaaaccgccgaccagctcaccaccatcgacgaagttaaatccgacatggaaaagcccgtgccgatggaccgcctcatctgcggcgacgtgggcttcggcaaaaccgaaatcgcactgcgtgccgccttcaaggccgtgcaggacggcaagcaggtggccgtgctcgtgcccaccacgctgcttgtccagcagcattacgagacgttcagcgaacgattcgagggtttcccggtcaatgtggcggccatgagccgattccagaccaccaaagagatcaacgaggccatcgaggggctggaaaccggcacggtggacgtggtcatcggcacgcacaagctgctgaacccgaaaatcaagttcaaggatctgggactcgtcatcatcgatgaggagcagcgtttcggcgtggaacacaaggagacgctgaaagccctgcgcaccaacgtggacgtgctgtccctgtctgccacgcctatcccgcgcacgctggaaatggccgtgaccggcattcgcgagatgtccacgctcgccaccccgcccgaagaccggttgccggtgctgacctatgtgggcgcctacgaggatgcgcaggtcaccgcagccgtacgccgcgaactgctgcgaggcggccaggtgttctatgtccacaatcgtgtgcaggacatctcgtccatcgccgacaagatccacacgctggtgcccgaggcgcacgtcggcatcgcccacggcaagatgggggagaagcagctcgaccagatcatccgcgacttctggcatcgcgacatcgacgtgctcgtgtgtaccacaatcatcgagaccggtcttgatatctccaatgcgaacacgctgatcgtcgaccatgccgaccgtttcggcttgagccagctccatcagctgcgtggccgcgtcggtcgcggccgcgagcgcgcgtacgcctacttcttgtacgacccgtccaagccgatgaccgagcagtcccatgaccggctcgccaccatcgcgcagaacacggcgctcggctccggtttcgatgtggccatgaaggacttggaattgcgcggcaccggtaaccttctgggcgacgagcagtccggccatatcgagggcgtgggcttcgacctgtacgtacgcatggtgtccgaagccgtggaaaagtacaaggagcccgaagaggacgtcgagccggtggccgtgtccatcgacctgcccatcgaagcgtcgattccgatcgagtacatcgattcggacaagctgcgtctggaagcgtaccgcaagctcgcctccgcccgcaacgaggccgatctgaaggatttggaagaggaacttaccgaccgttacggcaagccgccggtcgaattcgagaccctgttcgacgtggcccgtctgaagttcaaggcccgcaagctcggcatttcggagattctcgcgcaatccaaccgcgtgcgcatcggtcgcatcgacccgcccgaatccatccagatgcgtatgggccgtatttacaaaggcacccaataccgtccggtcacccaccagctcatcgtccccaccccgttcaccggctccctgggccaaggccccatgagctccgaccaggtagtcctctggaccaaccagttacttgatgatttggcatggaccccgtcgtcaagcaaacggcagagccgtttgtagacggggtgcgaggcggcagtcgagccagctatggctcaccgggcaacatccggtgagccatattcatattcatgccgtcgtttgtgacgatgattcaccccagacggaatcgttccgactgtccagcgagcgagattaagtgactgctatgagcgaaacgactacgaaccgcacgaaccagagcgcgaccacggcaacacttgccggctatgagattccccgcctcggcatgggcacgatggcgctcgccatcgaggggcgcccctccaaccgtaatcaggcaatcgagaccatccatgccgcgctcgatgccggagtccgttatttggacacggcttggtcctattatctgcccagcgcacccggcaccggcgaaccggaggatatgggctatggcgaatatctggtccgcgatgctctgcactcgtggcatggccccaaagatcaggtgctcgtagccaccaaaaccggctggctgcgcacgcttgacggcaacggcaactacggctggcaggccgacgcccgacctgaaaccatgatcgccaatgccaaggaatcagcccgccgcctcggtgtcgatacgctcgatctgctctactcgcactgcaacgatccgcaggtgccgtacgaagaccagatgggcgcactcaagcagctcgtggacgaaggtgtggccaaagctgtcggcatctccagaatcgacaacgcggacatcgaaaccgcccacaatattttgggagatcgtctcgtggccgtccagaaccagttctccccggtccaccgcgaccctgagcacacgttggaaacctgcgaaaagctcggtttggcttttgtctgctggtcgccgctcggtggattccttgacccgttcaacgagcatctgttcgaccggttccgcgaagtcgccaagattcacgactgctcctaccagcgcgtcacgctcgcgtgggaacttgcgcaataccaatatctgttcacgattccctcggccagaaacccgcaggagattcaggactcgttcaaagccagcgaactgaaattgtccgacagtgaaatcggctacctcaatggcaaggatgttgactgagcgatttcgtccgtactgccttgcaatcaggcggcacactggcattgtgagcgctaacgctaaattttgggcgtgttgttcacaacgtccacaaatcgcactattcttaagaatgtcattcaagatacacaaccgttttaaggagtagttgtggcagtaattgaaagcgtgtacgcgcgtcagattctcgattcccgcggcaacccgaccgttcaggtcgttctggacaccgaagacggcgcccagggcctgggcctggttccgtccggcgcctccaccggtgaggccgaggcttgggagcgtcgcgacggcgacaagtccgtctacggcggcaagggcgttcttaacgcggtcaaggccgtgaacgaggtcatcgctccgaaggtcatcggcatggacgctgctgaccagcgcgctctggacgacctgatgatcgagctcgacggcaccccgaacaagggcaagctgggcgccaacgccatcctgggcgtctccctggctgctctgtacgcttccgccgagtccgccggcctgccgctgtaccgctacatcggcggcaccaacggccacatcctgccggtcccgaacatgaacatcatgaacggtggcgctcacgctgacttcgccaccgacattcaggagtacatgatctccccgtacggcttcgacacctactccgaggctctgcgcgctggcgttgaggtctaccacaccctgaagaacgtcctgaagaaggaaggcctgaacaccggcctcggcgacgagggcggcttcgccccgaagatgaagtccaacgaggactccctcaagtacatcatggacgccatctccgccgccggctacgagcctggcaagcagatcggcatctgcctggatgtcgcctcctccgagttctacaacaaggagaccggcaagtaccgcttcgacggtgaagagcgtgactccgcctacatgctcgactactacgagaacctcatcaacgagtacccgatcgtctccatcgaggacccgttcaacgaggaaggctgggaagactgggctgccatcaccgctcgcctcggcgatcgtctgcagttcgtcggcgacgacctgctggtcaccaacccggctcgtctgcagaaggccatcgacctcggcgccgccaactccctgctggtcaagctgaaccagatcggttccgtcactgagaccctcgacgccatcgaactggccaccgccaacggctacacctccatggtttcccaccgctccggcgagaccccggacaccaccatctccgacctggctgttgctaagaacacccgccagatcaagaccggtgccccggcccgtggcgagcgcgttgccaagtacaaccgcctgctcgagatcgaggaggagctcggctccaccgctcagtacgccggctacagcgccttcaaggcctgcaagaagtacctggccaagtgagctgaaacgcccgtaaaggcgtgagtttccactgaagctcgatacccgtcgtattcgtcaagtcgaatgcggcgggtattttcgtgtgacatgagcaagtcgtcccgtaccggcaaacctggcaaaaccggcaaagcacgagttaggaaaaaagggtcggcggggcctatagcgttcttcgtctccctgttcattatcgcccttggcaccatccagctggtctccaccttccacacctatgccctgaacctggccgaactcaatggtctcaagcgtgaggaggcttcgctgatcgccaaaaagcaggagttggaaaacgacatcaagcgttgggatgacaaggcctacatcaccgcccaggcccgtgaacgcctcggcttcgtattccccggcgaacaggccgtgcgtgtgcttcatcccgaagccgtgaccggctccgatagcgaatcccagaaaacggaagattccagtagcagcaacaaaaaagtcctgccatggtacagcgaactgtcttactcgctcaaaaaggccgatgagcctgtgaccgatagcgagtccggcaaatccgatatttccggttcctctgactcgtcatccaacgactcatccaagcggtccgataagtcagaccagaacacccaatccgatcagaacacccaacagaatacccaacagaacacaggggagggaacccaacagtgaccatcgatatcgccgccaaggccaaggcccttgtcgataccgtgcttgccgagcccgccaacgatcatgacatcgacctggtgcagcgtcagctcggccgatacccgcgcggcatggtcgccgtgggggcgcgatgcgtctgcggtaggccacttgccgtaatcacccgtccggtgttgcccggcggaatccctttccccaccacgtgctatctgaccggtccggaagccgtcaaggccgcctcccatgtcgaggccgccggcgtgatgcagcaatacaacgacatgttggcctcggacgaggagctcaaggccgcatatgagcaggcccataacctgtatctggcattccgccacgaactggcaggacgtcttggcgacagtgaggagcatattgaaggcacttcggccggcggcatgccggtgcgcgtcaagtgcctgcatgccctgctggcccaatccctggttatgggaccgggcgtcaaccccattggcgatttggtactggaacgcgtcaaagacgaattcgatccgaccgtctgccgctgcacgctggacgattgatcaacagatgagccagcgcgaacagtccattcatacgcactaagggatacgaggagaaggcaatgagcaaggaatccgtaaccgtcgccggcattgattgcggcacgaactccattcgactgaaaatcgcacgtgtcgatgccgatggcatgcatgaggtggtgccgcgcatcctgcgtgtgatccgtctcggccaggatgtggacaagacccatcgttttgccgacgaagcgttggaacgcgcctatgtggccgctcgggaattcgccggtgtgattgccgaacatcccatcgacggcctgcgtttcgttgccacctctgcaactcgtgacgcggaaaaccgtgaggagttcgaggatgagatcgaacgtatcctcggcgtgcgccccgaagtcattcccggcaccgaagaagccgacctgagcttccttggtgccacttccgtggtcaatcgcgacgatctgcccgccccctatctggtggttgatctcggcggcgggtccaccgagctggtcatcggtggcgacggcgtcagtgcgcccactacccaggttcagggcgcgttttccatgaacatcggttccgtgcgcatgaccgaacgtcatctgaccaatgatccgccgacccagacacagatcgatgaggccgttgcggacgtcgatgaacatatcgatgaggccttccgcaccgtggacgcaggcaaggcccgtaccatcattggcgtgtccggcacggtgaccacgatgaccgccttggccatgggattgaaggaatacgaccacaccgtggtcgacgggcatcggttgagccttgaagacgcctatgccgtggacgacaagttccttaggatgacgcgcgccgagcgccgcgaatacaagaccatccaccccggccgtatcgatgtggtcggcggcggcgctgtggtctggagccgtgtgctggcgcgtgtcagcgaagccgccaaggccgatcatggtgaagccatcgattcgttcgttgccagcgaacacggtctgctggacggcattgtgctcgattatggtcgccggttgctggctcaatagcgtaagtggtaagtgcctccagcgggctgagccgttaagcaaacagcccggtgggctgtttgtaggcgaggggagcggctatgccgcgacggctgcacgaagtgcagcaacccgcaagcaatgctcagggcaggagatagcttataatagaaaagttggcctccgtggcgaaatggtatacgcagtcgacttaaaatcgatcgcttcggcttgtgggttcgagtcccaccggaggcaccttgaaatcggcctgtggccgatgccgttttgcggctgtgccgtggtctctccccagtcggcttcgccgacagccccctcgtcagagggggctcgcagctcactatgtggagagctcataaggccgaaacaaaaggccgttaggctatgtggcgttgtgacgatgtacctgatgaaacgaggaatccacatggcttcacgctggaccgatgtcgaacgagtcgaacaaggcgccctgcccaccatgcttgcccaagccgtcattgcgggcactgcactcaccgttggtgccatcgcctgctcgggattctatctgtccatgatcggcaatgtggccgcactcctgccatgggcgactatcgtgatactgatcgccgtggcgttcacctacatcgtcggcttcgccctgttgtggtgtgccgaagccctgaccctgcgtgccaacgacaaactcaagccatggctgtacggcgtcgtcggattaatcggctacggcgtgtggggcatgttcgtgatgagcgcgatgatgaacacgctgaaccagccgctgaacggcgtggtgttgtcgaacggcgatgtgatggccctgaccgtcaactacgcggtgttcggcttcatcgccttcctgttggcacaggcgtacgcgcccaaaatcgccaccaagaagggactgaccatcgggctgatggtggtgcagatcgtattggccatcatcggtatcatcgtactggtcatgatgttctccgcactgtctcactgactgacttatcgctcgccggcacgacgcgcgcggccatcatcgcacaaggcgaaagcgattccgggcgctgggctgggatacgatatcgtgatggcatgacgcctggtaacaccggcatgccgaaccagcaggggagaaggagccaaatgttcagtgtgcttgacatgttcaccatcggcgtcggaccttcatcctcgcacaccgtaggcccgatggtcgcggcacatgctttcgcctcctcgttgcaggccgaccatttggtcgatcgcaccgcacgtgtcaaaatcacgctttatggttctctggcgctgaccggtctcggccacggcaccgatcgtgctacgatggccgggctcgaaggcaatctgccggccaccgtggataccgaccacatgatgcacatccgcgagatctgcgcgttggacgatactctgaacctcgccggcctcaaacgcatccatttcgactacgaccgtgacgtggtgttcgaacaatggaagcgcatggccgcgcaccccaatggcatgcgattccaggcgttcgacgccgccgcaagcttggtcgacgaacaggtctggtattccatcggcggcggattcgtgcgcaaaggcgctcccgaagacccgatgatcggcattcatgaacgccctccggaaggcgcctcctttgccgatgcggacgagtcatcatccactgatttcggcgtcgaggcaccctacccgttctcatcatgcactgaactggtgtcgttatgccgggaacatcatctcagcatcgccgaacttgtatgggccaacgaaaccgcttcacgctcgggcatccaggtccgatccgatattgatgccatctggcgtgttatgcgcgcctgtgtggaccacggatgcacctcggcggaacccacattgcccggtggccttgacgtaccccgccgcgcgccgaaaatgtatcggcgtctcgcctcgaattccgatgtgctgcgccgcgacagccggcgcaaagacgccgtgctcgagtcttccgacgccgcatgggtggatctcttcgccttggccgtctctgaggagaatgccggaggcgggcgcatcgtaaccgctccgaccaacggttccgccggcatcattcccgccgtgcttcactattactggcatttcgtggacaacgccaatgaacagggcgtggtcacgtttctgctgactgccggtgccatcggatacctgttcaaacgcaacgcctcaatttccggtgcggaagtcggttgccagggcgaagtcggctcggcctgttcgatggcggcggccggacttgccgcagtcgtgggcggcacgccggaacaggtggagaatgctgctgagatcggcatcgaacacaacttgggtctgacttgcgatccggtgggcggattggtgcagattccatgcatcgagcgcaatgccatggccgccaacaccgccatcaacgccgtgcgtatggccatgctcggcgacggctcacacatcgtgacccttgatcaggccatcgaaaccatgaagcagaccggtgaagacatgatggccaaatacaaggagacctccaagggcgggcttgccgtcaatgtcgtcgaatgctgattgacatgtccggtattcaccagcatgatgaccggaattgacgtatacggccagcgtgtcgtatcgcacagggatgaaggactaccgccgattcgccgatggtgctaaggtagggcgcattgtgtctttgaaggaggactaatgacagatcagatgcctcaggtgaacgccgaattcggcaccacgcccgttatcgagttcccgacgcccgaagccccgaagggcctcaaggttgtggagctgaccgagggagacggcccgatcgtgcgtcgcggcgacaccgtcaccgtgaactaccacggcgtggtgtggggtaaggacaccccattcgactccagcttcgaccgtcatcagcccgccagcttcggcatcggcgtgggacaggtcatcaagggctgggaccagactgtgccgggccataacgtgggttcgcgtctggtggtttccattccgccggaatacggctacggttcccgcggcatcccgcaggccggcatcggcggcgaggacacgctggtgttcgtcatcgacatcatttccacccgctgaccataggtcagcacatgacgaacgccggggtcatagccggcgttttgtcataaataacgaagattgtttcagcatcgacaacggttcaggaggacgatatggctgaggacaaggtctacctgctgacgcaggaagcatacaacaagatgaaggaagagctcgcccatcgtgaaggtgagctgcgtgaggaaatcgcgcacaagatcgccgtggcgcgtgccgagggcgacttgtccgagaacggcggctaccaggccgcccgtgaggcgcagagcaagaacgagggccgcatcaccgagctcaccgtcaagctgcgcgattccaagatcatcgagaatgctccggaaggcaccgtgggcgagggctctgtggtgaccatcgagctcaacggcaacgagatgacctacgtgctcggcagccgtgacatcgtggccggcaccgactacgacatcatgaccccggattccccgattggcaaggccatcgagggcgccaaggtgggcgacgtcgtttcctacaccgcaccgaacggccgcgagctgtccgtgacggtcaaggccgccaagccgctggcctgagttaagtgactggtatgcccccgtaggcgggggcatacttatatgtcgtagcgcttattgccacagcgagacgatcaccatgtagatggccaccatatggcaggcatatccggccaccgttccgcagtggaaaatctcatggaatccgaagacgcgaggccaagggtcgggcttgcgcaaggcgtagacgatggcgccgaggatgtagcaggcaccgccggcgcacagcagcaccaccacggctggccccgcatacggcgaattccagaacatcaccatataagccaggccgtagatgccgaagatgatgtacaccaccgtatacagccagcgtggtgcattgatccagatcacatgaatcacgatggcgatggccgtgcacgcccacatcgatatgatgatcacattgcgccagaatggttccagcgcaaacgaaaccggggtatacgtgccagcaatgagcaggaagatgttgacatgatcgatacgccgcagcacatcggtgacgcgcgggctccaatcgcccagatggtagcaggccgaattggtgaacagaatcagcgacgctgtcatgaacacggcacacgcccacttcagactcgcgccatgtgccaagcatataagcacgatgcctgccgccaatgacaggggagcggcaatcgcgtgaatccagccgcgcatcaacggctttggccgtccgtgcacgtcgagacgaatcttgcgttccacttccgcaggggcaatgccctcgattttcagtgcacggttctccgctttggcgagcttgtgccgggccttctcctcggctttggctcgaatggcctcggccttgaactgggccttggcccgtacggcatcagccttggcctgcaacgcctgttcgcgcgcctcgatagccgcctgacgcttggatgcgatggtggcatcctctgcaatcgtcgcgctgttatgagcgtcgtgatgcatcgtcttttccgagtcgccggttgttgatgccatggtgatgcccccgtttcacgagctgacgatacgcttcttacgctgccgtaacgctacgttagcgtaacttttatgcttgtcaataccgactcgcacgaacactatcacccaatggcggcgatactatggaatccgaagatgagaacgtcgcagcaataaagggctcggcgatggtgtattgcacggagtgtgggtttgccaacgagcaaggaaatgccttctgttcgcagtgcggaagcccattggagcagcccgaggccaatccggcggcccctgcttctcctgaacctcccgccgggcgtcctggcgtcgatcacaccaaagcggtggtgattgtgctcatcgcgctgatttgtgtcgtggcgttagtcatcggcttgttcatcacccatagcatgggattgtggggagctcagccgcaggcgcaaacatcggcacagtcgaccggggccgatgcgtcggattccgccgatgatggcacgacggattcttctgacgccaagtccaaggccaagaagaacacgtctgatagcgccaaagacaagaacagcgacgattcgtccaagaaaagctcgacggagaagtcgaagccttccactccggtgatcacatccagccagttgtctgacatcgcggattcatactcgtcctccgatgtggccgtctccgccatggtcatcgatggaacatccgccgactcctcagaggacgccaccatcgcgaccacgtcgcagtccggcaagcaattcgtggctgccgatttctatctgccggtctatcttgcggcccaggacaatggcgatgacaacgccaaagcgcaggcaaacgcgatgatgggttccatggacacagcaatgccggcaatatggtggcggcttcggatatcaaactgtacgtgatgcttgccgtgtacgataagcaacatgccggcaccttggccacgggcgggaagccgtgcaacgcgattggcgcggtattgaagatgcgatgtcgtcatagtcgtcgtacttgcccgtgtggcttgccgcgacggcggcggtgcgtctgcgtatgatagggatatggctgatttttcacatatccttgcaacgcgccccgacttcgacgacgaggaccgcgagtggctgcatcatcttgtcgccgattggcaggtgatcgccgatttgagctttgccgatctgctgctgctggtacaggatggcgatggcaaatacgtggtggccgagcaatgccgtccatccaccgttatgacgctgcgggcggaagacgtggtgggaaacgtcatgccggacgacatggtcggcgaattggacgccgccatgctctccagcgtggtgttccgctccacggtattgagaaccgtgggcaaggcgaccgtctgcaacgtgtacgcgccggttcggcacaatggcaagaccttgggcttggtcgtgcgtgagaccaatatggccacacgagaatccaacggccgatatgagtcggaaagcatcaacgccggcaagcatctgtacgagatgattccgcgaggccaattcccctacaaggattcggtgatgagccaacgccatatcgctcgcgtggcggacggcttcatcatcctgaccatggacggcgtggttcgatacgcagccccgaacgccatcagctgctttaggcgtctcggtctgctgaccaccatgcctggccattacctcagcgaactcggcacacagctattgaaggagaacgaccctgttccggaaaccctgccgttggtgttgacaggcaaagccgcggtcgactccgaactcaacgccaaccgttccgccgtctcgatgcgctcgttgcccttgtatgacaacaacggccgtatcggagcgattctgctatgccgtgacgtcaccgagctgcgccgtcgtgagcaggagctgcagaccaaggacgctacgatttccgagattcaccatcgtgtcaagaacaacctgcaggccgtctccgcattgctgaggcttcaggctcgtaagaccaagtcggatgaggtcaagaaggaattgcaggaggcgcaacgccgcgtgcagaccattgccatggtgcatgagggattgagccagaccgccgacgaggtcgtcgacttcgacaaggtgatcgccaacctgctgcgcatggccgtggacctagccacgatgaaagaccagcacatcgatatcaactacatgggcaagttcggcatgatgcccgctcaggatgccacgccgctgtccctcgtgctgaccgagctcatcaccaattcggtggagcatgggttcgaaggccgcaaggatggccatatcacgatttccgtgggccgctccggcccgaacctcaatgtggtggtcgaggatgacggttccggtctcggctccgaagaacagggtggattggctcgttcttccggttccggtttgggcacgcagatcatcaacacctttgtgaccaatgatttcggtggttccgtgcattgggagccgcgccgcgaaggcggcacccgcgtggtgcttgatatgaagctcagggctgctcaggacgagtgatgcgaagcccgaaatgaggaaaccctcccaagcgggagggtttcctagtatgacgaagcgataatcaaaacatcagatttgcatctgcatggcctgagaacggcgggcgcgcatggcgcggcgcttcagcgcacgacgctcatcttcgctcaagccgccccacacgccgtaatcctgattggtgtccagtgcgcacttcaggcatgcgtcaatcactttgcaggtgcggcacacggccttggcctcctcaatctgctgataggctgcaccggtgttgcccaccgggaagaagagttccggatccttgtcacgacatgcggccttggctcgccaatcaaaagcgctgctcattgcttgcctcccttaaaagccccgtggctggtgttgttccttaagtccagtaccaaggtaaccacgaaccgtggtgattttcaagaggttttgccgagaaaaaaccgaagttttcacgaagcgcactgcaccagacatgccgatgtgccctcgatgagcacggcccggcccgcgttgtcggcatcgatatgactcatcatatccaataggcgagcggggactccggccataagatcggacgttctctccccgcacgggaacacgattctggtattgcaatgctccggtatacgtatcgggcgaatcgtgctgacggcgaataccacgctgacggactcatcggccaacgcatgtgtgaaagacagcgcctgctcgtcggtgcggaatgggtcgaacaactcatcggcgtcgtcgacgaaccacacgatatgcggaggcggtggtgcatccgagctggcatacggcgtgcagcggccgccatgaagccattgcgagctccatacccgacgatgcggggaactgacacgtaccgccaagccatcagccatgctggcgtgtcgagccaatgttttcagcaacgtggttttgccgcgcccctgcgggccgatgacaccgatattgccaccggtgagggataccgtcgcctctcgcaggttgatgccatcgtcggcaagtccaaatcgaatgcgttgcggtgcgtggtcggccacagtccggtcttttacgtgccgggggagtggcgcggtaaacagggacggttgcggcgggcttccgacgaaccgcgatgcgaacgcgatctggcggcacaccgcatcgatatcgcgtgccgttgcacagcggaatgccgtcacctgttcggaatcgttgcagaacgccgcaccgggcattgccggactgaggtcggcggcacgaccatcgccaagcagctcgcatgattgcagacggtcccgaacccgtaaacaaatgctgacggacatattcgccttcatatcggcactgacctgacccatgggattctgcgtacaggcgatcagatacatgcccagtgacctgccgagcgaggcaatacgcaccagacgattcacataatccgggagctggtccttcagggcatggaattcgtcaatgaccacgatcaggcgcggtggtggattgaccatatcgcggatatcggaagcatggacagcggcggacagctgttcacggcgtgtcagttcggcttccagcgcacgcaacgcgcgtacggcatgcgccagatccagatcgcatacgctgcccacggtatgcggcaaccgttcgagtttgcggaacgcggaaccgcctttgaaatccaagaacacgaaattcagatgctcaggcccgttcatcgaggcgagcgccagacaccagctttgcagcaacacggattttccggaaccagtggtgccggccaccagagcatgcggcccctgacggttcagatcgagcatcagcggctcgcttccggtcatgccgatcggcaccgcaaggtcaaggggttcaagccagcggcccacaatggcgcgccatggcaggcgtgcgaagtgcagcagcgattctatcggctgcgacggcgcatgacggaggtctgcggcgcggtcatcggcgtcgcccgtgataccgacatcgatcgttgcctgttgcggatcgggagccttctccgggcctggaggcgaggggagcgtcagcagcagggacacgagacaggcgaatatgcccggtgcgatcatggcggcgaacagccattgcccgtgcaacagcagtatgaccatcatcaatgcctgcgcgatcatcgggcatgccgcggcaaacatggtcaggcgggcgcgcaatggcggcgcgcccaaacggtgcttcgcccgggatacggcggatgccgtatggacggaatgtcgcttcgaatcgttctgctgtgatgtcatgcttccagcgtgggggaacgcatgccgaaagcgcaagccgaatcaaggtatgtggttctagcttgccgagttatccacatgacattttgcccgtgcatgattggcggtgtaggcaacggtgacgatcatgcgccgatgatgaagccgatgggctccgggaaagcgtcggtcagccttccgccagattgcccacggtgccggccttatacgtgccgtcggcaagttgattgaacagttcggtgttcttggcgtcgtcaagcagcaccgaggaaccaacgccatcaacgtaataatcggggtcggaccagtacacgctgccggagatgccattcgagccggtggcgcttttgaacgccaacgccatggtgagcaacgtgtaagggttggtcttctcgtccacggtgagtgcgctcatcgcggcattggacactgccacgattttggacggattggtcagggtctcactgctggaagccttcttgacgatggccgagatgacctgtcgctggcgttcgttgcgtccgaagtctcctcgcgcgtcggcatatcgcatacgagagaaggacaatgcggtggaaccatccgccgtatggcatcccgccttccagttcagtccggaataggaatcctgaacatcctcgtcatagcacagttcgataccgcccaaggcgttcaccacgttctgcagaccgccgaacttgatctgtgccacatgatcgattttctggccggtgatctgctcgacgttgcttaccaaagccttcttgcccgcaatcagcgccaccgcattgattttcatgtactggttatcgacgttcatgagcgaatcgcggggaatggaaaccaacgaactcggcccgcttttgggcttgatcagcaccagaatcgtatcggtcctgaagccagagatattgtctacgccgccgtaatcggtggaaccgtcacgctcatcggagccaagaatcagccaagtcgaggccggcgtgttgggggtgtcggtcagccagtcgctccgattcagtttgctgtccacccattgccaggcaccgaaaacggaaagaatcaacgccgccaccagtaccgcgattgcgcatagggtgatgcgtaaggctcgcggacggcgtgccgttaccgttttcgccgttgccgccgccggccggccaagatggctgaacttcgtggacacgtttgctgctggcgatgagggccgggaaaccggcatatccgacggattgcgcacggcgttgcgggatgagccggaagacatccgcgctcgcgacggcggaatgctgcgcggtgcggcggcatccggagccgtgctgcgagtggcgcgtccggttttcggagaaaaactgggcggagtccgcctgccgttgtccgcgacgttggcgcttgccgtggcgttggcgttcagttgaggctcttcgatgtcatttcccgtgacggacggacgggccgatggagcttgacctgactggcgcgaggttcgggcgggggcgaaggagcgtggcacctgcccggaaggccgggtgcgtcgatttcccgcaggaatgaagcttggcgggttgatatgcggatccgccccacctgattcctgcgtcataacccctcctgaaactgtcgattgtctgaatgacactttgacacagcatccgccgggtgttcctgcgctatggtgttcctgcgcaggaacggcacaatatcatgtgcaacggcgtcagggcatcgcgttcacgccatagcacacagttccataaaaatgatgtaatgacacgagaaagaatttgacaaaaccgaaattgcatgtgtgtaatttagtccgtatgaaaagctcaataggcaaggagaatcgcatgtggggtgtggtcgacgattcagccgaagagccatggcacgaattgtggggactattccgacctgatggcgatgtatcttggcagcacaaggcgttgtgcgcgcaaaccgatccggaggcgttcttcccggaaaaggggggctcgacccgtgatgccaaacgtgtgtgcgcaaaatgcgaagtgcgtgagcaatgcctgaaatgggccatcgaccatgatgagcgattcggtatttggggtggcatgagcgagcgcgaacgccgtcgatataagcgagagcaccgggagcgggcgtagctccacacacccccttcaagtctggtgcgtacactgggagtttatgagtccgacaggtaatagcgatattcatgaggcgttggccgacgccatgtcttctcgaccatatacgcataggcaggatgtggataccggcattacggctgtgatcaccgttgaggaggatatgcgtttcctccggtctacattgcgttcggtattgacgcagaatgttcttccgggggtcgtcatcatcgccgacgcgaccgggcgcaccagttcgaggataaccacctcgttcgaggtcatcccctcgccatcggggccggtgatggaggtgccgcagtccaagcatgtgaccattcacatcgtctcggccaagggcgcacgctccttcggcgatgcggtcagccgggcattggatcgtgccgatctggatgacgctccccgcgcattgtggctgctccatgatgattcccgcccttcggatgactcatgccttgaacgattgcttgaggcgtggcgcaatacgccgggcgccagtgtgctcgggtgcaaacagtgcgattgggaaggctcccatctgcatgatgtcggtatgtatgcgggtcaccacgccgtgcattccctggtggtcgatggagaacccgatcaggagcagtatgacgggcggcaggatgtgtttgcggtgtcgctggcaggcgcgctggtgtccatgtcgcaattcacgcgactgcggggcatcaatgcctggctgaccacctacagcgaatcggttgatttctgccgccgtgtctgcctgagcggcggacgcgtggtggttgtcccgcaagcggagatatcacatcgtcgcgcacggtatgagggcattcgtacgcgaggcggggaaccgcttaaggacgatcacacggtcaatcatgcgatgacggtgcatcgctcccaacagcggtatctgtacacggacctggccatgtcgtcctggtttatcgtctggctgtggaggctgctccgcagttttggcatggccatatccatgatgttcggcaagaagccgtatgaagcatgggtgcaattgtgcctgccatggctggccttggccgatatcgcgggaaacatgaaatcacgcagtctggtggccagacaatcgaaggtcgccgcatcgtccctgcatgtcttgttcgcagacagccagcagatcaagcagttccatgatcgtcgggatgcattccaatcccagcagggcagagtgctgctcagtccgctggaacgtgcccatctgcggacacgcaccatatatcgctggagtgcggccgtggtgatggcgctggtgtgctttgcggccatcgcggtgatgtattggccggtgttccgttcgatattctccggcggatcgttgtattccgatgtgttgcttcccaccggtgccagcttcacgcaactggtgcagtccgccaccacgccgtgggtgtttggcagcggcaccggcattcctgcgccgcccacgccgtggctgctggtgctgatgctggcctcgttggtcacgctcggccatgtgaccgccgctttggcgatgatactgtttgtggccgcgccgctgagcgcattgtcgttctgggcgctggcgggcgtattcacccgctcggacgtggttcgtgtgctgggaggactgctgtgggcatccaccggcattatgttcggctggtatgcgcaggccaatatgccgatgcttaccgtaatggtgttcctgccggccgcgttcgcattcgtgttccgtgccgtgggcatgtaccataccgaagacccgctcaagccgcgcacatccgttcaggccgcggccatcgccgcactgtgcttcatccctgtggtggccgctgaaccgcagctgctgttcgcgctgatcgtcgtgttcctgatgttcctgctattcgtgcgtcgcaagcgcgccatgctgttgctaattccggttcctgccgcctttgcggtggctcctacgctcgtcaatgcggtgcgttacgccgatttgggcatgtggcgtcaactgttcggcgacatcacggtgccaacgtcatccgccaacgggtcgccggcgtcgctgagtctgcttgaggccgcacagcgtgcgctgggatggcgaatggggtcgactgattatgccgatttggcggtcactgtgctgtttggcgtcatcacgctgcttgctcttgcttcgctggtgctgccgttcgcgttgcggacctcgcgactgatgtgggtggtaatcgtctgcggaggcgcgctcgccctggtctccagccgtgtggccataaccgtggatgccgatggtgtcgtggccggttccgcgcagccgggcatcgcgatgatgatattgggcttcctcgcctgcgtgtgtctcgtcgctggtggggcggtgaagcgattccaaccgttgcatgcgtctggcagtgatcccgcatcgaaaaaggaccgtctgcatgtgctcatcgtgtctggccgtgtggtgcttgctctgatactggtgtgctgcattggcatccaatgcatgtatggcatcgaacgtcataaggatgcgggactgggcgtgtctgaaaacggcctgcccatggtcaccaccgattatctggaggccggtgccgatcatcgtgtgcttgccgtgagcgcggagacccgcaacatcgtcaactatgcggtgatgcgcacctcgcgcggcgatttgatcgacagctctccggtccagcgggcgcgcctgctgtccggcaagcatgatgcggttgacgaacaactggcccaggcctgtgcctcgctgctgtccaatcccgacgaagaggccatcgcggccatcagcgcgcttggattcggcggcatctacgtggttcccgagaccggcgattccttgaacgacatgccgtatgaacagttgagcgcgaatatcgccgcatcgaacggcacccagtccctggtctccacggatagcggcagctactatcgtctgacgctgcgtagcagcgcctcacagcaggtggatacctcatggcagcaacgtgcacagcatagtgtctggaggcacgcctggctgatatgcctaggtgtgatcacggcgttgtactgcttggtcgccatgcctcgcagacgaccgtcctacggattggaggagcaggcatgagcaacaaaacttctggtttcaaacgtgcgatcggcatcgtgctcggtgtgatcaccatgctggtgttgattgcgctgttcgtcgttctcgtcatggcccccatccccaatatctgggtggataaggtgaccgcttccgataatgccatcgaccagaccgttagtccgacccagtccgaaacctactgcccggcacctataggattggccgataccggcacgtacggcgacagcgccttccaggccactgtcggcaatctgagcacacaagcgcgctatgcggcgttcggctccgtctacagcgccactgtctcggcgatcggacaaaagtccagttcagatgacgtaactttgaaagacgccgattcgaccgacgattcctcggtgaaaaccggtgctcagaagatcaatcagggagctcgtctgatcaatacccgtatgctgcaggccgcagctggcaccggcaccgtcggcaccatcgcatcatgggccgatgatggcgatgtgagaggcatatcggcggcatcctgcgtatcgacctcgctcagccagtcgttcctgctctccgacagcacgaccggtaccacacagcagctcatcgtctcgaatctctccaccaagccgaccaccgtcgacattgccgtctggggttccgagacagccgggaaaatggcattgtccacccaatccacgctgtctgtgccagccgagggggagtcctcgatggaactgtccgccgcggtcgatgggcagcatggtctgttcgtgaccgtttccagcaaggagactcctatcgcgtccgtggtgcgcacggtgaccatggatggtctgacaccgaagggttctgatttcgcgctgccgctgccgaccgcatccaatgcatcggtggcgccgtccatcactgccggcgatgcggtcaccgcttatctgttcgccaaggcagacaccagcaccgggctgtcatggattaccgccaaaggcttggttcccgccaaagatgccaccgtcactgctgataaagtgacggcgatcgacttgggagaagctcctgatggggcgttgggcgtgatgtccaccgcagaggacgccgtgtcgttctccgtcaaggccacacgctccggtgactccggccaagccgatttcgcattggtcaatgccggcgagccatccgaattctcggggttggcccttcccgacggagtaaaggcctccatcacgctggccaatacgtccaatgcgcgcaggacggtcaccttgcgcgcctacgatgatgccggtgcttcggtaacctccaaggaaatcacactggatgcgaacgcagcacaaacgattgaagccggcaatctttccggcgatcatggcaccgcggtcgtgctgatgttggaggactcatccaagaaagtgagctggggagcgcggttcagtcacgattcgttgcaagacaaggacatcgccggattgtccgtcatcgacgcttcaacgctgatgcccgccacggttcatgtctgggctcggaacgattcctccatcgtcaagtagaagggtatgctcgccgaagcgtcagtttgatgatgtttcggcggcgatatagctgcgggccgtgccactaccttattacaagtgacacggcccgcagtgttgtcacaggccccagtcggggtcgatttcctcgggcctgcgcccatacaattccgctatgcgggccaccagctcatccctgacggccaattgcagttcgagcttggtaggtgcctcggtctgcaacggcatgcggtagagcacgactcgtgcgggaatgccgtggctggcggggaagcactgggacgtcatattcggctcggtctgccaaggcgtcggatccgaaggcggcacatcctccaccgcgaactggagcggacgtatcagttccggccacgcttggccgagcctgcgaacctgggccgccaccatatcgtcgaacatgccggtgcgagtgcggtaacggggcagacgggtgccgaacatcggggttcgtgtgccgcgaccgtggcggttgcggtagattcgtgcgttccaaggtggctgaagcatggttcccaccatagggcatggcggaggcaacatgcgttaggattggttcattggctgtgaacattcgtcaacgagggaggcacgacaaatggtggtacgttcgtggtccgaacttgatttcgataatgtctgctccaacgccaaggtgttcggtttcgatttggacaacacactggccagctcaaaacagctgatgaagcccgcgatgatcgaacggttctgtgcgttgctcgaccatacggtggtggccctgatctcagggggcggcatggcggtggtcacctcgcaggtgctggatgtactcaccccgaatgccaggcgcggcaatctgcatgtcatgcctacctccggctcccggtattaccggtgggatggcacgcaatgggccttggtgtatgcgcatgatctgtccgaagccaccgtggccgctgtctcggaaagtcttgagcgacatgcccgggaactgggattgtgggaacagcaggtatgggggcctcgaatcgagaacaggggcagccagatcaccttctccgctcttgggcagttcgcgcccgtagcggccaagcaggcatgggatcgcgataacacgaagaaacaggcgctggtcgaagcggtcaaggccgatctgccgcatatgcgggtcagggccggcggatacaccagtgtggatgtcagcgaatgcggcatcgataaggcctatgccgtgcgcaagctgacgcagacacttggcatacgggccgatgaaatggtgttcgtgggtgatcgcatgacgcctacgggtaatgactatcccgcggttgaggccggtgcgatcggtgttcgtgttgagaatccgcaagatacggtacaactgctggatgcactgcttgcgcgattcgatactccagctcgatagtgacgcgttatggacgggccgagcgtatacaagtggtggcatgcgatgtgggcacaggtctgcaatctgctgtttccacgcggctgcgctgggtgtgacgcgccggatgaggtattgtgtgcggcatgctgggccctgttcgcgcaatgccgggaacgggatgcagacagtggtggcggagcccgtatatggtccgcatcgatttatcagggagcggtacgtcgtgccattctcgactggaaggaccacgacgataccgagcttgacggcccgttcggccgcatcatggtgtcgctgctgaacaagacgccaataccatcatcatgcttgggtcatcgcgtattggtggttccggtgccatcatcgctggcgtcaatgcgccgaagaggacgtgcccatacggcaccgttggccaaatcggtggcaggggcattgcgtgggtgcggcgtcgatgcgcgaccatgcaatgccctgagctcctccaccaaggcacgctccgtgcagcaggtctcttcggcacagcgtgcccgtcgtatcaccggtcatgtcagggtgaagcgtgatctcatcggccatggcgacgcggtgcttctcgttgatgacatcgtcaccacaggtgccaccgtgcggcaatgcgttcaggcgtttcagcaggccggcaccaaggtggtgggcgtgctggtattggcggatgccgtggtgcgacggtccgatgacgatatcaacgggtgaatgacatcggttacgatgccccagatagcaggcgaagcgccgttgctcggcatgtaatcggggtatcgcggattctcggcgtgcaatatggtgatgccggcccgtgaaaccagccgcttgatggcgatttcgtcgtccatgacagccgcaaccacatctccggggactggtgttaacgaacgatcgacaatcagcagatcgccgttgtgaataccggcattgatcatggaatcgccggccatctgcataacaaacagcgtggcctcgtgcgccatggcctgtgactcggattgctgtgtcatgctgcgcctcccaccctgtattcgaacatctgttcgaatacagtatacggtaggacgtcggacaatatcagcgttcggcgatgtgatatttaggcaggatgatttcgaaatcggcacctcgcgtgtcgtcgaccactttgacggtgccaccgtgcaattgggccgcccagcgcgcgatggacaggccaagaccggtgccgcccgactcggtgccgggacccgtcttgcctttgacaaagcgccggaagatgtccaaacggtcggaaggcgcaatctgggagccgaaattcaccacattggtcacgatggtgccttggttttcgtcctcgtgggcgtcgaccagcacggtggtgccgtcggccgaatgtttcagcgcgttggcgatgatgttggtgaatagctggcgcaggcggtcctgatcgccttccatcgtgatgtcggccggcacggtgacgcggatgtcgtgggcgtggccaccatcggcgatttccaacggctcgatggtctcgtcaagaaagtcggcgaagttgaacttttcgatattcagactcgccgcaccggcctccatacggctcaggtccagtaggaaggcgatgagatcggagagacgctgcgtttgggtgaggatgctctccagattggtgggagtgggctcggtgacgccgtcggccatgttctcgaccatcgcctgcaaagcggaaacgggcgtgcgcagctcatggctcacattggcgatcatgtcgcggcgcattttatcggcatgctcgagttcgccggccatctcgttgaacgagcgagccagcttgccgacctcgtcatgacgatcctgatcgatatccacgcggaccgtgtaatcgccatccgccatggcttcggccacatcgcgcatctggcgtaggggagcggtgatgccgcgagagaagaaataggtgatgcccaaggccaccaccaaagtcagcggcatggcgatccaaccggaccagccgaatttcaggaggaaccagcacatggcaaacgcgatggcagtggcgataacgatcagtgcgctgagttccagcttcagagatgagaacaaatcaaccggcttgacgcgaggtttcatcgcatcaagccgggattgctgttgttttttggatgccatcacgcggtcggcggctcgaaagcgtagcccacgccatgcacggtgcggatggtatcggcaccgagcttatggcgcagcgccttgacgtggctgtcgacggtgcgggtgccggatgcgtcgacccagtcccagacctcttcgagcagcttttcgcgggtgagcaccgacttcgggcggcgggccagcgtggccagcagatcgaactcggtgggggtcagatgcacctgttcgccgttcacggtgacgatgcgctgggccgggtcgatgaccatcgaaccgaagtcgagcagcttctcgttctccgagttcttggcgatgaccttcgcacgctccacgcggcgcagcagcgccttgcagcgggcgataagctcgcgcatggagaacggcttggtcatgtaatcatcggcacccgctcccagaccgatgaccttgtcggcctcgtcatcacgtgcggtgaggatcagcaccggcaccggacgttcggcgacgatgcgtttggtggcctctagaccatccataaccggcagcatgatgtccatgatcaccagatcggggcgtagctgggacgcggcctggacggcggaagcgccgtccccggccacgcgagcggtccatccttcagcggtgatgcgctgggcgatggccgtggcgagcgtgggctcgtcctcgaccaccagcaccgtgcgcggtgtcgtattctgacgcgctgtggtattgagcataaataaaccggttacctttcagcctgttgaccagttcagtcttccggcttcaagaatacaactcccagagccggaacggtgatcttcgccgagaacggacgtgaatgatattcgccctcgaccgcttcgaaggtgccgttgtggatgtcggagccgccgtacttggcgtcatcggtggtgaacacttcggtccacttgccgccggtgggcagcgccacctggtaatcggaccaggcctcaccggagaagttgaccaccacggccaaggtctcgcccttggtaccgatgcgcaggaagctcagcgtgttgtggtcggcatcgtcgctggtcagccactggaagccggccgggtcgaagtcctggctccatagtgccggatgcgccttgtagaaggcgttaaggtcggcgaccatggtctggacctgacggtgctcctgccagttcaggcaatcccaatcgatggaggcgtcgtgatcccactcgccccactgggccagctcgttgcccatgaaggagagcttcttgcctgggtgagcccactgataggcgaacatcgaacgcacgccggccagcttctgccagtcatcgcccggcatcttgccgtacagggaacccttgccgtacacgacttcgtcgtggctgatgggcaatacgtagtgttcggagtaggcgtacaccatggagaaggtgatctcgttgtggtgccacttgcggttgatgggctcctcgtgcagatactcgagggtgtcgtgcatccagcccatgttccacttcatgccgaagccgatgccgccggcggaagtgggggcggtgatgcccggccatgcggtggactcctcggcgatcaccatgacgccggggttgttcttgtacgcggtggcggtggcctccttgaggaagtcgatggcctccaggttctcgcgtccgccgtagatgttcgggcgccaatggccgggttcgcggctgtagtcgaggtagagcatggagctgacggcatccacgcgcagtgcatcgacgtgcaggtcctcaagccagaacagggcgttggccaccaggaagttgcgtacttcgcggcgtccgaagttgaacacataggtgccccattcagggtgttcgccgcgcagcgggtccgggtcctcgtacagcggggtgccgtcgaagcggccgagcgcgaaggcatccttcgggaagtgggcgggcacccagtccatgatcacgccgatgccggcctgatggaactggtcgaccaggtaacggaagtcgtcgggggaaccgagacgggagtcgaccgcatagtagccggtgacctgatagccccaggagccggagaacgggtgctgggccagtggcatgaactccacgtgggtgaagccttcctgcttgacgtagtccacgagctgcttggccaggtcgcggtaggtcagtccctgcctccagctgccggcgtgcacctcatagatggagaccgggccatcatgcgggttggtggtgcggcggtgctgcatccaggcgtcatcgttccacttgtaggtggattcggtgacgatggaggcggtgttcggcggaacttcgtgctgacgctccatcgggtcagccttcatctcccacgtgtaattggcgttcaggatctggaacttgtaggtctcgcccgcgccgattccggggatgaagatctcccacacgccggaggagccgagctcgcgcatggcatgacggcggccatcccaagcgttgaagttaccgactacgcgcacggcatgggcgttcggggcccacacggagaatgcggtgcctaccacctgttcgccgggcgtgccgtctgcgccgcccatcggatcgtcatagcgcagcacatgcgcgccaagcgtctcccagagcttctcgtgacggccctcgccgaacagataggtgtccatgtcaccgactgtgggcatatagcgatatgggtcgtcctcaatgagcactgcgccgctttcccactcggtcctgacacggtagtcgggaatcgtgggctgcttcttagtgccggaagccggcacggtaaccacgaacacgccgttgtattcgtgggtcatcgggtattcgccatcctgggtgaggatggtcacggacttggcaagcggacgcagcacgcggattgtggcggtgtcggcatgcttgccgatgccgagatgcccgccgagaactccgtgggggttgtagaattcagcattgctcgtcgcatcgaggtcgccttgggcgacaggcacggtgacggtatcttccttgattttcgtttctttggccatgtcccaaagtctacgtgcgttgaagtcgaaaacgctacattggcgcgtcgaaaatggcgaattcttgcccttttcgttgtgtttccgtggttgtgagcgctctcataggggtggtccagaccgcatggcataattattcgagttttcgtgtgtaagccgtcagttctcggagggtacatgtcttacaaagtcggcgatatggtcgtctatccgcgtcatggtgcagcgaaggtggaggccattaccgagcggacggtcaagggagtgacgcgcgaatatctgcagttgtccgtactctcttccgatggtttggtcatcaacgttcccgtggacaatgccaagaaggtcggtgtgcgtgacatcgtctccgcatccgaagtggccaaggtgttcggcatcctgcggaccccgatcatcgagaaagagatgaactggtctcgccgttacaagctgaacgtcgaaaagatcgccaccggcgatgtcaacaagatcgccgaagtggttcgcgatctcgcccagcgcgatgtcgacgagcacggcctgtccgcgggcgagaagcgcatgctcaccaaggcccgtgccattctgacttctgagatcgccttgtccgagaagatcgacgaggcggaagcccagcgtctgctcgacgtgaatctgggctacgagcccgctcagcccggtgacgacaagcatcacaccgccgagcccgaagaggccgcggccgatactttggctcgtgttgaagccgagaagaagtccaagaagaagtgatttgattgttttgaggccccggtcgtgtccttatgcgatgcgccggggcttcgtgattcataatcgtttgctgccgttcgtctgggcaacgccatcgaaggggactgcatggggtctgtaggagtgctgatagggcaaggttttgacgctcaccgttttgcgcctgctggctcaggccgtgaactgtggattgccgggctctactggccggtgcctgattcatgcagcgaggccgatgccgccaaatacgaggggatcgaaggcgattccgatggcgatgtggccgcgcacgctctgattgacgcgttgcttgccgccgcccgattgggagacattggttcactgttcggtgtcggtgcggacgcgcatggtgccggaatgcatggcatcgatatgttgcaagaagttgtggcgcatctggcatccaacgggtatacgccggaatcggcctcggtggcgatcatcggtaaccgcccgaaaatcggcacacgccgtgctgaagccgaagccgccctgtctgcggcggttggttgcccggtatcggttactgccaccaccaccgaccatatgggattcactggccgcggcgaaggcatcgccgccatcgccaatgccttggtggagaagatataacaaagcccccgctatgaattcgccagcgggggcaagaaaaaatggatgagattacttccgcatcgtctccacggctttggcgatagcccagaacagggtggaaagcgtcacgatgatgaagctcgggggagcggggaacatcgccgacagcacgagtccggcccaaatcgacaccaagcacagcacgctggcgatcaccattgccttgaatggggagccggccagaatattggcggtggccgcgggcgtaatcaccagtgcgaaaatcagcaaggtgcccactgccggcacggcgatggtgatcacaccggccataatcgccataaacgccacgttcatcagcccgatcggcacacccttggcctgtgccacctgctcatccagcgagctgaacagcagcgggcggtagatgatggccaacaatgccagcagcagtacgtcgaacacggcgaagccgatgatctggccggtggtgatggtcaggatcgagccgaagaggatcgactgcatctgctgggaggcggaactcgacaatcgcgcgaagaacagacccaagccggtggcgaaggccagcacggtgccggtggcgatttcacgctcggaaacgcgcttgcccaaagcaccgatcaccagtgcgccgcccagtgcgaacacgcccatgcccagtgacacgggcaggccgagcaacaccgcgccggtcgcgcccggcagaccgatatgggccagcgcatgggccgcgaaggtggaacgacgggcgatggtgaagtatcccatgacaccggcggctagggcaatgcacaggccggcgatgaaggcgttggtcatgaatggagcggacagtgtatccagccattcgggatcatacgaaaagttgatggtgctcatgtctctgtattttctccatgcctgagctgcagtccgttgatgggctgtgggtcggctcgcttgatgttatcgattctcggcgctgatggcggcactgccattggtggcattgccgtgctcgtgatggtgcaattgcgccacttcggctgccgtgtgcatatcctgcggctggtcctggagctcatccggcgtcggggtcacgaacatgtctccctgcggagtggtgaccacctgcacctgtgtgccgtagaggtgggtgagtaggtcggagtcgagcactttgtgcatatcggcgtagtgcgggtgaccgtcgagcaagtagacggcaccggtcagaatcggcaagagcatattgagatcgtgcgcaaccacctggatggtcatgttcagttcgcggttcagcttggccagcacgtgtacggtggcgcgctgactggccagatcgaggttggccaacggctcgtcaagcatcagcagttgtgggtcgcacaccaacgcctgggcgatggccacacgctggcgcaaaccgccggacagttcggacagacggtaccgcgccttgtcggcgatgccggtgaactccatcgcctcgagcgctttggctttctgggccttggtgatggggtggatgccgaatcgggtgccggtcaggcccagcaacacggattgttcggcggtgagattggaatcgacattcgccacatagctctgcggcacatatccgatgcgtttgttcatctcgcctgcgggcttgcccagcacggtcaggctgccatgacagagcggcaaaaggcccagctcggccctcatcatcgtggttttgccggtgccgttggtgccgacgatggccgtgaccgaaccggtgggaatggcgaaggtgccatgctgccagatgatatggtcgccacgcttgatggcggcatcgctgaacacgatgcaatcggaagtttcactcataacgcccgattgtggcaaacgatgctgacaatcgttctcaatatcgtgtacggatggtgataaccaaagagaagggttgtgcggccatctcgacaatggtcgcacaacccttctcatgcaaggcgtctattggcattggcacgaatccgatgccggtgtcctttgcttctaactatttgccggagtcggtctggtcgttgccggaggcatcgccggaatcgccattggcggcatcggcctttgccgaatcctgagatgagtcactggatgcggccgccttgcactgacggatgtacttggggtccgtgctggaaccggtgctggccttggagtcttgcgcattggcatcatccgtggcggagccttcggcgctggaatcatcggaattcgcgttgctgtccgcggtatcgccgtccgtggcgtcttcgcagccatagcttggatccaccgcgtcgatgatggtgttgatgagctggttgatccaggcgttcagcgtgtcggcgtccttgggcatttgttcggagacgtcgactaccggcacatcggcgcgaccggcagcgccagtgatcatattggtcgcgtcactggcttcctgcgtgttgttgaccagcacatccacgcccttgtcttcgatgagtttctggaaagactgcaggtccgcgggtgccggttcgccgccggaagcggtcgattgcgtataccccttgggcgtctgatctttgaacccaagatcggccatcagataatagaccacgggttcggtggctgcataggtgaggtcggagtgggacttggtgaactcggacgcccatgtttccaacgatttctcgtccgcctgccatgccttgagccgcttctggaaggctttcttcttgctggggagtgcctttatatatgcatcggtgatggccgtggccatgctggatcgagcgtctttggagaaccacagatgcgggttatcgccctcgacggcacccatgacggaagcggcggatacgatattcgtggtcttggtcatcgatttggtggcccaggaatcgtagcccgcaccgttggccacgatgatttgggccttggacagcttggcgacatccgaggtctttggctcgaaatcgtgggcatccacattggtggagttcacgatggacgtgacttccacatcatcgccgcccagctcggcggccagcgagccccattgattgagggaggccaccacattgatcggcccggtcggtgcgggaacgctggtcttgttgtccggctcggtttcagcgggggaggtggctgcgcatgcggtggtcgcgaacaacaggacggcgctcaggccggctgcggcgagtcgcgtaagtcgtgtgatttgagtccccatggcacgccttcttcgtgagagcgaacgatatataatcctgacttgttccaacgatagcctatcgtttcgatagaatgcaccgaaactacaggggagggcgttgatgtccacaaaaatcgacggtaagcagattgcggccgaaatcaagaccaaccttgccgagcgagtgaacaagctcaaggcgcagggcatccaaccggggctgggcacgctgctggtgggcgaggaccccgggtcgatgaagtacgtggccggcaagcacgccgattgccaggaagtgggcattacctcagtcaagaaggaactgccggcggacgccagcttcgacgacatcgccgctgccgtacgcgaactcaacgaagatccggcttgcaccgggttcatcgtccagctgccgttgcccaagggcatcaacgagaacgcgatcatcgacatgatcgacccggccaaggatgccgacggcatgcacccgtacaaccttggcgaactggtgctgcatgtgcgcggcgacatttcgacgccgctgccttgcactccgcgcggtgtgctcgagctactcgacgcctatgacattgatctgaacggcaaggaagtgtgcgtgcttggccgcggcatcaccattggccgcacgattggcctaatgctcacgcgcaacgccgtcaacgccaccgtcaccctgtgccacaccggtacccgggatgtggccgaccacatgcgccgcgccgacgtgatcgtcgccgcaatgggttcggccggattcgtgacgcccgacaaaatcaaggacggcgccgtgctggtcgatgtgggcgtcagccgcgtctacgacgaagaagccggtcgctaccgcatcaagggcgacgtggacaaggcctgctacgacaaggcctccgcctacacccccaaccccggaggcgtgggtcccatgacccgagccatgctcctagccaacgtcgtggaaatggccgaacgacacgcctagagtttcctaggaaatttgggcagagttgcttgtattgtgagtatctgtatgcctgtagggtgtgcgtataactgaatatcgagaaattatccatccactattagaaaccatatatttacatggcagagaacaacactgaagtcaccaaggttgccatcaacgacatcggcaccgaagaggacttcatcaaggcagtcgattccaccatcaagaacttcgatgatggtgatctggttgagggcaccgtcgtcaagatcgatcacgacgaagtcctcctggacatcggctacaagaccgagggtgtcatcccctcccgcgagctttccatcaagaaggacgttgatcctgacgaagtcgtcgaggtcggcgacaccatcgaggcccttgtcgtcaccaaggaagacaaggaaggccgtctgattctgtccaagaagcgtgcccagtacgagcgcgcctggggcgacatcgagaagatcaaggaagctgacggcgtcgttgagggcaccgtcatcgaagccgtcaagggcggcctcatcgtcgacatcggtctgcgcggcttcctgcctgcctccctcgttgagatgcgtcgcgtccgcgacctctccccgtacatcggccagaagatcaaggccaagatccttgagctcgacaagaaccgcaacaacgtggtcctgtcccgtcgccagtacctcgaggagacccagtccgaggtccgcgagaccttcctgtcccagctcaagaagggccagatccgtgagggcgtggtgtcctccatcgttaacttcggcgctttcgtcgatctcggcggtgttgacggcctgatccacgtttccgagctgtcctggaagcacatcgaccacccgtctgaggtcgtcaaggtcggcgacaaggtcaccgtcgaggtgctcgacgtcgatctcgaccgtgagcgtatctccctgtccctgaaggcgactcaggaggatccgtggcagcgcttcgctcgcacccacgttcccggccagatcgtcaagggcaaggtcaccaagatcgtccagttcggtgtcttcatctccgtcgaggacggcatcgagggcctggtgcacatctccgagctcgccaaccgtcacgtcgagaacccggagaccgtggtcaagccgggcgagaccgtgttcgtcaaggtgatcgacgtcgacctcgatcgtcgccgcatctccctgtccctcaagcaggccaacgactccgttgacccggcttccgaggacttcgatccggccatctacggcatgccggccgagtacgacgagcagggcaactacaagtaccccgaaggcttcgacccgaacaccaacgagtggatcgctggttacgagaagcagcgcgaggagtgggagtctcagtacgccgccgctcacgagctgtgggaggagcacaaggagttcgtggccaaggagctggagaacgctgccgaatccgcagccgccgacggccagggcccgaaggaagagaagccggtcgaggagacctccaactactcttccgctgctccggctaccggtaccctcgccgactccgatcagctcgccgccctgcgcgaccagctgctcggcaagtgagtttgccgcgaagctagcgcttagcgtgtaaagaaacccggtccgattgggccgggtttcttgtgtttttggagttatccgccaatgactcccctcagtctcgctacgcgagccggctcccctccctgaggggagctgtcggcgatagccggccgaggggagcgccagctatcatgggcaccatgatgcgaataggactgaccggcggcatcgccgcgggcaaaagtacggtggcggcgcaactcaagcaactcggcgcgttgcatatcgactacgatgcgctggcgcatcagatcgtcgaacccgggggagtggcgctgccacagatcgtcgccgagttcggtcctgatgcattgctcgccgatggcactatgaaccggccatggattgccgatcatgtcttcggcgcgaacgccgcgccgggcgcacgtgaacggctcgacgccatcgagcacccattgatctatgccgaggcggcgcgactggagcatgagcaccccgaggcagccatcatcattcacgacattccactgctcgccgaggtcattgacgatattccattcgcctttgaccatatcgtcacggtcgaagctcccgtgtgcatgcggctcgaccgtatggtcgaggaacgcggcatgagcctggaacaggccgaggcccgcatccgccaccaatccagtgaggaggagcggcgggccatagccgatatcgtcatcgactccacccatccattgcccgagatgctggcccaagtgggtgagatatacgcaggatggtgcgcaggtcgctaagatgaggccctatgggattcaatatcgagcgcgcggacaagcctttcgtcgtcaaatcgccatataagccatccggcgaccagccgcaggccatcgccgaactggccgaacgcatcgaaaacggcgagaatgatgtggttcttatgggtgccaccggtaccggcaaaaccgcaaccaccgcctggctgatcgaaaagctgcagcgaccgaccctgattatcgagcccaacaagacgctcgctgcgcagctatgcgccgaattccgcgaactcatgccggacaacgccgtgagctacttcgtgagctactacgactactaccagcccgaggcatacatcccgcagaccgacacctatatagaaaaggactccaacatcaacgacgatgtggagcgcctgcgccaccaagccaccgcaaacctgctgacccgccgcgactgcgtggttgtggccaccgtctcctgcatctacggcttgggtacgccggaagaatacgccggtcgcatgctcttcctcaaagtcgggcaggaaatcaaccgcgacgacctgctgcgccaattcgtggccatgcagtacaagcgcaacgacatcgccttcacgcgcggcaccttccgcgtgcgcggcgatacggtcgaaatcatccccgtctacgaggaactggccgtgcgcatcgaattcttcggcgacgagattgaccgcatctccacgctgcacccgctgaccggcgacgagatcgacgaggaaaacgaagtccacatcttcccggcctcccattatgtggccggccccgaacgcatggaacgggcgctcaaaaccattcgcgaggaactcgacgaacgcctggcagaactgcgcaaacaaggcaaggagctggaagcgcagcgcctcaacatgcgcaccacctacgatctggaaatgctcacccaagttggcgtgtgctcaggcgtcgaaaactattcgcgccactttgacggccgcgccgctggcaccccgccgcacacgctgctcgacttcttccctgacgacttcctgctggtcatcgacgaatcacacgtcactgtgccgcagatcggtgccatgtacgagggcgatgcctcccgcaagcgcacgctggtcgaacacggcttccgcctgccctccgcgatggacaaccgaccactcaaatggccggaattcctgcagcgcgtcggccagaccgtgtacctgtccgccacgccaggcgactatgagatgggactgtccgatggggtggtcgaacagattatccgcccaaccggtctgctggacccgaagatcgacgtacgcccggtcaaggggcagatcgacgatctgctcgccgagatcaaggcccgtgtggccaagaacgagcgcgcgctggtcaccactctgaccaagaagatggccgaggacttgaccgactatctgctggaacgcggcatcaaggtcgaatacctgcattctgatgtggatacgttgcgccgcgtcgaactgctgcgcatgttgcgcgaaggcaagatcgatgtgattgtcggtatcaacctgctgcgtgagggcctcgatttgccggaagtatcgctggtggcgattcttgacgccgacaaggaaggattcctgcgctcctatcgttcgctcatccagaccatcggccgtgcggcccgaaacgtgtccggcacggtgatcatgtacgccgacgagaccaccgaagccatgcggcaagccatcgacgagactgaccgtcgccgcgccaagcagattgcctacaaccaggagcatggcatcgatcccaagcccctgatcaagaagatcagcgacgtcaacgacatgctcgccaaggaggatgtggacacccagaccttgcttgaaggtggctaccgcaacgcgggcaaggccggcaacacgcacctgggcgtgccggtactcgatcccaacgaggcagacaaacgccacgaggagatcctgaaggccggcctgcccgcgcaggacctcgccgacctgattcgccaactgagcgaacagatgcacaccgccgccgaacaactccagttcgaactcgcggcccgtctgcgcgacgagatccgagacctcaaaaaagaactccgtcaaatgacggaagccaacaagtaaccaaattcccatacccgaggcgggcagtcaggggatgcgttgttcgaccgtaaagacttggcctgagcggcccggagcgtgtcgaacaacacatcccctgactgcctggcgatcagcgctaccggaacggcccccaaaaccgtcacatacataagttagtgtagggaatcatggcagaaaccccactcgcatttgaaatcatcaccttcgtggtgctcgcgttgttctttatcgtcgacctgttcgtcatcggacgccgaccgcatgtgccctccaccaaggaatgcgtgcagcatatcgccttcttcgtggttatggcgctgatcttcggcggatgcatctggttcttcgccggctccaagcccgccatcgagttctattccggctggctcaccgaatactcgttgtccatcgacaacctattcgtgttcgtcattatcatgtcgaacttcgcggtgcccaagcagattcagaagtatgtgctgtccatcggcatcaccattgctttgattttccgtggcattttcattctgatcggcgcggccctgatctcccgcttcacgtgggtgttcttcctgttcggtgccttcctgatctacaccgccgtcaaactggtgctcggcggcgatgaagatgaggaatatcacgagaacggcatcatccgtaatctgcgcaagatcatcaagattaccgacgactacgacggcgagaagctgcgcaccaccaagaacggcgtgcgttactggaccccgatgctcatcgtgttcctgaccatcggcaccaccgacgtcatgttcgctttcgactcgattcccgcgatcttcggcctgaccaaggatccgttcctggtgttcacctccaacgtgttcgcactgctcggcctgcagcagctgtacttcctgctgggtgctctgctcgacaagctcgtctacctgcctgccggcctgtccgtggtgctgggcttcatcggcgtcaagctcatcatggaggccctgcacggcaataccttgccgttcatcaacggcggcgaaggcgtccattgggtgccggaggtgcccacatggctgtcgctggctgtgattgtgctcgcaattggcggcgcatccgtggcttccgtgatcaagatgaagagcatggaaagcgctgaaaaggcctgaaatcgttagagaatacaacccttaaacccagtcaacacaacaatgtgagcgctcacaacacaccgtgaagaaaacttgtcatgagtcggctcgcgctagtagactgggtttcggcaaatggggcaatcgcgcctcgaaccaaattgaacaagaataggcaggcattcatgcgtaaagccaagatcgtagacaccatcggtccttccaccgaggattacgacaacctcctgaagctcgttgaagctggtatggacgttgctcgtctgaaccgctcccacggcaccccgaggatcacctcaaggtctacaacaacgtgcgcaaggccagcgaagccactggtcgcaacgttgccgcgctcgttgatttgcagggcccgaagattcgctgcggttggttcaagaagaacgccgatggcgaagacaaggttcagctgcagctcggccaggaattcgtcatcaccactgatgacgtcgagggcgacgagcacatcacctccaccaccttcaagggcctgccgggcgattgccacccgggcgacccgatcctgatcgatgacggcaaggtccgtcttgaggtcaccaaggtcgagggcaacaacgtgtacaccaaggtcgtcgtggccggtcctgtgtcctcccacaagggcatcaacctgccgggcgtcgccgtctccctgccggctctgaccgagaaggatgaggccgacctgcgttgggccatccgcaccggtgccgacatcatcgccatgtccttcgtgcgtttcgccaccgacatcgaccgcgcccacgagatcatggacgaggaaggccgtcgcatcccgatcattgccaagatcgagaagccgcaggctctggagaacctcgaagagatcgtcaagaccttcgacggcgtcatggccgcccgtggcgacatggccgttgagtgcccgctggaagaggtcccgctggccactaagcgcatcatcgagctggctcgccagtacgccaagccggtcatcgtggctaccgaagtcctcggctccatggtgaactccccggttccgactcgtgcagaggcttccgactgcgccaacgccatcctcgacggctccgacgccaccatgacctccaacgagaccgccgttggtaagtacccggatgtgaccgtggccaccatggcccgtatctccggctacgccaccgaccacggcttcgaccgtatcccggagctcaagaaccttgacatgtcctccaccggcgctgtctcctccgccgctgtggacctggccgacaagctcaacgccaaggccatcgttgcttacacccagaccggtgccaccgtgcaccgcgtctcccgtgagcgtccggccgccccgatctacggcctgaccagcaacgagcacacctaccactggctggctctgtcctggggcaccgaagccttcctgctcaaggaggactaccacgacaagtcccgcaaggatctcatggtctacacggacaaggtcctcaaggatgctggcaaggttgctgacggcgacaagatcgtcatcctgagctctgctcagggcgatcaccagccgggccgcactgactccatctacgtgcacaccgttggcgcttgcgactgatttcaggcttctggtagctgctgacagctagcatatagcacacgaaagcccccatccaaagtggatgggggctttcgttatctgttatgttgcgattgtgtggtgattgcaatggcccacagtcaccgcggtgatcgagcgtggcgatcagtcgttgagatgatcgagcgtgccgctcttcaggcgcaaaatggcgaccatggtcttggcatccacaatcgtgccattgaccaccatctcataggcatcgtccaccgacaccatacgcacgtcggaacgcggagtctccgggccgatttcctgacgggaagccggggttagaccggtggcgaagaagattgcggtgtgctgggtggaatagctcggcgtgttcataaaacgggtgaactgcgtaagcttggtggcgtcgaaaccggcctcttcggccagcttgcgcttagctacatcggtcgggcgttcggacgggttgttggcgtgaccggccggaatctccaacgtccaacgatggttggcgatgcgatactgctcgaccagcggaatcatgccatcatcggtgacggccagcacagccacagtgtcgccattgttctcctgaacaaagtagcgttcaaacgaaccgatttgattcgactcataggagacgtgatcgacattgaaataatgcgtctccacaatctgtctacgggaaatctccttgaccggagaggggcgccagggatcgaactgacggtaagtttcgttgctcataagccctcctaacaaaagcgatacatcgaaactacagcccattgtaagcggtgaaaccacgcaggagaacgggcaacacacgggtgcgccgtccgcgatatcgacgtgtttcgcctgtttcaccggggggaatggaggattggcgcgtgtcttgtgtcgcaagagtcgaattggtatgctactctcttcagagtgctttggcacgccctcgtatcccaattggtagaggaagcagcctcaaaatctgcgcagtgtgggttcgagtcccaccgagggcactttagttaggagttcgctgaaattattgtgaaccccattgtcgggtaattcaagaaagaggttggcatggctgcaaggaagaagtccgaagaaccgagtatcaacatcgatgaggtgctgaccgacgaagagctcaaggccgtggccaatgaaagcgaacctgctgagcgcaaggccaagcccgaggacggtccgcgtaccgttgtcgtggccgaggacgaagccgtgaaccgcatggatctggtcgccatgctggaagacaacggttatgaggtcgttggtcaggccgccaacggcgaggaagccgtggaactgacccgcaagtaccgccctgatgtggtgtgcatggatgtcaagatgccgcgtatggacggcatcaccgctgccggcattatctgcgatgaaaacatcgcccccgtcgtcatgctcaccgcattctcccagaccgatctggtgaagaaggccaccggcgctggcgccatggcatacgtcaccaagccgtacgaggaatccaagctgctgccgaccctcgaggtggccatgggccgtttcgccgagatcaacgatttgctggacagcgtggagcgcagcgaacgtaagctcaaggaaaccaccgatcagctcaaggaaaccgaagagaagctcaagaaggccgaagacacgcttgaggagcgcaagctcgtcgaccgcgccaagggtctgctgatggacaaggcggacttctccgagcagggtgccttccgttggattcagaagacctccatggaccagcgcatccccaagaagcgcctggctcaggccatcatcgccaagtacggcggtccgaagccttctgattcgggcgaacgctgattatcggcgtcgccgtactgagtcgtaaagcaacacaaacacactatgggagaggccagcgtgaccgtacccaccaatgaaacattgctggtggtggacggccactcgctggccttccgtgcatttttcgccctgccggtcgacaacttcagcacctccagcggccaggccaccaacgccgtctggggttttgccaccatgctcgcgcaggtgatcgatgcggagaagcccgaccatctgggcgtcgccttcgatgtgaagggcggcacattccgcaatgagatgcttccgcaatacaaaggcacccgtgaggcggctcccgaagagctgctcacccagctgccattgattcaacgcatgctcacggccctcggcgtcacctacatcgagaagccgggattcgaaggcgacgacgtgatcgccaccctcgccaccatgggagacaaggccggttaccacacactggtattgtccggtgaccgagacgctttccagctggtggatgacaacgtcaccgtgttgtacccgggccatcacttcaaagacctgaagcatatgacgccgcagtccatcatcgacaaatacaaagtcactcccgcacaatatccggatctggcggcactccgaggcgaaaccgccgacaatattcccggtgtgcccggcgtaggcgacggctttgcggccaagtggatcaaccaattcggttccctcgacggcatttgcgagcacgccgatgaaatcggcggcaaaaaaggcgaatcactgcgggccaatatcgaccaggtcaaactcaatcgcaaagtcaacgcactggtacgagacgtcgatctaggcgtcgatatcgaggatctgacattcggcaccgtggacgtggcacagatcgacgccctgttcaaggagcttgaattcggacctcgcaccaagagtcgtgtactgaaaaccttcaataccggggccaaggcatccaacacatccggagctggcgagtctacgaataatgagcagaacgagcaggatagcagcctcgatctgaacctgccggaacccacgagcatcactgctccggagcagttcgacgaatgggtcaaggcccatcgcgtcgaagtcaaggttcccggtgaaatcgccgatttcacggtttccgactatggcggtggctcgcagcggcatgccatctgcggcgacgcggtcggccacgcttggaccgtggccgcatggggcgacgaaaggccggggcgtgccacggcacaagccattgccgtggccacggcaacatcagcggccatagtgccccttccaatcaccgataccctgcgagcacagcttgcgcggttcctgaaaagcgaacactcccgcaccatcgtgcatgggtataaagaattgctgcatcttttgggcgcggtcgatcttgacatggacctgccgatgttcgacaccaagcttgccgggtatctggcccaaccggatttccatgccgatagcctcaagcaggcggccgagcacttcctcgacatccacttcaccgaaaccgaacagccttcgcaaggcacgttggacttcgacgacgatcaggtcgaagaagatccgaacgaacatcgtctgcgtgatttggccattatccgcagcctcgccgtcacgctcgggccgattatcgacgagcgtgaacaatgctggctgatgcgcgcgattgaacttcctgtttcccgcgtgctgcacggcatggagcacacaggagccaaagtcgatagcgttcgactcgtctccatgcgtgaccagtttgccgccgaggctcgccaagcgcaggaaatggcttgggagtatgccggcaccgaaatcaacctgcaaagccccaagcagctgcagaaggtgctgttcgaagatatgggtttgaaacccaccaaacgcaccaagtccggctcatacaccacgaatgcggccgcattgcaggatctgtatgtcaaatcagtggacaatgagcgggccaacggtttcctcggagcgttgctgcgccatcgcgagatcaacaagctcaagcagatcgtccaaacgctgatcgatgccaccaacacatcagatgagcgcatccacaccactttcgagcaaaccgttgccgccaccggccgattgagctccgtggatccgaacctgcagaacatccccaatcggaacgccgccggccgtgagattcgtggcgtgttcgtgccgggggaggggtacgaggccctgatgagctgcgattactcacaggtcgagctgcgcattatggctgatctgtccgatgatgaggcgctgatcgaagcgttccgctccggagccgacttccacaaatacgtggcctcgatggtctacaagctgccggtcgaccagatcaccggcgaccagcgcagccacgtaaaagccatgagctacggattggcctatggtctgagcacgtatggtcttgcccagcaactcaagatcgcgccacgtgaagcggaagcgttgaaaaaccggtatttcgataccttcggcaaggtgcacgattaccttgaatcgctggtggccaatgcccgagagaaggggtatacggaaaccattttcggacggcgtcgctacttcccggccctgcattcgaccaatcgtgttgcgcgtgaggccgccgaacgcgcggcactcaacgcaccgattcagggatccgccgccgacatcatgaagattgcgatgattcgcgccgaacagaccttggccgaggctcacgtcaagagccgtatcattctgcagattcacgatgaactggtagtggaaatcgcgccgggagaaggcgaccaggtcaccgaactggtgcgcaacgccatggaacacgccgtcgaccttgccgtgccgctggacgtatcgtgcggcatcggttccgactggcaactcgctgcacactgacaatttctagctcccctcgggtgagggggctgagccgttgagcaaacagtccagtggattgtttgtaggcgaaggcgagccgatagtcgagcaatgaagagcacgagcatggcttgtccgcaattgcagaatgagtcccttgccgcaatagcccactacaatgggacatatgccgaatctcaagcaagtcatcgacgttctcgagaccctgtacccattgcgctacgccgaagaatgggatgagccgggcctcattgtcggagatctgagccacgacgtgcaccgcatcgtgttcgccgccgacccgacctccgccatcattgacaaggccatcgctactggcgcggacctgctcatcacccatcacccgttgttcttccgttccgtacacgagacgagcggactcggtttccggggcgacatcgtccgcagactctaccagcacggctgcgggctgtgggtagggcacactaatgccgacgctgcgtatcgcggcgtgggacaggcggcggccgactacttcggactcatcgaccagaaaccactcgtgccgattgacgatgcaaacgcctctcatccggtcggcttggggcgtgtgggtcgtttgccgaagcctgttgccctgaaggatttcgctcagcgtgtattcgacgaagtgtccgatcatggcatgaccaccgcgctcggcatccaggtatgcggcgattcggacacttttgttcagtatgtggccattctgcctggctccggggactccctgttcaacgaggtgcgtgccaccggtgcggacgtgtacgtaaccagcgatttgcgtcaccacccggtgaccgacgccatcgaacaagcccggtatgaagcccgtatgaggtcccaaggcatcatgctcggccatggaatggcgggggagagccatgtgcgtccctgcttcatcaacacccctcatgccgccatcgaatccatgtggttcaactacgcgatcgatgacgtgccagccgccatcgaacaagcgaccggagcaaggcctgaagtcgagtggttccacgacacgaccgatccatggacgctgtccattaccgcgcatcgagattaagacgctatagtaacgtggcaaaaacgttttttccgaggagatgacatgtttggcggaagcaagcaggaacaactggagcatcggctcgaccataagctgaacgcctcctcggacggcatcgacatggacgtgcccgccaaagtgatcagtagcgaaaccgtttataccgggcgtatcttccatgtggacgacatgcgcatcgctctgaccgacaagcagggcaaggaacacgagatcggccgccaggtgctgcgtcacgccccctgtgtggtcatgctcgtgcacgacatgtccaccgaccgctacctcatcgaacgcgaataccgcgccggatcggacatgttcgcctacgggcttcccgccggactgatggacgagggcgaggacatcatggacgcggccctgagggaactggccgaggaaaccggcgtggtgccggaccgtgacaccatgggcgttgacttcgtaggtgatttctactcgtccgaaggcatgaccgacgaactggcccacatcatggtgttgcatttgggcccgttcaggcgggagcagcgccatttcgatgcggacgagcatgtggaatccgcgtggattccgtggagcgaccttgccgccacgcgcatcacctcatccaattcgatgatcgccatccagcatgaggcgttacgcagactcatcgccaggaactccgacaaagataagccgtcgctgttctcctgacgttcaactccccggcacatcactgacacaaaaaaagtgggatactgaaaactatgcagatcagacctggatcaatgtatccgctgggcgccagctatgacggcgccggtgtgaacttcgcgctgtactcacaggttgcgcagaaagtcgaactatgcctgttcgacgagcacgatgtggaaacacgcatcgaaatgaccgaacggaactcgtacgtatggcataactacattcccggcctccatcctggccagcgttacggctaccgcgtctacggtccctatgacccggtgcacggcctcagatgcaaccccaacaaactgctgcttgacccgtatgccaaggccattgaaggtaatatcgacggcgacgaaagcctgttctcatactggttcaagagcccggacgacaactcggcgatgaacgaccttgactcggccgcccacaccatgaagtcggccgtcatcaacccctacttcgattggggcaacgaccagcatccgtacatctcgtaccacgattcggtgatctacgaggcgcacgtgcgcggcatgaccaacctcaacatggacgtgccgccggacatccgcggcacctacgccggcctggcctatccgagcgtcatcgaatacctgaagaagctcggcatcaccgccatcgaactcatgccgatccaccagttcgtcaacgactccttcctgcaggagaagggcctgtcgaactactggggctacaacaccatcggcttcttcgcgccgcacaacgcctactcctcctccggggaacgcggcgagcaggtcaacgaattcaagtccatggtcaaggcctaccatcgcgccggcatggaagtcatcctcgacgtggtgtacaaccacaccgccgaaggcaaccatatgggccccaccctgagcttcaagggcatcgacaacgcctcctactaccgactggtggaaggcgaccagcagcactacttcgacaccaccggcactggcaactcgctgctcatgcgctcgccgcacgcgctgcagttgattaccgattcgctgcgctactgggttactgaaatgcacgtcgacggcttccgcttcgatctggccgccacgctggcacgccagttccaggaggtcgacaagctgtccgcgttcttcgacatcgtggagcaggacccgatcatctcgcgcgtcaagctcatcgccgaaccgtgggatctgggctccggcggctatcaggtgggcggcttcccgtccagctggtccgaatggaatggccgctaccgcgacaccgtgcgcgacttctggcgctcgcagccctccacgttgcccgaattcgcctcgcgcttgatgggcagctccgacctgtatcaggtcaacggccgccgaccggtggcgtccgtgaacttcatcaccgcgcatgatggtttcacaatgaacgacctggtcagctacaacgaaaagcacaacgaagccaatggcgagggcaatcgcgacggcgagagcaacaatcgctcttggaattgcggcgttgaaggcccgaccaatattccggacgtcaacgacttgcgtcagcgtcagatgcgcaacatgttcgccacgttgctgttcagccagggtatcccgatgatttgcggtggcgacgaagtggcccgcacccagcagggcaacaacaacgcctactgtcaggacaacgagatctcctggaccaactggcatcttgacaaaggacgcaaggaactgctcgccttcgtttccaaactcattcatctgcgtttggatcatccggtgttgcaccgccgtcgcttcttcaccggccgtgagcccggcgacgattcgaacacgattccgcaggtcgaatggttcgaccacaccggctcgatcatggatatggacgactggcagaacacgcatgcgttctccatgatgatctatctgaacggttcggatatcccggaggtcgactggtacggcaaccggatggtcgacaatgacttcatcctgatcttcaacgcgcattacgagccgattatgttcaccctgccggatgagcgatacggccgcaaatggcagctggtcgtggatacgcacaacccgaatgagccggcgctgagctatgaggcgggcttcatgatcaccgcccagtcccgcagcttcctcatgctcatgagcgccaaaaagcccaagaagcccatgggcctataaccagaccgaatttaagctccctctgacgagggagctcccggtgtagccgggtgagggagagaccgcagcaaagccgcgaactcctactcgcgccccttacgctcctccacgagccgagcatcgacatgatgccgaggactgcatgtcggcgctgttgccaaacctcaagcggtggcggcgtcaggatgagatcgatgcggtggcggaggggaaatgacccaaatgagcgatggcattcgactataaaaaggaataaaaaagccctacattccagtcgggagtagggcttgtggtcgggctagccggatttgaaccggcgacatcctgctcccaaagcaggcgcgctaccaaactgcgctatagcccgatacgccattaaggcacaagaaatcattataaacgacgctggatacattgcgtgtcgagcatatgaattcaaaaaggttctggattctcttgcatatgagcggcatctttattcaatgatgctctacaacgactaggtttgaatctgcatctgctatttcagtttaattcagtaacagcattcatggggatgttgcgagtcgtcacgtgttttggcataacaagcagtgctttggcccgcaagggcgaggctccaagtcgccggggggggtattccccggcattccttttcctccaacgttgtcaggagcccatttgagcgaattgagcatcttcgtggacgaatctggcgagtgaggtaagctgtccgaatactatctcatcacattggtgcttcacgtccagtccgattctgtagcggaacatattgataagtatgaacgccatctggctgattccggcttgcctgatattccattccatgtttcagattttcagtagaatggcgacagacaaatcccgctggcttgctagtaaagcgttgtcctcggggagggttttgtttgttattgaaagataacgcggcatcgaatagataggggaggtccggcatgggacgtcatcagcgcgcagaagcctccggactcatctccttcttgatttgcgccgtcgtcggcgcggtatcgatgaacctgtacatggaatacgcgccggccatctggcagctgacgcaacgccgattcatggtatgttcgggcatcgtggcggcatgcggtgtcatttccttcattattggctatgcgcgtaaatcacgttcattgaacctcaaacatggttggtttgcaccgattcgtcgcattttcgaaatcgtcgccctttcggtggtgtatgcctcgaccatcttcctgtcgtccttcgccctcatcggtgcggccaacgatatgatgggcaatgccattttctccggctatatttccagcgtctgcgccgcctttgccggcgtggtggggtacatgacctttgtacaggcggagatgatgaacgccaaaaccattgccagcctgttgccgttcttcgtcatctccggcgtggtcaccgccggcatgaccaccgacgacccatactggtatcacaacaacttttcgcagcttggtgacagaaccacgttcgcggcccgtatgttcaactccacgctgattcttgccggcacgtgcatcatcatcgtcagctacttcgccatctccgaattggtgaccaccgaacggctacagcgcctctggcacgaccgcaccaacagagatccgaatcgcggctacgaaatcccacatttcatgctgcgcatctccattctgtccttcctgctgatggtggccggcctggcattcatcggcatcggcgtgttccggtacacgccacacaatctcttgcacaatatatgcgccaaaggcctgccgttcgtcatgctgctgctgttcgtgctcctgccatggcttgcgccacgcctgtccaaaacagtgatggtggcctccgacctgaccgcgctcgtatgcgctgcattctgggtcaatatgatgatgggtcacaacaccctcaccaatgtggaggcgttggctggtctggcgttcctaggctggttcatcgtgttctcgcgccagatcgccgccatcgaggccgaccgcgtggccgcccagctgctgcacgcgcaggccatcgaaggcggactggaggaagcatccaccgagcccgcacagcagattgaatcccgcatcgccgccgaccgttgatagatatctcgttcattaggtcgatttgtcgttcatttggtaggttcggtgtcctacgccatgttgggatcgcgccatttcaaaggtgggtgcggaggctgacctaccaaatgaacgacaaatcgaccaaatgaatgacagcggacgctctgaagcctccaaatactgatagatttggccttatgactgaacaactcacgaatctctggcctgccccgctcgccacacagccgttgaacgctacggtaacggtgccgggcagcaagtccctatccaaccgctacctgattctcgccgccctcggcagcaagcccgttactctgattggcctgctgcgttcgcgcgacacggaccttatgatgggtgccctcgaagccctcggtgtccgctgcgacgtggattccgcaaccgacaccaccgtaacggttactcctcccgtatccggccgattccatggcaacgtcaatgtgttctgcggactggccggcacggtgatgcgtttcgtgcccggccttgccctgtttgcagatggcccagtgaattttgatggcgacgaacaggcttatgcacgcccgatgaagccggtgcttgacggtttggaacagctgggtgcaacggttgattaccacggcgaggttggccgtctgccgttcactattacgccgcctgcaaccttgccgtctgcccaggcgcaggtcagcatcgattcgtccggttcttcccagttcatctccggcctgttgctgattagttccaaactgcctagcggtctgcacctcgcgcacacgggggagaagaccccgagcctaccgcacattcgcatgactgtggctgatgtgaccggtgccggcggtgcggttgaggccgacgaatccgcccgcacatggacggttgaaccgcgcgcaatgcaactgccgagcaaggtgaccgttgagcccgacctgtcgaacgcggcgccattcctcggcgcggcattgatcgccggcggcacggtccgggtgcctcattggcctgagaccaccacccagccgggtggtttgttgccgggctatctggaacagatgggtgccaaagtatcgttcccgacaatcgatggcgtgcgctattgcgaggtgaccggtgacggcaccgtgcatgggctgggtacgttcgatttgacggcggccggggagattgcgccctcgttggcggcgattctggtgtttgctgataagtcgacagacatggttggtattggtcacttgcgcggccacgaaacgaatcgtctggaggcattggtcaacgagattcgtcgtgttgggggagcggctgaggaattgcctgatggattgcgtatcgaaccggtgccggcggagacgttgcacggtgccgtgatggaaacctatgctgatcaccgtatggccacgttcgccgcgatgctggggctgcgtattcccgatatcgaggtcatcaacgtggccaccacgcgcaagaccttgcctgatttcgtcggtatgtggagcggcatgctgaggcagtaaggggtcctgtgttctggtggacccccctcagtccgccggaggcgactgagggggagtatgacgcaggggtaggggtctcatgaccatatacgaatgggggctgattccaatcggaatcagccccatagtgttgcaactagagattggtgagatgcctaacggcggttacttacttggcgaaggtgttgccgtaggtgtcggtgccggcttcggcgattgcggcggacttgcgggcgatggccagctcttcgttcgtcggaatcacggcgatgatcacggaggagtccggagtggagatgatgcgcggttccttggagcgggtggcgttcttctcctcgtccagcttgacgccgaacggagcgagcttgtcgcacaccatcttgcggaccacgtcgtcgttctcgcccacgccagcggtgaaggtgatcacgtcgcagccacccatctggtaggtgtagttgccgatgtagctgacgatgcggtgcacgtagacatccagagccagcttggcgtcctcattgccctcggacaccagacggtgaacctcacgcaaatcgccatagccggtcatgcccatcatgccggaacgcttgttgaacagggcgtcaagctcgtccacgttcatgtgggcgttgcggatcaggtggaagaccacagccgggtcgatgtcaccggtacggccgcccatcatcaggccctcaagcggggtcagacccatggaggtctcaaccggcttgccggagacttcagcggaagcggaagcgccgttgccgatgtgcaaaacgatctgcttcaggccttcagccggcttgccgatgacgtccggcaccacggaggagatgtactcgtgggaggtgccgtgggcgccgtagcggcggatgtggtactgatcggcgatttccttgttcagcgcgtaggtgctggcggccttcggcagctggaagaagaaggaggaatcgaagacgaagatctgcggaacgtccggcagcagggagcgcatgacttcggcgcccttggcctccggtccgttgtgcagcggggcgagcacagccagatccttgacctggttgatggtcttgttggtcacgagggccggcttcgggaagatggagccaccctgcaccacacggtggccgacggcgacaatgccagcctcagacaggttcgggccgtactcctcgaagaagccgagcacgcgcttcagaccctgctcgtggtcgtgaatcggctcttcaagctcgtgcttttcgccgttgtactcgtgcttgtagtggccgtcgaccggctcaccgatcttctcgacgaggccggaagcgaggccttcgccggattcgagatcaaccagctggtacttgatcgagctggagccggaattgatgacaaggacggttttcgccattatgggcatcctccattgtgattgaatgttcccgtgagacacgggttaccgttgattagattactcgttgcttgctacaaaaaaggcattacggtggctcccgctggcgggagccaccgggagccaagccgggctcactgcgcttcgatggcggtgagggcgatggtgttgatgatgtcccgcaccagagcaccacgggacaggtcgtttaccggcttgttgagaccctgcagcaccgggccgatggccaaggcgccggaggagcgctgcacagctttgtagccgatgttgccggcgcacaggtccgggaagacgaacacgttgacgtgtccagccacatcgttgcccttggccttggtggcggctacggtgggggaccaagcggcgtcgaactggatggaaccgaccaccggcagatccggagccttctccttgagcagcttggtggcttcctcgaccatgtccacgtccggtcccttgccggaaccgagggtggagtaggagagcataccgaccttcgggtcgatgccgaaggcacgtgcggtctcggcggactgcagcgcgatttcggaaagctgctcggcgtccgggttgaggttgatggcgcagtcggagaacacggccacatggtccttgaagcacatgaggaatgcgccggagaccagcttctggccgggcttggtcttgatgacctgcagggccgggcgcacggtgttggcggtggagttcacggagccggagaccaggccgtcggcgtagccgagcaccacgagcatggtgccgaagtagctggcgtcggtcagctgcttgcgggcctgctcctcggtcatgcccttcttggcacgcaactcgcacagcttggcgaccatgggcttcagcacgttctcgtcgtccatagcctggaagcgggcgcgatccaagtagttcaggcccagttccttgccgcgagccagaatggcgtccttgttgcccacgatgatgaggttcacgatctcgcgctcaagcaggtagtcggccgccttgatgatgcggtcctcctcgccttcgggcagcacgatggtcttcttgttgctcttggccttgccgagcaggccgaactggaaggcgtacggggtgatgggcgcggtgacgtccacatcgagcgcggcgagcacttcatcggtgggagcgttcttacggaaggcctccagcgccagatccttggtggattcatcggtgaacggcacctgcggaagagtccagaccggcaggccgtacttggcgagggtctccttaacggagaaagcgtggcgcggctcgcatccggtcacgaagatgccgagcaccttgttgccagcggcctccatgccctcgatggacagcttgacggtctcgtcgagctcgtgcggccaacggttgatggtgcacacggctaggaacacgccggccttcagatcagcggcgacattcgcgtcgaattcatagctggtcggatcgttgacgtgggacttgtcggtgcccacgatcagggcggcgtccgcgcgggaaacgtccatggcatcgttgaacgcgccgacgatatcgccacgggcggtgttcttatcttcgcgcaccttgtgcacatcgaggccggtggacagggccacgccgagtccggcattggaggcggcgagtaggatcggggtgaattcgtcatggttggacacagcagggcggaacaccatggtcttgtacttggaagtcaatgcgttgagcatgccgtaagcgacgacgttgcggccattggcgccttcagggctggcgatatatacacgggtgacggtcacgatgtttttgtctcctttgatgatcaacacgatagggaccacacctcattgtagtggcgattactgttatcgctcacgccggtgtcgcgccaatcggaagcgtcccctttgcgacgctttccggggaatgttgcgcaaaaccccaaaagtcggccgataggccagaaaacgaaaaaggccggtgcgtgaagcaccggcctcgattgtggagctagggggattcgaacccccgaccctctccatgccatggagatgcgctaccagctgcgctatagccccgagtgaagctatccgattcatgggagtcgcaagacccgccatgaaccagcggagaaaccaccatatcgcctgacttgatggcttcgtcgtggagctagggggattcgaacccccgaccctctccatgccatggagatgcgctaccagctgcgctatagccccgttttcagttgttggcccgttgtttggacctcgtatacattacgacgagatgtcgattctggcaaaagccggcgtgtcgccaaatggcaaaagtgggatttggcgacactttttggcttgtttccgccattattcaggcattgggttattcaattactgcttgaacggtttttcgaatacactgaacctgttggctcagcaggggagccgtgacacgatcagcgttcgcgttcccactcgtcggtgtcggcgatggccggaccgtgattgtagtccagcagacgccagcgcacagtgccatcgggattgtccatcggcaccaagcgcacccagtgcgcattacgcaatgaaaccaccgtggaaaaggtcggatcgattgcagaaatgcccaacagggtctgcaatgtctgcgcaatccatgcgccgtgcgagaacacgaacaggtccgtgtcgtctccggcacgcgtggaccagtcctcaagagcctccacgccgcgcttgcccacagcttccttgggctcggctccatacttcagctcgccgccccgagactccatccaggaacggaagtcctcggggtagcgttcggccagttcggccacggcatggccatcccaatcaccgaagctgcgttcacggacgcgacgatcatcgacgggctcgattccacccaatacgtcggcgaaagcttgcgcggtggcgtgcgcacgcttcaaatcggagcagacaatgaaccggtggttgatttccggccgacgatcgacgtacaggcttttcaaggccgcggcggtctgcttgacctgccattcacccacggcgtccagcggaatgtcgacctggccttggagcttgtgagcggcgttgtaggaggtacgtccatgacggataaggaaaacggaacgaacatgattggtcatagtgacgatcctttcggttccagtgaggaaacaggaaaaagggagggctgcctggtgccgtcaatgacgttcggcaacaggcagcccgacacgcgaatatcagcgaatatcagcgaatatcagcaagtatcagcgttacgcgattcgcacgttacgcggtggtgacggcagcatcttccgcatgctccgccgtttccgggtgtgcgagttcaagatcgatggccgggcagtcgcgccagagtcgttcgagcccgtagaattcgcgcgattcctcgtgcatgacatgaaccacgaaatcaccgtagtcaagcagcacccactggccctcggtcaggccctcgcgagagcgcggctgacggccggagcacttaaggaacaggtccttttcgatttcctcggccacggccagtacctgacgctcgttggaggcgccggcgatcatcatgatgtcggtgatgccgagcaggtcggctacgtcgaaggccacgatgtcggtggccttgatacggtctgcggcctcggcggccacgcggacggcgttgatggaatcctgaagtgcgggcatggttcagcgctcccaggcgggcttccagccctcgacgttgtgctgcgtgttctcggagtagaccatcgtgtcgctcggcacggcgtggcgcaccacggagccggcgccggtggtcacgttgtcgccgacctcgaccggggccacgaacaggttgccggcgcccacatggcagccggagccgatggtggtgcgattcttgtgcacaccgtcatagttggcggtgatggtgccgccgccgatgttggtgtggtcgccgagctgggcgtcgcccacgtagctcaggtgcggcaccttggtgccgttgccgatgtgcgccttcttcatttcgacgaacgcgccggccttggcatccttgccgaactcgttgcccgggcgcaggtaggtccacgggccgatgttcgtgcgtgcgccgatgtgcgattcctgcacgcgggaacgctcgaccacggcaccttcgtccacggttgcgtcaatgagggtggtgtacgggccgacgatggcgtcctcgccgaccaccgtgtggccttgcaggaaggaaccgggcaggatggtggcgtcgcggccgatctggacatcgtcctcgatccaagtggtttccgggtcaagaatggtcacgccatcgcgcatccagcgctcgcagacgcggcggttgtaggtcttggacagcgcggccagctgcacgcggtcgttcacgccttcgacggtgagcggatccggagcagcgaacgcgccgactttgccagcggccttggcggtttccagcgcgtcggtcagatagaactcaccctgcgcgttgttcgacttcagtccggcgattgcctcggtaagcacggaagcctcgaacacgtagactgaggtgttcacttcctgcacggcgagttcgctgcggttggcgtctttctgctcgacgatgcgcagcacgttgccttcgcgatcgcggatgatgcggccgtagccggtcgggtcatcgaggatggtggtgagcacggtggcgccgttgccggaggcggtgtggaattcgaccagacggtgcagcgtctcgctgtcgagcagcggcatgtcggaggcggcgatcagcaccgggccatcgaccttgccagcctcggtgagctgcgccattgcgcactgcacggcgcggccggtaccgggaatgtcgtcctggttcacgatggtgacctgctcgtcataggagcgggcggcttcggcgacgcgctcggcctggaagtgcacgaccacggccagcgtgtcgggattcagggcggccaccgaatccatgaccctgttcaggaaggtcttgcctgcaaaagtatgcagcaccttcggcttgttggaacgcatgcgggtaccctcgccggctgcgaggacgatggctgcggataatgccataactgacgtattcccttcgatcggaatgtctattgagggtggaaacacctcaaaacaatagacggccgcccggatgtcgagcggccgtcagccgttcccccacctggactcgaaccaagacaaagggttccaaagacccgtgtgctgccattacaccatgggggagtcgtgggctttcggcccacaagtgttcatttataccatattgtcggtatttaccgaaagactacgccatgtcgcgtctcgcatcgtgtgctttccttgaacaaacacgcacgtgatcaggcgaacaggaagccttgaccgtggtgctcggggtaggtgtcgaacagttcggcgaccgagccgtcctcgaatacggcgcggatggcgctggccagcagcggggcgatcgacaggacggtcaagccatcccagcgcttttcctcgggaatcggcacggtgtcggtcagcacgacctcgcgcgcaccgcagttcttgagtcgctcgatggccgggccggagagcacgccatgcgtggcgaccacggtcaccgacttggctcccgcgtcctgcagcacgtggcatgcgcccgcgatggtaccggcggtgtcgatcaggtcatcgacaagcacgcagtccttgccggcgacgtcgccgaccacacggttggcgaccgcctggttcgggcgggtgatgtcgcgcgtcttgtgcacgaaagcgagcggaccgccgccgagacgctgcgcccactgctcggccacgcgaatgcggccggcgtcgggggagacgacggcgacgttgtcgagatggccttggaaacgatcacggatgtagtcgaccagcactggcatggccaccagatgatcgaccgggccgtcgaagaagccttgggactgcgcggcatgcagatcgaccgacatgatgcggtcggcaccggcggtcttcagcaggtcgaacaccagacggcaggagatgggctcgcggccgcggtgcttcttgtcctgacgggagtagccgagcaacgggcagaccgcagtaatggaacgggccgaggcgcgcttcaatgcgtcgatcatgatgagctgctccatgatcgccttgttgatgggtttgtagtggctttgcagcacgaacacatcggcgccacgcaccgattcggtgtagcgcacgtacatctcgccgttggcgaaatcgtatgcggtggtttcaaggacgtcgatgccgagctgctcggcgacatcctcagccaacttcggatgaatccttcccgtaacgagaataagattcttatcgggctttccttcaaggattgcgctcaccatgtctcccaacgtgtggtctcgttgatgcagtcttcagcatagccgttcttcacgaccggttggacaactcagcgttgcctgccgttcacctgccgcttgcgatccattgttcgatggcctgtttgaccgcctttgcatagatatcgctatccatgctcgggtggatgccgtcggagccgagcacctgcgcgttcgcgttggctgtggcatcccaatccaccagcaccacattgtccggatgtgcggccgcatagtcggcaagcacctggttggtaggtggaatccacgtacggtctccgtgggcattgaccagtaccagcacgcggtcggggccgatcatattacgaatctggtccaactgatcgggggtgattgccgaattggtgccaaggccgatcagcacccactgccgcagactgccggcggacagatcattgccgatgagttcgggggcgaccatgatggagcgggaaacgctcgcgtcggtctgaatgccggggaagacttccgaaaggccctgtgatgaggccagcatcaccgaatcgcctatggcggtaatctgatcgccggtgggcatctcatgcttgggcttgggcggtgccggcacggcatgtcgcagcagcacgtgttcggttttctgtatgcgttccagttgtgcggcctgttgctccagctggatctgcatggcggttttcgcaggtgcatgagcaatgccctgcacgcagccggccaacgacagcaccaggataacgtcaacggcaataacccgggccacatgattcttcttgttcgtgcgaaggggcaccacgacggataccgccgagtgcgttgccgccggtttctccaccatcagccaggaaatcatcaccgcaatggcggtgagcaacgcggtcatgatgagaggccaaggccctactgccttgaagatcttcggggcaagggcgctggaaagaatccacaacggccagtgccacaggtagatgccgtacgaatacttgccgagggaggccaatggcttgaacaccatgaggctttgcatccaggaatcgtcggagatggtaccggcaatcagcagcacggacaacaagctggacaatatgatgccaccgcggaaggcgaatgcatcctgtttgccgataaccgccatggtgaccaaggcaatcaggctgaggaacgccaataccggtgccgccgcattccagatgcgatgctccacgggaatctgaggtaacggagcccgatgtgcggctgccgaagcgctcgagctaatggtgcggggcatcggcacagccctctggcgagcgtggcccaactgaggagcggtgacccaccaggcgagagccacacccagcatcaggcccatgctgtgggtatcggtgccgaagtagacgcgggtggggtcgcctttgggcacatacatcacccacatggcgatactgctgaacgccgcgagtcccagtgggatgagtgaagacagtttcgtctggcggagcttccacatcagccagacgatgaacggcacgatgacgtagaactgcatgagcacgccaatgaaccacagatggcgaaacacctgcgggttcatttggtcgaaatagctttggcctccggcaatggcgtaccagttgtagcagcccagcagcacggtgatgacttggtcgcggatggaaactagaatgtcgtgatcgaacagccagccgacggagacgatgaccggaatcagcagaaacagcgccggatagagacgtactgcacgcttgggaatatatcgcacgagattcagcgatccggttttcgccagagaacgaatcaaactgacggcaatcaggaatccagagacggtgaagaacacgtcgactccgtagaatccgcctggcagccgttgctgcatgcagtggtacagcacaatggctatcagcgctagtcctttaataccgtctaaacccacgaaccgcttcacggataatccttctctttccgtagtgctgatggcattccccgttctctccaacaaacggaaaacaagcccagcatggccgaggggagagacaatgcgacagcagcgaatcgtcaggccgcatgctgcatgattaccggcttgacgattcgcggcataccgcgcttatcggtggcgcttaccggtgatacagactcacccgttcgtacttcggttcgcagcacacgttgatgccgagtttgcgatacagcgcctcgtccgtggatgagatgataacggagaagaaggcgtcgcagccccgcaactgtttgagcccgtcgatgacgcgagcggccacaggactggtggcgctggtgattgacaatgcaatcagcgtctcatccgagtgcaagcgtcggttcacgctgttgagatgttcggttttcagccgacagatgggttcgatggcggcatcgtcgattaccggaatggtttcgtcaacaccggtgacggccttgagcgcgtgcatcagcagcgcgctggccgcgcccaacaggtcgccggttttgccggtgaccacatggccatcgggcagcaccatggcgccagccggggcaccggtggcggcctccttctcaagagccacggcgcgggcgggagaaagatcgggggtcacgccggcccggttcatgatggagcgcagccgctccacctgttcctcgccagtgccggtgcgcttcaagtgcacggcggcggcgaagtagcggcgcacgatttccagacgcgcggcatcgcggcaggcatcgtcgtccacaatggcgtatccggccatgttgacgcccatatcggtggggctctgataggggctttcgcccatgatgcgctccatcatggccttgagcacggggaatgcttcgacgtcgcggttgtagttgacggtggtctcgccgtacgcctccagatggaaggggtcgatgatattggcatcgtcgaggtcgacggtggcagcctcgtacgcgatgttcacgggatggttcagcggaagattccagatggggaacgtctcgtatttggcatagccggcgtcgatgccgcgctggtgctcgtggtacagctgagacaggcacgtggcgagtttgccggagcccgggccgggcgcggtgaccacgacgagcggtcggctggtctcgatgtactcgttcctgccgtagccgtcatcggacacgatgcgttcgatgtcgtgcgggtatccggcgatcgggtagtgcaggcggcaggtgacgccgagttgctcgaggcggtggcggtaggcgtcggcggcgggctgattggcgtattgggtgagcactacggagccgacgaggaagccgcgggaacggaacacgtcgatgagtcgcagcacgtcctcgtcgtaggggataccgaggtcgccgcgggtcttgcctttttcgatatggttggcgttgatggcgatgacgatttccacatcgtccaccagactttccaacatgcggaacttggtgtccggctcaaagccgggcagcacgcgcgaggcgtggtagtcgtcgaagagcttgcctccgaattccagatagagtttgccgccgaattgcgcgatgcgctttctgatgttggcggcttgcagctcgatgtatttttcgttgtcgaatccctggcgcatagaggtcggcatccctttccgaacgacgtcgtaaacggaaaaattataccggacgtcgtcggcaacaaaaaatgggattccccgatggggaatcccattcgtcatagagagcaattactcccgaggaatgttgaacaggggtttgcatggctcccaaaaacgcgctggttgaaacgttgccgacgacgcgtgcgctcgaagagtatgcacgggtggctttgcggtgatttcccagaccgttcgttgctaggcgagatatttctttttccaggccttctttcgggcgtaagcgttttctgtcatgtcggagtagtcgtaatcaactttgaacttgccgttggaatggagaataagcgtcatcgatccccatctcttttcgggcttaagcgcggccctttcaggttcaatgaacttgttgatagccataaagtttttcatcaaggatgccctcgaaacgcctttttggtcaaagcatttaacgaagtcgtcttttccgctgccagcaacgtaatactcaatagagaacgcaccctcggcgtactcggcgtaaaacacgaccttgctccagtcttcggggagggtttcctcaagaattgaagctatcccttgtagcatcttcttttcactcattacatttcctttgcagtgttaagaagaaacgtaaccgtctcttcgccgtcaataatgtccgtgatagcaaacgagctaggcctgaatgacccgccctcataaagtggctcaaccttgaaaaacacttcagcgccatcagccaaagcatcggcgcatttttgctcgattgctgcataggctttttggttaacctcgccgcccatggcgacaatattctcaaggccatttgatccattgaatcggtcggcaatcagatggcctctttgatcaaaaagctcttcaaacccttttccgattgactggatagtgtccttgatggtcaaacgaccttcgtgggtctttagttgtaagaagccttcggccgattcgaccctacccattgcatcggtaacgtatttatacccattgatctcatagctcatgttcggaacgaggtcgtcgccaacgcggtaaagttgcccgagatcgtcggttgcacacttcacgccgtcgatcgcaaactcgttattgggaagcagtcggtcgccttcgtaaattgcctttccggcatcatccagaattcgtgagcttgcgcccgattctgctgcctttgaggcaagaaagttatttagacctcgtccggcaagaagcgttgctgccgtaacagttcccgcaacgacttctccgacgatatcctcctgagatatctcaccgtcttcagcgccggcttccaagctctttcccatttcgtcaagaacgagtacagacccagcagcgagtgctgcaggggcagaagcggtgacggctacggcaccaagcgcaacttcagtggcgatttcgcctccagtttcgacatagtctccgatttcccgtatctgctcatcggcttccatgaagtcgccccaggcgttggctgcatcgtcaacagcgtgtgtttgcgcggttttcaccgctgcttcttcgtcttcggccagtagttcaatattcgattcaacaccgacatatgcgttttctccaacgtcggcaactccaagtacgaacctgccgccaagataagctccgttccttgcgccatcgcggacagtttcgcctgcagcgttgagtgttggctcgcatgctttccaggcgtcatctgcggcttcttgaactgttgaaatgctcgcggttaggacatcgccggaagaaatatcccgccatgcggcatctgcacaatcagcaacggtgcgttgcgcctcctcaaaggccaatctcgtttcggtcgtatccggcattaattgctctatattttcaaacgccatttagatcaccggccttgtttgagataagaccgctgatacttcggcgagtgctgaggccttttccgttgtctcgatgccggtacccctctttctcagctcgttgagatgagcgttaagcatcgactgaatgaacaggtattggattggtccccagctttcgggtgaggagtcatcttcgaatttccagcttgaaagcagatgggagcaaagcctctctttgaggctgtcggcagataaatccctggcgtcgtcgaggatgcgtccaatattgaaatacctataagcacaccattcaaacagtggcttcctcgaggacagaggagtccttgccatctcaatcaagcgtgccttcatggagtcaggtatgtccatcttgtgcacacagtcgcagaagttgtattcccttggctcatcgagcttgaacggattaagcacacaagagttgagatagcgaagctcttcagaagaagccttgtccttcgcgctgtgcttgctctgtgtcggcgagtactctaggccgcgttcatgcggttcgatgtgacagaggacaggttcgatccattcgttctgatatattgctgcaacgcctcgctgaagctttgcaagctcttggatttggctctcgttaagatttgccgccttgccgataagcatcctgtcgccttcgtcaggcagtttccaggataagtcgatgcgatgattctgcctcaagcccagcgggttgttaaggcgcggtcattttggcgcttacatctcacttttgcagacgtagaatacgagtattggaatcaaaggagggttctcatgccaaatatcggtaaggacgaccatccgaagctgtggtcgcttattttcgtgcttatcatcgcgctgaccttctgttgcttcgtcatgggccaaggactcaacagtggaaccagcgtcttcctggcaggccaaggttacggtgcgagccttgccggcgtacttgcctcgtcttctccattgccgccgcgttagcacgactgttcgtcggccctgttatcgacaacggcaagtgctcactcgttatcatcgccggcatcgctatcctcatagcaggaacagcactgtccgctgtcgttcaaggcatccccctcttcacaatcagccgtttgctgcaaggcgtgggctttggcgcagcaacaacagcagcctcgaccgccgcagcaagcgtcttaccgcaagaacggctcggcgaaggcattggataccacggcctcggacaggctatcgccatgagcatcggcccagccttcgcactttacctagtaggaaccgatccctcaacgaacctctatgtcggccttgccctggttgggtttgcagggcttgtaatcgccctcaacgcacgctatgaaagtaaatggcaaactctgccaagctccagcgcataccgaatcaaaatggaaacccggctcgaactcgactcaaaagacgggcaggcacccagccccaccacagtaactacatccgaaacaattaacagtgaaaagtatcctgaaggcgaccaggtgtccaagagaaccctgcgtgactcattcaacatcttcgagccgcgcgcattgcctggcgccatcccacagatgatcatgtgccccacttttggctttggcgtcttctttgctggtctgtacggtactactctcggctatacccacgccggtctcttctacaccatcagcgcggtaagcatgattatcattcgcatgatttcaaagcatttcatggacaccgtacctgcaatcaaaacaatgaccggagccgtcgcgtgcggcatcctctgctgccttatgctacttgccgcaccgtacggggaacctgtcttcctggcgtccggaatcttctatggtctcgccactggcataagcctgccacttaatcaaagcgtagcggtaaagaacaccccgccagagcgctggggcgccgcaaacgccctgttcctgctcgccaatgacatcggcattggcttcgcaagcgtaatctggggcgttatcaatgactcattcgggttccagacaagcatcgtctgcgtcattgtctgccttatcgcaagctacgcatccgcctggatcgtctaccccgcccgcgacaagcggtggaggcattagagcgtaagcgtcaaaatgaccgcgtagcaggaaacgtccaggaccattccggcatacggatggaaaagtcctggacgtttccatctttgcgttgcggtatgccttaggccgctatgtcgctacaggccctcctcggcgttgttcgccatctcgtcgtcgaacgcatcggggtcgatgttaattatgaagtcgtcaggcatctctttggccttctcggcagcggctgggtcgagcttgcaggactcaggcaccctatccgaccacggcaggaacgagtccacaacctcatcggtgagctcgccggcgttgggcatctcggtcagcagccactcgacgtaaagcctgggattgagcccgttggccttggccgtggtggtgacgctgtatatcgccgcagacgcccgcgcgccgcgcggcgcatcgctgaagagccagttcttgcgccctacgacgaagattcgctgggcctgctcggcgacgttgttcgagagctccaggtgccccgtcttcgagcacgttcatgacgtagggccagaactccacagcgtactgcagcgcacggtgcggcgccagcttcggcgaggctaggggaagctgggcccgcgcccatcccccgaagtcctccatgagcgggcggagctccgcgtcgcgggcggccttcctgccgcccggctccatgtcgtcgaacttggagtcgaccttgaacatggcgtcgatcctgcgccttgcctcgagcgcaacgctggccgcagacgccgccttggcgtcgccgccggcgatcttcacgatttgggcgaagtagcggcgcacgtggacgaggcacgccgtgttggcgatgttggggttgccgagattgaagtagggtttgtagccgttggcggtaagcgtgccggaccagcccgcaagaaactcctgggcaacgcccttcctgcgggtctcgtggtattcgaatacatacacgggcacgttgcagcgcgccgagcagaacagccacatcctcgatttcttcttcgcctcgcggttcggctctttcaggacctgaaccgtggtctcatcggcatgaatcctgacatgcgacagcagctcgaccttcattctctcatggaccttcgccagccagcgcgcgtgcacgttcatcatccagttcgccattcctggcgcgatatcgtcgcgccgcacgccttgaggtctgtctctatgcggtagagcggcagcgacatgacgtacttgccgttgacgatccaggcaagcagcgacggcgtcgcaaacgagcctggtatcggcggctcaggctgcggtgctcgcacgatgacgcccttgcgttcctattgagtttcacttgagtttcaggggcgtttttggggtggtgggacaaactactgggacagttcactctccgaaaaatcctttactcttcgtccgctgcgtgtcgccatgtccgtggtgtacgcgcttttagagtaaaaatgactgaaactgcaggtcaaaaggcataaagagaccccctgaaaacgttgtttccagagggtctcaatagtttttactcacccaaaatcacaggtggctttacgctttttcgtacgtggcggcacactgcgacactctacggacggaatttcgattgcgcaaaatccgctccagtttactcccactcgccaaagtaaaactggttctaaacaatactgtttaggggatttgactcttagttgctcaatttgataccaattatccaacttatacggcgttgtcggactcctgttatcaaaagattatcaagcccaatgttatcagcagaaaagcaatggtttggatcatctgtattataccacaagcagagtgctatttcaatcaaataagggactgcttcaactgtagaatccgtttttcaatctctcgaatgatctcgacaaagacttgatcttcgcttccggtcggatcttctaatccccagttatcgtcaaatgctctaccaatgaaaggacagcccacattgcaccccatggagattgcaatatcaggggcaggaatatccgagatcagtttggaatactgggttttctccatgtcaatcccgtacagttctttcataatgcggacagcatcctgattgatttgcggttttgtttccgttcctgcggaatagctttcaaacacatcggaagccaagtgctttcccaaggcctcggcaatctgactgcggcaggaattatggacgcagataaatgccacctttttcttactcatatttgaaccagtctttcgttttatttgcgtttttttacaaggaacagcatcacgggaacttctgtcagcacacccacagtcgttgccagtgccgcaggggaagtcgttccaaacaaggcgattgcaacagcaacagccagttcaaagaagttggaagcacaaatcattccggcgggagcagcaatcttgtagggcagcttcaaaacccggcaagcgatatacgcaatcgcaaaaatcaggaaggtctgtaaaatcagcggtaccgcaatcaaaacaatgtgcagaggtttttccagaatggtattgccttggaacgagaaaatcatcaccagcgtcagcaataagccaatggtagttacactgtcaaacatatggatgaaagtctcctcaaagtacactgccccttccgcttgatgacagccgaacgggtcagcataccgccagccagaggaaacaccacaaacagtaccacagagagaatcagggtatcccacggaacgggaacattggaacgcccagcaaaaaatgcccgttgagttcgatttgagtttcacgggccccgaaacggccccgtttcgccctcggggacaaaaaccgcgcgtcaactcacttgggataaatccttactcccattccctcgaatacctccccgtgccttgttgtcttgaaacacggggagtaaatggcgaaatcgcaggtgaaagggagtaaaacggcaaagaaaaagcctccgttccaacgagggaacggaggctaggaaatcgtttttactcactgccgtcgctggcggttttgccatgactctcgtacgaaacgaaactcagcggtacaccacggcactcaaaagagcaggtcaaagccctatcggcttactcccattcgatggtcgccggcggcttggaggtgcaatcgaggacgacgcggttgatctggcggcattcgttggtgatgcgcgtggagatcgtggcgagcacatcgtaggggacacgggaccagtcggcggtcatggcgtcttccgagctgaccgggcgcaggacgatcggcgagccgtaggtgcgctcgtcgccttggacgccgacagagtgaacgtcagccagaagcacgaccgggcactgccagatgtcgcggtcgagaccggccttggagagttcctcgcgggcgatggcgtcggcctcgcgcagcaggtcgaggcgctccttggtgatctcgccgatgatgcggatgcccagacccgggcccgggaagggctgacgccagacgatttcgtcgggcagaccgagctcggtgccgatggcgcgcacctcatccttgaacagagtgcgcagcggttcgatgagctggaacttgatgtcctcgggcaggccgccgacgttgtggtggctcttgatgttggccgcgccgtcgccgccgccggattcgacgacgtcggggtagagcgtgccctgcacgaggaacttgacctccttgccgcgggcgccggcctcttcgaggacctggcgctgggccttctcgaaggtgcggatgaacttctcgccgatgatcttgcgcttgcgctccggctcggagacgcctgcgagggcgtcgaggaagtcgtcggcggcgtcgacggtgatgaggcggatgccggtcgcggcgacgaagtcgtgcttgacctgctcgacttcgcccttgcgcagcaggccgtggtccacgaacacgcaggtgagctggtcgccgatggccttgtgtaccagagcggcggccacggcggaatcaacgccgccggacaggccgcagatcacctcggcgtcgccgacctgctcgcggatcttcttgacttgatcctcgataatcgaggaggcatcccagtcgttgggcagcgcggcgcaacggtgcaggaagttttcgataagcttctggccaagcggggagtgcttgacttccgggtgccactgcacaccatagagcttgcgggattcgtccgccatggcggccacgggcgcgccttcggtgtgggccagcacttcgaagccggccggggcctgttcgaccgccacaccgtggctcatccacgtggtctgctcggcgggggagtcggcgaggatgccggcggcgtcgtcgatggtggctgaggtcttgccgtattcgccgagcgcggccttatccaccttgccgccgagctcataggccatgacctggaagccgtagcagataccaagcaccggaacaccggattcgaataccttggtgtctatggtcggcgcgccgggctcgaacacggaggccgggccgccagacagaataatcgccttcggatccttggccaggatctcgtcgaccggcatggaatgagggaccagctcggagtacacgcctgcttcgcgcacgcggcgggcgatgagctgggcgtactgggcgccgaagtcgacgacaagcacaggaccgtttgccattgatattcccctaacgttcattggaattttacgtgggctgaacacccctgattatcactggtcaaggcgacaaggccgacacgcagagactatgtgcgcaaatcgaacaaactacatgcctgtagacggacaacacgccgatttcgaacatgggaaatcgaacgtgcgctgttctagccaaatgctggatttccgcatgcttccgccgttttgaaaaagtatgttgaaaaaactaatgttgacaaacggtcagtcgaaccgcacaaatactgaaatatccgcaacaatttcgaacacacccgcaagaaatcgttcaaaagtcgcgttgtcctcgtaccatgacgattgattgggaacggaaaaccttggcaccgcaagggtcagggaccgtgaccgaacagaaataatcaatcgcacgatcacgtgcaggagtacaggagtacacatgacgagtcctgttattggcaccccttggaagaagctcaacgctccggtttccgaggaagccctcgaaggcgttgacaagtactggcgcgttgccaactacctttccatcggccagatttatctgcgttccaacccgctgatgaaggagcccttcacccgcgaagatgtgaagcaccgtctggtgggccactggggcactacccctggcctgaacttcctcatcggccacatcaaccgtttcattgctgaccacggccagaacaccgtgatcatcatgggcccgggccacggtggcccggccggtacctcccagtcctacctggacggcacctacaccgagaccttcccgaagatcaccaaggacgaagctggtctgcagaagttcttccgtcagttctcttacccgggcggcattccgtcccacttcgctccggagaccccgggctccatccacgagggtggtgagctgggttacgctctgtcccacgcttacggcgccatcatggacaacccgagcctgtttgtcccggccatcgtcggcgacggcgaggctgagaccggcccgctggctaccggctggcagtccaacaagctcgtgaacccgcgcaccgacggtatcgtgctgccgatcctgcacctcaacggctacaagatcgccaacccgaccatcctgtcccgcatctccgacgaagagctccacgagttcttccacggcatgggttacgagccctacgagttcgtcgctggcttcgatgatgaggaccacatgtccatccaccgtcgcttcgccgagctgtgggagaccatctgggacgagatctgcgacatcaaggccaccgctcagaccgacaacgtgcaccgtccgttctacccgatgctgatcttccgcaccccgaagggctggacctgcccgaagtacatcgacggcaagaagaccgagggctcctggcgttcccaccaggtgccgctggcttccgcccgcgacaccgaggcccacttcgaggttctcaagaactggctcgagtcctacaagccggaagagctgttcgacgccaacggtgctgtcaaggacgacgtccttgccttcatgccgaagggcgagctgcgtatcggtgccaacccgaacgccaacggtggtgtgatccgcaacgacctgaagctgccgaacctcgaggactacgaggtcaaggaagtggctgagtacggccacggctggggccagctcgaggccacccgtaccctgggtgcctacactcgcgacatcatcaagaacaacccgcgcgacttccgcatcttcggaccggatgagaccgcttccaaccgtctgcaggcttcctacgaagtcaccaacaagcagtgggatgccggctacatctccgacgaggtcgacgagcacatgcacgtctccggccaggtcgttgagcagctgtccgagcaccagatggaaggcttcctcgaggcctacctgctgaccggtcgtcacggcatctggagctcctacgagtccttcgtccacgtgatcgactccatgctgaaccagcacgccaagtggcttgaggctaccgtccgcgagattccgtggcgcaagccgatcgcctccatgaacctgctggtctcctcccatgtttggcgtcaggaccacaacggcttctcccaccaggatccgggtgtcacctccgtcctgctgaacaagtgcttccacaacgaccacgtcatcggcatctacttcgccaccgatgcgaacatgctgctggccatcgccgagaagtgctacaagtccaccaacaagatcaacgccatcatcgctggtaagcagcctgctgccacctggctgaccctggacgaggctcgtgccgagctcgagaagggtgccgccgcttgggattgggcttccaccgccaagaacaacgatgaggccgaggtcgtgcttgccgccgccggcgatgtcccgactcaggagatcatggctgcttccgacaagctgaaggaactgggcgtcaagttcaaggttgtgaacgttgccgacctgctctccctgcagtccgccaaggagaacgacgaggctctgaccgacgaggagttcgccgacatcttcaccgccgacaagccggtgctgttcgcgtaccactcctacgctcacgacgtgcgtggcctgatctacgaccgtccgaaccacgacaacttcaacgtccacggctacgaggaggagggctccaccaccaccccgtacgacatggttcgtgtcaaccgcatcgaccgctacgagctgaccgctgaggctctgcgcatgatcgacgccgacaagtacgccgacaagatcgacgagctcgagaagttccgtgatgaggccttccagttcgccgtcgacaacggctacgaccacccggactacaccgactgggtgtactccggcgtgaacaccgacaagaagggtgccgtcaccgctaccgccgctaccgctggcgacaacgagtgataacacctccacggtgttgttagttcgctaacaccaaagggctcgggattcgtcccgagccctttgcttattcataagccctgtcacggcggggcagaacaaagcgaactgttgtgatgttttaatcgcgtagcaccctgaaatgcagcagggcattgcgcacaccgtcgtggtccacatcgtcagtgatgtagtcggcggcggccttgggctcggcggtcgcattgcccatcgcgaccccgatgccggcgtaggcgagcatatccgtgtcattgccgccatcgccgaaggccatggtctgctcgcgcgtgatgccgtaatgcgccatgaaccgctggatgccgcgcggcttgccgccatcggccggaatcagatccgtgaaatccggatgccaacgcaccccgcgcacattgctgcacagtcccaccagttcggcctccagctcgggcccgacaaagggactgatctggaaagtctcatgatccagcgcgcgggtgcgcgggtcctcgaaataccgggtcggtgcggttttgcccagtttgctccacgtggcgcgaagcagatcattggactggttgaagtacacgtaatccttctcgccgaaattgcacaccacatcggggtgacggtccagccagtcgagaatcacctcaatatcagcagtatccaaggcctgcgaggcaaagaagccggtgtcatcaaaacaatactgcccattgaacgccaccacgccatcgaacgtcaccggcatggtatccagcaccacgtgcatctgtgaaggcgcgcggcccgtgcaaatcagcaccttgacgcctgcggcctgcagccggtgaatcgcctcgattgtggaatccggcaccgtatgggtcgtgaaactggtgagcgtgccatcgatatcgaagaatacggctcggatatcggcattggcagtatcggtagtcatagcttccattgtcaaagcccctctcgacgtgctttccggcgtgttcggcacgcctatagcgggttatcaaacgcacgaatcccggacattgcatgcgcgccataaaagacacctatatggcaatcggccattttccgtcactttcgcggttcaagcgcgttatggtgttacccgacatcaattttggagagaggaaatccaatgacagcagcaacccagccggcaaccccggccgctcctaacaataacgagccggtgcgtgtgaaccacaccgcccgcaacgtcatcatcaccatcgtggtcgtggcgattatcgccgtagccgcgttcttcggctaccgcgcgtttgccggtgccaacgagtcgtccgccaagggcagcaagggcaacccggtcaagatcggcgtggtcggcgctaccaaccccgaatgggtcaagttcaagcaggacgccgagaaggccggcatctacgtcgacatcgtcgacttccaggactacacctccgaaaacccggcccttgactccggcgagctggacctcaacgaattccagcacctgctctacttggccaactacaacgtgagcaacaagaaggacctgcagcccatcggcggcaccgccatctacccgctcggcgtgtactccaccaaggtcaaggacatcaaggacctgaagcagggcgacaccgtcaccattccgaacgacgaaaccaaccaggcccgcgctatcggcgtgctcaaggccgccggtctcgtgacgctcaagggcgactggaccgccttctccaccccggcctacatcgacgaagccaagagcaaggtcaaggtcaccccgctcaaggccgaacaggtggccaccaccctgaaggacccgaccatcgccgctggtgtgatcaacaacgactacgtggccgatgccggtctcgacccgaaggacgccatctaccaggatgacgccgaatccgaagaggctcgcccctacatcaacgtgtgggtggcccgcaaggcggacgtgaacaacgagacctacaagaagctcgtttccatctaccagcggaaggatgtgctcgacgccctgcaggagaactccggcggtaccgcggtgttcgccgacaagttcagcgccagcgagctgcaaggcttcctgtccgacattgagaaggatgccaaggcccagcagtgagccgcggctgatacgagcgcacgactagcctgtccatagccattaccaccaagcggagcgagtacccgagccaacaatcgggattcgctccgcttccgtgaccggacaccaacaaccagcatcagggagcactatgagcgaccccatcatcaccttcgaccatgtcgtgaaggaattcaaaacacgcggacgcggcgcgaacatcgcacgagccgtggatgacgtcagcctgaccatcgatcgcggtgacatcttcggcatcatcggctattccggtgcaggcaaatccacactggtccggcttatcaacgcgctcgaacgacccacctccggcactgtgaccgtgcttggtactgatatcacctctctgagtgagaccaagctgcggcccatccgccagaaaatcggcatgattttccagcagttcaacctgttctccaccaaaaccgtggcccagaacatcgcctacccactgcaactcgatcactggcgcaaggactatcaggatcgtcgtgtcaacgaactccttgaattcgtgggcctcagtgagcacgcaaacaaatacccttcgcagctgtccggcggccagaagcagcgcgtcggcatcgcccgcgcactggccactaatccggagattctgctcgccgacgaagccaccagcgcgctcgacccggaaaccaccaccgaagtgctggccttgctcaagcgtgtgaacgaggaattcggcatcaccattgtgcttatcacccatcagatgaacgtggtccagcagattgccggccgcgtggccgtaatgagcgccggacgcgtggtcaaatccggcgacgtatacgatgtgttcgctgcaccccagcagccggtgaccaagcgattcattgccaccgcattgtctggcctgcccgaggaagaccgggtcgagcgattgcatcacgaatggtcgggccgcattgtcaccgtgcttatccgccaaaaggacgtttccggcacccaaggccatgaactcaaggcatccggacagaatatctccgaactcatcgccaaatacggcgtcgaatccagcctgctctacggcggcatcgacacggtcaaggggaccgccatcggtgccatcacctacgaattcaacgggcccggctggcatgtggacgaattcctgcgcgagctcgccgccaatagcgacgtcatcgacttcggcaccgccgcaaagcctgtggcctacgccgacgcagtcgccggacatgcctcctacgccgaagaccgcgcccatgacccactggcggccgatactgccaccgcgcccgccgcgtccgccgccgcacatgaaggagccaacgcatgatcatcctcgccaacccgcgtagcgactggaacgtgctgcgtccactactgttcgaatccattggccagaccctgaccatggtgctcgtcaccctcgtcatcggcggattcctcggcctgatcctcggcgtggtgctctatggcacccgccccggcaacctgttcgagaacgcggtcgtctaccgcatccttgacatcatcgtcaacatcgtgcgcccgattccgttcatcatcttcctggcagccatgcagccgctcaccatcgtcgtggtcggcacgtccatcggcaccgtggccgccatcttcccgatggtggtgatgtgcaccttcgccacctcgcgtctggtcgaacagaatctcgtgccggtcgacccgggagtaatcgaggccgcgcgttcgatgggtgccggcaagctcaccatcatccgcaccgtgctcatccccgaagccctggcaccgctgatcctggcctacgccttcctgttcattggcgtgctcgacatgtctgccatggccggctacatcggcggtggcggtctcggtaacttcgccatcgcctacggctaccagaagttcgaccagaccgtcacctggacggccgtgatcatcatgatcgtactggtccaggtggtgcagggcatcgccaacgccatcgccaaacgactgctcaaacgccagcaataacaaggcatactgaccccatagatcgcggccctcgccaatatggagcgagggccgcaatatattcttcgcgctactagaatcgggaaccatgagtgaacatatcgacatcgaccacgaactcatcactatccgccactacctgcacgcccatccggagcgtagtttccgtgaattcggcaccagcatctatctgaccgaccagctcaaggcgcacggcatcgagatcctgcacaacccgctggagactggtgttgtggggctcattcagggcgaggccggtcccgggccgcgtatcgggctgcgcgctgacatcgacggcctgcccatcgtggaagactccggactggagttcagctccgtcaatgaaggcgtgatgcacggctgcggccacgacctgcacatgaccggtctgctcggtgccgccttctggctcgccgagcaccgtgacaagttcgccggctcgatcaagattctgttccagccgagtgaggagaccggccaaggcgctcgcgccatgatcgacgccggactcgtggatgacgtcgaagccattatcggcacgcacaacaaccccaactatgcgcccggccagctggccatcggcgttgagccgatgatggccggctgcgtgaaattccgcgtgaccctccacgcccaaggcacccacgccggttacccgtacaagggcaccgggcccatcgaagcgctcgccagtattattctgagcctgcagaccatcgtgagccgcaacgtcacgcccttccacccgctggtgctgtccgttaccgaagtgcacggcggccatgtgtggaacgtggtgcccgccgaagccggattccaagggactgtgcgctatttccacaagtcggatggcaatctggtcggccgccgattcaaggaagtggtggaacacaccgccgaggcatacggcatcagcgccgacgtggtctgggatgactttcaagacccgctggtctccgatccaggtctcgccaaggccgtggcggcggatgtcaacgactacgcgcagctcgaaccgatacgtcagtcgatggcgggggaggacttctgcgaattcgccaaggtgacgttgccggtgttcgcgttcgtcgggtcaaacggccaggaaggttgcgccgactggcatagcccgcatttcgtgggtctcgacgaatccattcccaccttcgtcaacttctacgtcaacaccgctctgcgcgtgctcaacgagctgaagtaaatccttttctggctcgcctccggaggctgaggcgttaggcagacagcccagtgggctgtctgtagccgaaggtgaggcgacagccgaaccagatatgcgcgggcctcgcccgtccataagtgcaggacgagctatcagcgaagctgactgaggggagtggcattcgttcattaggtcgattcatcgtccattaggtcggtgaacggcgatactggttgttggaatcgcgccattgcaacgactgatatcgcattgcagtgacctaatgaacgcaaaaacgacctaatgaatgacgccaagccggaagaacaggcaatccgacgtcatacgcggctacactaagaatctatgacacagcttcgcttcgcactcgcccagatcgacacctgcgtcggcgcgcttgacgccaacgccgccaaggtgctcgactactcccgtaaagccgccgcaggaaacgcccaagtggttgttttcccggaaatgaccctcaccggataccccatcgaggatctggccctgcgccgcaccttccgccaagccgcatgggacaaggccaacgaactcgccacccagctcaacgacgacggcctcggcgatctgttcgtggtggtcggcaccgtgggcaccgaccgcaagacctccaagccgcgcaaccgactggtggtcttgcaccaaggcgtggtctgggctggctacgacaagcacttcctgcccaactacggcgtgttcgacgaattccgcatcttctccgccggcgaccgctccgtgaccctcgacgtggacggcgccaccattggcgtggccatctgcgaggacatctggcaggacggcggaccggtggccgacctggccaccaagaacatcgacctgctgctcaccatcaacggctcgccgtatgaggaaggcaagaccaacacccgtttcgagctcgcccagcgtcgtgccgccgaggttaacgccccggtcatctacctgaatcaggtcggcggtcaagacgacctcgtcttcgacggcggcagcttcgtggtcgacgccgacggcacgcttatcgaacgcagcccgatgttcatggaaaacctgacgttctgggacttcgattccgccgccgaacatcaggccaaggccgagatcgttccggaactcggcccggacgaagaggtatacaccgcctgcgtgctcggcctcaaggactacatggccaagaaccacttcaccggcgtgacgctgggcctctcaggaggcatcgactccgcactggtagccgccatggcggccgacgcatgcggcggcgagaacgtctggggcatctccatgccctccatgtactcctccgacggttccaaagacgacgccgccgatttggcctccaacattggcgcccattacgaggtccagcccattgagccattgttcaacgcctaccaacagcaacttgaccttgatggcgtctccgccgagaacctgcaggcccgcatccgcggtgtgatcgtgatggccagctccaattcgcgcggtctgctcgccgtggccaccggcaacaagtcagagctcgcctgcggctactcgaccatctacggcgatgcggtaggcggctacgcacccatcaaggacctgctcaagacccgtgtctgggagatcagccgttggcgtaacaaggccgcggccgcaggcgtcggcatcggcggtctcaagatcgcgggcaacgaggacggcaacaccggcatcccgttgaaggacggcgtgatgattccggtctcctccatcgagaaggcaccctcggccgagttgcgccccgggcagaaggactccgactccctgcccgaatacgcgctgctcgacaaggtgctcgccgcatacatcgagcacgcgcacggccgcgccgacctgttagccgacggcttcgaccaggtcaccgtagacaccgtgatgcgattggtggaccgcgccgaatggaagcgccgccaatacccgctgggaccgaaggtcacggccctcgcgttcggccgcgaccgccgactgcccgtcaccaacgcattcagggaataaacatatattgctcccgccagcgggagcaagtaataccgttgaggaggtaccaatgacagacgataacaagaagcagtggtatttcaacaccgtcaagaagcaggccgagttgggcatggtctcaccgatcgaacagcgcatgggtccgtacaagaccaaggaagacgccgaacatgcgtgggacatcgtggtggaccgcaatgccagatgggaggaggagaaccggcgctggaagaactacggcgtgaaacccgcacaggctcgccccgaggattgacggtcgaaaactgacggatacggttctgctgtcaatctcaagaccgaaccgctcatacgaacatcacagtatgagcggtttcccatatctggagacgtgcaatagtcccatcaatatctagaagccattggaatggtagcgttcacagaaacaatgtgagatagctcactcccaatttcagcttttctcaagcaagtgccaactacactgttgaaccaagggttccgtgaagatgcgaaacctacaaccccatttaaggagtgacatgaccgcagtggaaaatgcagctgtctcccaggaggagctcgacgccaaggcgtgggccggcttcaccgagggcaactggcagaaggatattgacgtccgcgacttcatccagaagaactacaccccgtacgagggcgacgagacattcctggctcctgccaccgagaagaccaagcacctgtggaagtacctcgacgacaactacctggccgtggagcgcaagcagcgcgtctacgacgtggacacccataccccggccgacgtcgacgccttcccggccggctacatcgactccccggaagtcgataacgtggtcgttggcctccagaccgacgttccctgcaagcgcgcgatgatgccgaacggtggctggcgcatggtcgagcaggccatcaaggaagccggcaaggaaccggatccggagatcaagaagatcttcaccaagtaccgcaagacccacaacgacggcgtcttcggcgtgtacaccaagcagatcaaggtcgcccgccacaacaagatcctcaccggtctgccggacgcctacggccgtggccgcatcatcggcgactaccgccgcgtcgccctgtacggcgtgaacaagctcatcgccttcaagaagcgcgacaaggactccgtgccgtaccgcaacgacttcaccgagccggagatcgagcactggatccgcttccgtgaggagcacgacgagcagatcaaggctctgaagaagctcatcaacctcggcaacgagtacggcctcgacctgtcccgcccggcccagaccgcgcaggaagccgtgcagtggacctacatgggctacctggcctccatcaagtcccaggacggcgccgccatgtccttcggccgcaactccgccttcctcgactgctacatcgagcgcgacctccaggccggcaagatcaccgagaccgacgcccaggagctcatcgacaacatcgtcatgaagctgcgcatcgtgcgcttcctgcgtaccaaggactacgattcgatcttctccggcgacccgtactgggcgacctggtccgacgccggcttcggcgatgacggccgttcgatggtcaccaagacctcgttccgtctgctcaacaccctgaccctcgagcacctcggacctggccccgagccgaacatcaccatcttctgggatccgaagctgcctgaggcctacaagcgcttctgcgccaagatctccatcgacacctcggccatccagtacgagtccgacaaggaaattcgtagccactggggcgacgacgctgccatcgcatgctgcgtctccccgatgcgcgtgggcaagcagatgcagttcttcgccgcccgcgtgaactccgccaaggccctgctgtacgccatcaacggcggccgcgacgagatgaccggcatgcaggtcatcgacaagggcgtgatcgagccgattaccccggaggccgacggcaccctcgattacgagaaggtcaagaacaactacgagaaggccctcgaatggctgtccgagacctacgtcatggccctgaacatcatccactacatgcacgataagtacgcgtacgagtccatcgagatggccctgcacgacaaggaagtgtaccgcaccctcggctgcggcatgtccggtctgtccatcgccgccgactccctcgccgccgtcaagtacgccaaggtctacccgatctacaacaaggacgcgaagaccctggaaggccacgagtacgagtacgttgagggcgccgatgacgatctggtcgtcggctaccgcaccgagggcgagttcccggtctacggcaacgacgacgaccgcgccgacgacatcgccaagtgggttgtctccaccgtgatgggccaggtcaagcgcctgcccgtctaccgtggcgccgtcccgacccagtccatcctgacgatcacctccaacgtcgagtacggcaagaacaccggttccttcccgtcccgccacaagaagggcaccccgtacgccccgggcgccaacccggagaacggcatggactcgcacggcatgctgccgtccatgttctccgtcggcaagatcgactacaacgacgccctcgacggcatctcgctgaccaacaccatcacccccgatggcctgggccgcgacgaggacgagcgcatcggcaacctggtcggcatcctggacgccggcaacggccacggcctctaccacgcgaacatcaacgttctgcgccgcgagaccatggaggacgccgtcgagcaccccgagaagtacccgcacctgaccgtgcgcgtctccggctacgcggtgaacttcgtcaagctcaccaaggagcagcagctcgacgtcatctcccgtaccttccaccaaggtgccgtcgtcgactgatgaccaaccccgcgaaccgcggcaatgactaactgaaggggtggggcacggctccaccccttccttatttcccacagaccttcgcatcatttggaacaggaggacaacgatgcccgcaacacccacgttccgcaccacgaccaggcatatgctcaaggaatcgaagacctatgcctcgcagactttgatgggcggcctttccggctttgaatccccaatcggactcgaccgacgtgaccgcctttccgccctgaaatccggcgatatcggcttcgtccactcttgggacatcaacacctccgtggacggaccgggcacccgcatgaccgtgttcatgtccggctgcccgctgcgctgccagtactgccagaacccggacacttggaagatgcgcgacggcaagcccgtctaccttgacgccatgatcaagaaggtcgatcgttacaaggacctgttcaaggccacgcatggcggtatcaccttctccggcggcgaatccatgatgcagcccgccttcgtctcgcgtgtgttccatgccgccaaggagatgggcgtgcacacctgcctcgatacgtccggcttcctcaacacgaattacaccgacgagatgctcgaggacatcgacctgtgtctgctcgacgtcaaatccggcgacgaggagacctatcacaaggtcaccggcggcaccttgcagcccaccatcgattttggccagcgactggccaaggccggcaagaagatctgggtgcgatttgtgctcgtgccgggcctgaccgactccgaagagaacgtcgaaaacgtggcgaagatctgcgagtccttcggtgatgccgtcgaacacatcgacgtgctgggattccaccagcttggccgcccgaagtggcacgaactgcgcatcccatacccgctggagaaccagaagggacccaacgccgccacccgcgaacgggtgaccaaccagttcaaggaccacggcttcaccgtgtattaaattgcagggccgaaccgcgcgtaaataccacgattcggcccgttcgcccataccctagagatatggccgacatctacgcatttcctacgggagagtccaacgacggacgccccgtgcgccctcagggtgtgccggatgaagtatgggcagccgtcgaatccgtcagcaccatgaagcgcatccatgacgtgcgctatcgggagattcccgtgccttccaccttggccgattatggtatcggcgtggaattcgaagcgggagagcgtgccctcggcgatgccttttccgccggtcttggcagcgatgccgaatcacgaatcgccacaggctggatcatgatgctttatgctcatgagctgcgcattgactgggattccaactggcgttgcgtggcgttcgcgcgactgccgctggaaaccgccgaaaacgattctctgacccccggcatgtactgggatgacatgtgcgactatttcgacggcatcgagccggattcggtatccggcacagtcaccgtgacccaaaacacggcttttggctcgatggccggctccaccagcgccgggtgtgagattcgcgtctcatggaccccgcttgacgggaccgggccggacggtactatggacgccggcgcacaagtccgctcgtgggccgcattcatcagatccaccatccgttttgaggaggatgacgccagttgagtgacgtccgtgacaccgaaccccgactgctgaaagagcctcgcgggggagtacccgatgtcacttcgacgctggacggctatcatcgtgtctgcgatgcgatggccgaggcgacgggctcgctggccgccgacgccgaacgggcgtccggcttccgctatggacacgaggattggctgattcagttcaaacgtgagggtgcaggcatcgccttgcttgatcccgtcgccctgacccgggccggagctgattggaatgaattcaatgacgccgtgggcgacgccacgtggattctgcatgattctctgatggacttgcccggattcgccgaaatcgggctcaaacccaaagccctgttcgacacggaaatagcggcgcgattgctcggcctgcaccgctttggtctggccgccgtcaccgaacactacctcggcatcacgctagccaaagagcattccgccgccgattggtcctaccgtccgctgccgcgcgactggcgcaactatgcggcgctcgacgtggaggtgcttatcgaacttgaaaccatgatgcgtcgtgacctgaaagccgcaggcaaggacgagtgggccgctgaagagttttctcacgctttggttgcgggccttgccccgcgcaaaccgcatccgattccttggctgcgtatctcgcgcatcacccagctgagtcgtgatccaaggggcttggccatcgccaaatccctatgggaggagcgcgaccgactcgcccggcaatacgatattgcgcccagcctgttattggccgattcatcaatcatcgaggcggcgaccaacaagccgcacaatgctgcccaattccgcgcgctccgatccctgaacgagcgtgtgcgcatccataccggcaccgagcaggacaaaatgttcgagcggtacgcgccgattcagcgtgcggtcaaaccgaaggtctggaagcaggccatcgatcgagccatagccctgaagcccacccaatggcctaccatgcccgcccccgaacaggacgaaaacggtgtggtgaacgcgccccgatccatgcggctgtggcaacagcgccatccggagcgttatgaccgtctgcaacgggtgcggcgtgtgatcaaccgcatcgccgaagacacccgcacgccggccgagatgatcatcaagccacagatcctacgcaacctgtgctgggtggaagacccggtggaagtggacgtcgagacgttcctgatcgagcagggcgcaaggaactggcaagtgaaactcattgcaccgtccgtaagtggcgttatcatgtagaggttgccttacggcagaactgtaagaaataacgacttttgaggagtcattagcgtgaagatcagcgttcgtaacctcgagcccaccaaggtgaagctcaccgtcactgttgaaccggaagagctcaacccgtatctggatgcggcccgtaaggaaatcgccaagcaggtgaacgttcccggcttccgtaagggtcacgttcccggcaagatcatcgaccagcgcatcggtttcgccgccgtcgccggtgaggccgtgaacgacgcggtcccggagctgtactccaaggccctggatgagaagaagattcgtccgatggctcagccggagttcgacgtgcaggatgttccgcagtccgccaacgacgagaccaagctgaagttcaccgccaccgtcgagcgtcgtcctgacatcgaactgccggaaatcgacggtcttgagatcgccatctccaagccggaagtcaaggatgaggacgtcgacaagcgcctcgagaccctgcgtcagcgcttcggcaccttggtcggcgtggaccgcccggccgccaagggcgacttcgccaacatcgacctgactgctgagattgacggcgagaccgtcgactcccaggaaggcgtgagctacgagctcggctccaacaccatgctcgacggtctggacgaggcccttgacggcctgtccgccggcgaggagaccaccttcgaaggcacgctggaagccggcgagcacgagggccagaaggccaccgtgaaggtcaaggtcaactccgtcaaggctgaggaactgccggagctgaacgatgagttcgcttccgaagcttccgagttcgacactctggacgagctcaaggctgacatccgcaaggctgccgctcaggacgccgaaggtcgtcaggccaccgaggctcgcgatgccttcatcgccaagctgcaggaaggcctcgagatcccggtgccgaagggcgtcaaggccaacatggtcgaagagcagctcaagggcatgaccccggacccggagaaggccaccaaggagcagaaggctcaggccgaggagaccgtggagaaggatctgcgcgatcagatggtgctcgacgctctggccgagaagctggacgttcaggtgtcccagtccgacgtgttcaacttcctcgcttccatcgcccagcagtacggcatggatccgaacaacttcatccaggccatcatcaagaatggccagcttggctccgctgtgcaggaagtcggccgttccaagggcctgctcgccggcatgcgcgccgtcaagttcaccgctgatggcgaggttgtggacctctccgccttcctgggcgaggccgctgaggacgaagagtccgagtccgtcgaggccgcttccgctgctgccgccgtggccgacgaactgtccgccaaggatgacgccaaggatgctgagtgagcatagcctcatcgcgttagcgtgattgtttgagcccggaatcgtgtttcatggttccgggctcttcctattctggcaaaaggactatttctttggctcccctctttgaggggagctgtcgagcgtggcgagactgaggggagttcccaaggcatactcgttgcatagggtgcggaggttgacatgcagccaacggttactatcaaacgccttggttggctcgctgcggcgaccattgtgctcggcgtgctcatcggtgtgggagcaggtctgctgaccctgttgctctacggcgttgaacatgtgctgctcggctacatcgaaggcccagaattgcctggttcattcggcgtgcccgctgcacgccgtgcgatatcggtgaccgtgggactcagcatcgcaggcattatctggtatctgctgcgacacaaaacgactgcggtgccctcagtcaagaaggccgtggcgggaaagcgaatgcctttctggcaaaccattgcgcatgtggtattgcagattttcatcgtcggctccggtgcctcgatcggccgagaagtcgccccacgcgaactcggcgccatgctcgcgcaacgtttctgcgacctgttccatatcgagggcgttgacggcatcgaccggcgcatggtggtggcagtggctgccggtgccggtctaggaggcgtctatgacgcgccactggccggcatgttcttcgccgtcgaaatcctgttggtagatgtgacaatcgaaaaagttgcgtttggactgggcatgtctgccattgccgcattcgtggcggttgcgatcaaagggcattgcctgttctacgacattaccgccatgcaaccggaatccacgccaacgttaatgctgttcgctctgatctgcggtgcggcatgtggagtgggcggcgcattgttccgaaaaggttcgcaatgggcggaagcgcacaagccaaccggtaaggctattctgtggcagatgacgctggctggtctcatcaccggtttggtggcgattgttgtgccgcaggtgatgggcaacggccgtgccgcagcgcaacttggattcagcacattcattcctgaaaccgccggcactgctggtgccatgcagtcggcatcttcagcggccgcctctccatggaacttgctgacgggcggcggtaatgtatccgattcggcctctggcgggggagcgggctctggaatggcatcgttctgggccatgcttcagggtgggagcggcccttctggatccgtgatgaacgccggtttcccgctgtcccagtccaatatctggatgttgctgggtgtgttggcactcacctttgttgccaaagcgctggtgacgctgatgaccattcgctccggtgcgtcgggcggtgtgctgcagcccggcatcgcattaggttccacgctgggtgcgatgctcggtctcgtatggatactgatgtttccgaccgattcggtaaccgcgtgtgccttgatcggtgcggcttcgttgctttcggcctcacaacaggcaccgcttatggccatgtgcttggtgatggagctctctgaagcgccgattaccttctttgtgccggtcggcatggccgtggccacgtcgtcactgatatcaaagtggttgctgagtcgtaagtaaatacatatattctggctcccctctctgaggggagctgccccggtcgaaactcccctcagccgcctatggcgacagctcccctcagagaggggagccgaggtaaagaaagctatgtcagaaaatacagaaattcgctcggcacttgaattgcttgccgctgagccgctcactgagcagattgactactatcgaaagccattcatggtgttatgggccgccattcaggaggcagccagcgatgtggccgaagactacgacttacctgcggatatggcccaattatgggtggccgaacagatgcgccaagtcgccgattcactggtcgatcggctcgcggaaaaagccgtggcccatggtgccagcaagtccaacgtagcgcgagccgccggtgccagccccgccaatgccgcccgtcgcttcccgcgtctgggcgacgatgccgcctcccagacccgcctcctcattgacgacgtcctcgacaccctcgaataaaccgaaatccctacgctgcccgccaaaaagcacgcgaaaagccgccttcagtcgcttcaaggcggtagtctgaacaatgttcgagtaattagaaggagaatcaaggtgagcaatacctttgcgaccttgccggtcatggcgggcgatgacgtcccggccggccccgtcgacccgattttcaaccgtctgctcaaagaccgcatcatctggatgggtgaagaggtcaaggacgatatggccaaccgcatctgcgctcagctgctgatgctggccgccgaagacccgaagaaggacatctggctgtacatcaactcgccgggcggctccatcaccgccggcatggccatctacgacaccatgcagctcatcgagcctgacgtggcgaccgtgggcctgggcatgtgtgcttccatgggccagttcctgctgagctccggtaccaagggcaagcgttacctgacctcgcacgcccgtgtgctcatgcaccagccttccggcggcatcggcggcaccgccactgacgtgcgcatcaacgccgagctcatcatggacatgaagaagaccatgagcgagctgaccgctgagcagaccggccacaccctcgaggaaatctaccgcgacaacgaatacgaccactggttcaccgcccaggaagccctcgactatggcttcgtggacaagctcgtgaccacgccggacaccatcggcaacaaccagcagggggagtgagactcatggcaagtgaagaagcaaagttcgccgcccgtgccgaccgcttggccggccgtcagggcgtagccggtttcatgccggcctccgcccgcgcagcccagcccgcgccgaccaaccgttacatcatgccgcagttcgtggagaagaccccgtatggcatgaagacccaggacgcctactcccgcctgttcgaggatcgcatcatcttcctcggcgtgcaggtggacgacgcctccgccgacgacgtgatggcccagctgctggtcctcgaatcccaagatccgaaccgtgacgtgatgatgtacatcaactcacccggcggttcgatgatggccatgaccgccatctacgacaccatgcagtacatcaagcccgacgtgcagaccgtgtgcctcggccaggccgcctccgccgccgccattctgctggcctccggcaccaagggcaagcgcctgatgctgccgaacgcccgtgtgctcatccaccagccggccatcgaccaaggcttcggcaaggccacggagatcgagattcaggccaaggaaatgctgcgtatgcgtgaatggctggaggagaccctcgccaagcacaccggccaggacgtcgagaagattcgccgcgacatcgaagtggacactttcctgaccgctcctgaagccaaggaatacggcatcgtggacgaggtgttggaacaccgccagtaaaacttccggacattgcaataccctcggtcggcaacgaccgggggtattgtatttcaaggatgacaatgataatgcgcagcgtggcggttcgacggtgcggcgcagtcggcaaaggagaatcatgggacgtgtggtgagctacaacgaggacgtaccccgttgcacgttctgcggcaaaaccgaacatcaggtacgaaaactggtggccggtcccaatgcctccatctgcgatgaatgcatcgccctgtgcgtggacatcatctccgaggagcgtgtcaaagatgccgaggtcaattcgctgagcctgcccaagcccgctcagatcttcgattatctcaaccgctacgtcatcggtcaggagaacgccaagcgcgcattatccgtagccgtatacaaccattacaagcgcgtcaacatggagcttcaggagtccgctgagcagcttgacgggaataacgggcacagtggccagaccggcaaacaagccaagcaatccgttcccacccagacgcgtgctgcccgccgcagcaatgaccctttggctgacgtcgaggtcgccaagtcaaacattctgttgctcggccccaccggcgtgggcaaaacctatcttgcgcaggcgttggcccgcgtaatgaacgtgccgttcgtcatcaccgacgccaccaccctgaccgaagccggctatgtaggcgacgatgtggaaaccgtgctccaacgtctcctccaagctgcggatggcgacgtaagccgagcccagcacggcatcatctacattgacgaaatcgataagatcgcccgcaaatccggtgagaacacctccatcacccgtgacgtgtccggtgagggcgttcagcaggcgttgctgaagatcttggaaggaaccatcgcctccgtgccgttggaaggcacgcgcaagcataaggagcaggacgttgcgcagatggacacacgcggcatcctattcatctgcggcggtgcgttcgtggggctgacggacattgttcgcaagcgattaggccgtcgagagaccggcttcggcgcgaattggcacgacgccgacatgaaagacgaggaattgctcgaacaggtcaatgccgatgatctggccgagttcggactgttgcctgagttcatcggacgtttgccggtcaccagtgtgctgaaggaacttaccgtagacgatctgacggcgattctcacccagccagccaacgcgctgatcaagcagtaccgtaaactgttcgccgtcgacggcgtcgatctgcaattcacagaacaggccattcgggcgattgctgatatcgctatcaagcaggggaccggcgcacgcggtttgcgttcgattatcgaacgtacgttgcaggacacgatgttccagttgccgagtttggatgatgtgaggcaggtgattgtggacaaggcgtccgtagagggttccagcacgcccaaactcctgcgcgaagccgtggatgtgccgcagggacgtctcaaagttgcgcagtcggttttgcttgaccgagtccgtacacacgaggcgtgaggccagtaaatacgccgttgcggtagtggtcgggatggtgcgactcgccgcaacacgccgagttgcattcagctgaacggcgtgtattatatatcgagttgtctgaaagacaacatgcgccagtagcccagcggattagagcagctgactacggatcagcaggtcgcaggttcgaatcctgtctggcgcactcccgaaccacggggacaacagtggtatgcgccagtagcccagcggattagagcagctgactacggatcagcaggtcgcaggttcgaatcctgtctggcgcacagtaagcctcgaaagcgaaatgcttccgaggcttttccaattgtattggcccgtttgagtcggttgagtcggccacacagggttgggctaaggttgcccttcgcgactcagcccggagcggaacgtcctgagacattccgtactattacatacggttcatccaagagagtgcagcaaggagacgcgatggccacgaccgccggcgcgaagaagggactttggtccaccatcaggcgaatcgccgcctcagaccgtatttccggactcatcatgcttggcttcgcgctcaccggcctggtgctcgcgaatctgcccgccaccgcgcatgcgttcgagaccgtagcggaaacgcatctgttcatcccctacaccaatctcgacctgcctattggccactgggcccaggatggtctgcttaccatcttcttcctgaccgtgggcctcgaactgaagcaggaactcaccaccggctcgcttgccaatccgaaagcggccgccgtgccgatgctgtgcgcggtgggcggcatgatcgccccgcccatcctgttcctggccgtcacggcattgttctctcagatcgggcctggtgaacccggcacgctgattctgaccaccaccggcagcagcatcccgttctcggagatgtcgcacggctgggcagtgcccaccgccacggatatcgcgttctcgctggccgtgctcgccctgttcgccaaggccctgcccggttcgatccgcgcgttcctgatgacgcttgccaccgtcgacgacctgctggccattattctgatcgccgtattcttctcctcgattaacgcctggtattggttcatcggcatcgccgtatgcgccgccatctgggcatacctcgtgcgactgaaaaaagtgccgtggatcgcggttggcatcgtcggtatcctcgcttggatcatgatgttcgaggcaggcgtgcaccccacactggccggcgtgctggttggcctgctgaccccctctcgtgaaatgcacggcgaactctcgccgcgtgccgaacgctatgccaacaagctccagccattctccgcactgctggccctgcccatcttcgccttgttcgccaccggcgtacacttcgagtcgatgagcccgctattgttggcctcgccgctggtcatcgcactgattgtggctttggtggtcggcaaacctctgggtatcatcaccaccgcatggctgtccacgcatgtgggcgggctcaagatggccaaggggctgcgtgtgcgcgacatgattcccgctgccgtcgcctgcggcattggcttcactgtgtccttcctcatcgcttcgctggcgtacaagaacgcggaactttccgctgaggcgcgcttcggcgtgctggtggcctccctgatcgccgccgcgatttccggtgtgctgctgagccgtcagtccaagcgattcgagaagaccgcagccgcagcagcggctgatgcggaggatgacgaatcgattgatggtgatggcatcgggcagccaagccacaccacagagcccaccacgcccacggaacaccccggcaccctcgccgacggcaccgccagtgtggaaatcgacttccgccactgatggcttagacggtccctactccattgttggccttgtttcgtgaaaaccgtacgctgagacgcgctcagtgtacgttcttcacgagatgaggccttatttcgcggaaaacgtacgctcagtgtcactcaccgtacgttcttcacgaagtcaaggatgatttcgcggaaaacgtacgctcagtgtcactcaccgtacgttcttcacgaagtcaaggatgatttcgcggaaaacgtacgcagagcttcaggcgctagaatgcgaagagtcgatagcgccgtacaggaggacattggatggcaaagaagcagaagaaatccaagaagaacgacggcaaaaaggccgctgaagcaaagaatctagccgaggccgcatccaagtccgcagtcgtggacgatatggaaccattggaagccacagccgcgaatgatgcggcggcgttggaggctgagacggcaactgaggctgtggccacaccggtgaacccggtcgatctggaggacgcctcgccgctgggcgacacctatcatcgcggcccggtgattctacgcggccagatgattccctcggacaacaccaccgccaacctgctgaaacccgatcaggacaccgactggctgcacatggacccatggcgtgtgctgcgcatccaatcggaattcgtggacggtttcggggcgctcgccgagctcggacctgcggtctctattttcggctccgcacgcacccagcgcaccgaatcgatctacaaggcagcacggcgcatgggtagccagatagccaagcgcaacatcgccgtcatcaccggcggtggtcccggcatcatggaagccgcgaataggggagcggcactggccggcggcaaatcggtgggacttggcatcgaattgccgcacgagcaggggttgaaccagtgggtgaacctcggcatgagcttccggtacttctttgtgcgaaaaaccatgttcatcaagtattcctccggcgtgatcgtatgcccgggaggcttcggcacactggatgagatgttcgaattattgaccttggttcagacccacaaggtggcgaatattccggtggtgctctacggcaaggaatactggcaggggctctttgactggctcaacggtccggtggccgagcatggcatgatctcgacgatcgacccgaaactggtcaccgtaaccgatgacgccgacgaagccgtggacgtggccgtcagcgcaattgtgaggtaagcgagatagagtggctcccctctccgaggggagccaaggacagagttactttttgtaggcgatgagcaggccggtgccgtcaggggtgagcgtggactcgaaaccttcgtcatcttcgacggtggtgagcagctcacgcatggcgatggccttgtcgctgcggtcggccggattgatcacgccgccctgaccgtcctccaacgccagcacatcggtgaacacgatcacgccgtgcacgcgcagcagacgggaggcctgggcgaacgtggcggcatagttctcggcgtcgcccgccaccacgatcagatcgtaatcattggcgttgaggcgcggcagaaacacgctggccggggcgttcaccgcacgcaacgtggtgtcggtctcgtcctgcagctcggcgaacgccttgcgaatcagcgcgatgccctgggcggtggaatcgaccgcagtcagcaggcccttgttatccagtgcatgggcgagctgcaaggtctccaccagcgagccggtgcccacggcaatcaccgaagcggcgccggtgatgcgcaccagcatgcccagcagacgggcctgcgccgccgaaccctgcaactggccggactcgtcggcggccgtacgggtgtcggtcaacgcatcggattcacgttcgcgcgcgtgttcctcggtgaattcccatgccttggcgaggttggtgtactgcgttctgtccataattcgttctttcatgtcttctctcgtgcgggcacccagcggatgcatcgacgcatgtgcttaggcgatcgccgcagccagccgcggcgcggcttagcgctcgcggaccttagccacgatctgccacatctcctcgcccacatcgatgccgcgcgggcagtggcgggagcaggcgcgcacggactggcaggcggccacgccgtcggcggtgtcgatggcatccatacgctccatggccttggtgtcgcgcgaatcgttgacgaaacgggaggcccaaatcagcgcggccgggccgatgaaggcgtcgccgccggcgtacaccgggcaggcgccttcgcacacgccgcaggcgatgcagttgctcagcagctcgtatttggcgagttgttcggggttctgcaggtattcgaacacgtccaccttgccttcggcggtggtggcgagcacgccgtccgcctgaagatacggggtgagcttcctgatctggttgagcatagggtcgatgtcggcgatgaggtcgcgctgcggcgggaagccgggcagggacgccagttcgatgactcccagcgaaccgtttgcggctgagttctgggcggccgccgcgtttgcgacgttttccgcggaatcgtcggattcctcagcctcggtgccggtgtgtcggaacccttcgtcatcgacttcgggcatggcgccgggttgcttggcccaatcgcggatggtggctgtgcacagcagggtgggggtgccgttgatggccacggcgtccgaaccgcacatgccatgaccgcacgaataacggaaggccagcgtcgggtcgacggtgcgtttgatggtcagcagacaatccaacacagtatccgaagggcgcgcgggaatcgtgtactcctgcacccactgcttgccgcgcggacgacggcgcgccgccgaatccgagccgccgccgaacggggagcctttcttggcaaacgggctgccaccgcgtgcacgttcggcacgctcgggtcgcggcgtgaaacgatgcacttgcagggtaaccgtcgtgttgctcgcctcagccatgttctgcctccatgaaacagtgggatgtcaagtccaatattagccaacctattgtgccacaagccctaggcggcttgggtattaccaccagcggatcagtactcgcgcttcttgggcggatagtcggtgatgtgcaccggcttgaaacttaccgaaccatcatcggcgaccatcgagtgagcaaggaaatgctcatcgtcgcgttcggggaaatcaaggcgttgcatggatccgcgagattcctgacgggattcggaagcgtgcagcatgacctcggccagttcgatcagatgacggacttcccagatggcggtgacctcctgattgaaagcggcggtcttgtcatgggcccgcaaggtatcggcaaccggtgtgatgtcaccgttgatctgggtcaacgccgtatcgatggtctgagcggtgcaacgtacggccagagcctgctccatcactgatccgagttgggccatgagctgataaggattggcggtgggcactccatcgtctgaatcatctattggcccggcgagcagttcgtcaagctccgctttgcgagaatcggcagcctgatcggcggcatcggtcagcatgtcatcggccgaatcatcggccatggggagtcaaccgggttctcggcgatgcgtgcggccatcgtctgaccagcgcgtgtgccgaacagacaggcgtcgagcagagaattgccgcccagacgattcgcaccatgtacggagacacaagagcattcgccagcggcgaacagtccatcgactacctgcacggcaccgtcggcccaacggtacacctcgccgtcggtggtgatggggatgccgcccatcgtgtagtgtgcagtgggcttgatgggtactaggtccttggccggatcgaggttcgcgtactgctcgatggtttcgaccacctgcggcagcacttccttcatacgttcggggtcgatgccggtcatatccagccagacgcagtccttcggaccatccgggtccttcgggtcggcgacgccgcgaccggcgtcgatctccgccatgatggagcgggagaccacgtctcgtgcggccagatccttatgctccggagcgtagcgttccataaacggctcaccgtcggcgttcctcagaatgccgccctcggcgcgggccgcctcggacagcaggatgccggtgtgcgcgagcccggtggggtggaactgcacaaattcgatgtcctccagctgcagaccggcggccaaggtcaaggccatgccgtcgccggtcagatcccaggaatttgacgtggtgtggaacagtcggcccgcgccaccggtggcaagcagcacgttgcgcgcgtggatggcctgaatcttgcccgaatgcgtgtcaaaggccacgatgccggccgcctgcttgccgtcgtcggcgagcaccaggtcggtcacataccattcctcggcgaactcgacgccggcggccacgcactgctgccacaaggcgtgcagaatctggtggccgatgcggtcggccgcataggcggcgcgcttgaccggggcgccgccgaactcgcgcgtgtggccgccgaaccggcgctgggcgatatgcccgtcctcggtacgggagaaggccacgccctgacgctccaggttgatcacggtctgcggcgcgtattcggcgagcagtttggccgcatcctggtccaccagccagtcgccgcccttgatggtgtcgtagtaatgccagtgccagtcatcggactccacattgcccaggctcgcggcgatgccgccctcggctgaaccggtgtgcgaacgcagcggctgcagtttggagaccacgaggatcttcgggtccacgccttgttccttgagctcggtgatctcgggggagcgcagcagtcccaacgccgccgacaggccggccgctccggcgccgacgatcaccgcatcatacatatcttccaaacgtttcggactcatgggttcgattctcgcacacccgccgaacagccttcgagccgtgtcatggaagccgattagccgacacggctgctcagcttgagtatgccggcatcccgctcgatcactcccttcagctccaatgcgccgagtagctcaagtatggtgccgatattgggaatctcgtcgggtaccgtctctcgcgccacacgcaatagtgcgtccggggtgacgatgagatgtcgtttacggcattcacgaatcaatgccactaatgtgcgttccatttccggcagcttggcgataatgatacgttgttgggcttccttctcgggatcgggcttcggcttgacacgaagatccggcatctgatgtgacgagggaagctcttcacccttgcttttgtcgttaccggaatcggcagttgcgctcgccggcccatccttggattgagtgcgcgtaggctgagtatgcttggtcttcgaacgtttcgaatgacctgaatcttgtgacgactcctgtgacgccgatgattccgaggatgctggcgataacggagtcgttgccggcacttccatggcctcctcgttttcggacgagtcctgacctgtggatttcgatatgcctgggcatgctgccataacgggcttatgccgttcatggcatatatcctcggtggatgtggcggcacacagaatcatcgctcggtggtcgccgatcatcttattgcacccggcgttgcaaggctgattgatgtcaccgggaaccgcatacacttcgcgcagcaattcgcatgcccatcccgcggtgttgagcgctccggaacgcaaccgggcttgcgtcacaatcaatgtggaagacatggccgcgataatgcggttgcgaagcagaaaacgacgggcttcgggaatcgtcccggggcacagttcactgatcagtgcaccaccctgcgcctcgatgcgttcgaacagcgtgcggttacgcatcggtccgatatggttgagcccgccggcgaatacggcaacggttttgcccacattggcgggcattctgccgtgcagcgcattcaacgctccccaatgtgccgccgcatccgtgcccatcgcgcctccggacacgaccagatgcccggcaacggctgcctgttcggctacggtgtgtgccacataccggccatattcggtcacgtcccgtgaaccgacgatgccgaccggtttggcgcaactggtcaatgcgcgtggatcgcctttgatccacaaacacagcggtggcgcccaatcggagcgaatggacaggtcggccaactgcgagggccaacatggatggccagggccgataatccattgcgtgccatccatagtgaaccagtcggccagttggatgatgtcttgcgagggcaggtccatcatgcggttatgccagcaggccagtgcattgcggaaggagcgcatcgcgttcgccgacgccttgcggccccatcgagtgaggccgtccacgaacatgcggtcaatacgtgacagcgccgggccgcagatttcagatggctggcttggatgggattgcgccaacgcatgccagagggattcggcgttttccgcgcctttgagcgtggcgtacatcatcacatccgcgccatcaagacagaacgtgagcgcggcacgatacaacgtatccgtgggaggtacgggaatagtgcgcgaaacggcgagactcgtatcggtgtgatccacacttcctgcggtgccgccagattgccggatatcagtagcgttactcatgtcatcctcgttctcatttcgatgccctgatggacgtcctgttcagtggggatacgcggccggccagatcggcgagcgtccaagacagacgcatggcgcgatcagccccgcgcaatgtgagttgatgattggacagggcccgattgaccaattccatcgctttcagcgatgtattggcgtgcagccatttgcccgaagcttgcgcgttgcacacccatccatactgtctgaaccggtctttggccacttgacgggcacgaatcacacgagcttgtatcccggcactggactcgccgattggctcgctttgcgcggcaatgcgcgagactggtggcaccgccatctgaatatccacacgatccagtatcggtccggacaatcgcgagaaataacgtatacggtctttttcccggcaagcgcaacgttcgccggtgccgtaatagtatccgcacggacaggggttggccgccatgatgagttggaatgaggccgggtagtaggtgctgccttttgaacgggaaagcgccacatacccggattccaatggttcgcgcaacgtctgcagggcgcgtgcgctgaattccggtgcctcgtccagaaacagaatgcctcgatgcgcgcgtgtgattgcgccgggaacggcgatgccgctgccaccacccaccaaggccgccgtgctggcggtgtggtgcggtgcctcgaacggcggcatgtcggtgatgccgtactgaggcagtatgccgcacagcgatcgaatcgatgccacctccagctgttccgcctcgttcaacgggcacatgatgccgggcatacgtgaggccaacatggttttgccgctgcctggcgggccggtcatgatgagattatgcccgcctgccgccgccacttgcagtgcccatttggcatgctcctgacccagaacctcgttcatatcgccacaatcgttgggatgacttgtgggcgattgatccgtggtggtctcgtcggtaaccggtgtatcgggaatcgtataggtggcatcgccgcccatcagttcgatgagctcacccacatgcctcacgcccactacatccagtccatccaccatcgaagcctcgtcaagattgcgatggggaacaatcattttgcgcacgccacgttcctcggcatgcagcatgatcgggagcagcccatgaatcggcagcaccgagccgtcaagattcacttcgccgagcacaatggtatcttctaggcaatcatgccctatggcacccgccgcacataggacgctggccgcgatggccagatcatgcgacgaaccgcgtttgggcatggccgcagggctcatgttcacggtcacacgggtttgcggccaaccgaatccagtggcttgacacgctgatttcacgcgctcgcgggcttcggacaacgatgcatccggcaatccgatgatgctgaagtatggcaagccagggctgatgaaagcctgcacttggacgatgaaggccttaaggccgatcagtccgactgagagggtgctgccgatagccatgtctactcctttcacaatgtgtttcgcaacgtggctgttttttttgggggggggcttcagaaggcattttcaatgtgatgcacgagcggcctgcccacccgaagcacgatggtgacgacatcgaaacggaccgccgaatgcggcacccgattacgccggtcaagtagccaatcgcaggcggctttcctgagattgtgctgtttcgccggcgtaatggcctcttgcggatatccgtaatgcatggaccggcgtgatttcacttcgacgaacaccaccgtgtactcgggattgagcatcacgatgtccaattcgccgtaacgggtatgccaattgcggctcaaggtcgtccaaccgtgttcctccagccacgcggcggcatactgctcgccgagcgcgccgaactgtttgggcgtcagattgcggtcgcccatcgtggccgcaatccgttccgaaggcagcattgcctgcggatcaggtgaagccagcatgggctggtgaaaggcaagaccggcgtcgatgccggacttcgtcgtcggctgagtaggtggtaaagcgttcatgattccactgtgcgggttacttatgtaagagcacaagcgcaaccggcaaatgtggatactatgacgcggtttggcgtgttgtggataacgtgtggatgaaaactcggttatccaccattagttcagaaggtttaccaaggctcaccagtcgacttccctgtgacgaaaaaacaacccatcggattgttcgctgaatacgtcagacccagtgagcggagaggggagccaaggtgcggtcacttcaccaaatcggtgagttcgccaaggttcagttcgaaactgacgccacgatcctcgaaatgcggctggttacgggtgctgaccatggcgtgacgcacgaactcaccggcgatttcggccgactcggccaggccgcggccggccatcaccgcgccgcacagggcagaggcgaaggcgtcacccgtgccatgaatcatgtatggcaacttctcatgagccagctcgatcttgccggcaacaccggtggaagcgctggccacatagttgacgattttgccatcgccatggtcaatgcccttcagcaccacgttcttggcacccaactccagcagagcaccaagcagctcgttaaccgtggcctcatcaatatcctggccaggatagtcacgcttggtgagaatgctcgcttcggtgaggttcggcatcaacacgtcggcaccatcggccagcgcgcccattgcctcgcacagctccggtgtgtacgtggggtacatttcgccggcgtctcccatcaccgggtcaaccagacgcagcgcgttcggatattcgcggtagagacgctgaatgatcgccacctgatcggggagccgaggaagcctgaatacacgccatccagctccacgtcttccttctgccaggcatccaagtaaccggagagaatatccgtggtgtcatggaacgtgaacactgcatagcgtgtgtgcgccgagaacagggcggtcggcaccgggcacacatcgcagccggcggccgagagaatcggaatcgcggcggtcagcgagcacttgccgtagccgcacatgtcgtgcacggcggccacgcgcggaatatagttcggatcacggtcatacagagttacatcggtcatgtctgttcgaatcccttcaccatgttggcggaataattcattggcgatgtttgactgtagtcgttcgtcatgtaaaccatgtaaccgggcggcagaaaaatgaaacagacgtcatcaccgagcgggcaaaccgtcttggtgacgggtggaacaagcaatcatcacggacacttgagccatgcgcgaaaggcatggcagcgatatcaccgtgaccgcagtcgaccttgaaagcgcatgcgtgcggcccggcgtgtcgcgataatttcaacgactttttcgtgacttctgacagtcgctcacgtcaatgattccaaggctttataagcccttataggcaagtccgataacgttcagcttgcgccgcgcggcccaagcgtcgtaacttcataaccaacacctcgccaaccgcccgaacacggcaggcgggtggcaaggaaaaatcctcgcgacctagcacaaccaaggagaataccatggccgagaacaacaagaagtaccgttttgaaaccctgcagctgcacgtcggccaggagcaggccgacccggccaccgactcccgcgcggtgccgatctaccagaccacctcctacgtcttccacaacttcgaccacgccgaggcccgcttcggactggcggacccgggcaacatctacggccgtctgaccaactccacccagggcgtgttcgaagaccgcatcgcggccctcgaaggcggcaccgcgggcctggccgtcgcgtccggcgcggccgccgtggaatacgcggtgcgcaacatcacccagtccggcgaccacatcgtcgcagccaagaacgtgtacggcggcaccttcaacctgctgcgccacaccctgccgcgcgacggcatcaccaccaccttcgtctccgccgagaacccgcaggagttcgaggacgccatccaggagaacaccaagctcgtctacttcgagaccttcggcaacccgaacgccgacctgcccgacttcgaggccatcaccgccatcgcccacaagcaccacctgccggtgatcgtggacaacaccttcgcctccccgtacctgttccgcccgctggagcacggcgccgacgtcgttgtggaatccgccaccaagttcatcggcggccacggcaccaccctcggcggcgtgatcgtggaaggcggcaagttcaactgggccgaagtgccgggcaagttcccgaccctgaccgagccggatccgtcctaccatggcctgaacttctatgaggccctcggcggcgccgccttcgtgacccgcgtgcgcgccatcctgctgcgcgacaccggcgccaccctgtccccgttcgcggccttcctgctgctgcagggcaccgaaaccctgtccctgcgcgtcgaacgccacgtccagaacgcgctgaaggtcatcgattacctgaagaccgttccggaagtcgagtccatctcccacccgtccatcgaaggccgcaaggacaacgagctgtacaagaagtacttcccgaatggcgacggctccatcttcaccttcgacatcaagggcggcaaggacgcggcaagcgtgttcatcgacaacctgcacctgttcagcctgttggccaacgtggccgacgccaagagcctcgtgattcacccggcctccaccacgcactcccaggagacagtggaggagctcgaggatcagggcatccaccaaggcaccatccgcctgtccatcggcaccgagaacatcgaggacatcctcgatgacctgaagggcggcttcgaagcccttcgcgcttccggcttggccaagtgaggtcgacaggaaggttgacggcccgatgagaaggggcgcgatgctaatggggtgcatcacgaatcatcgagccgcatggggtgccttccgcctgatcgcttgacccaaggaatagaaagctcgcactgatgtcatgcagtgcgggctttcttgcgtctgtatgcctcacactgtttgcgcagaggcatgaatagtgtgagacctgagacgacataatcctcaaggatgagggccggcgcgtggccgaccgcccaattcagtctggcgcacgatggggcgcgccgttatttcttcataagttggaatcatcatccgggcataaggcccggcccaatatggagaggcattatgaacgtgcagaacccgtccgcatcgcgcggcatcgttattcaggccgtcgacttggtcaagaactacggcaccggcagcaatatggttcacgccctgcgcggcgtgaacgtgagtttcgaacgcggcaaattcaccgccatcatgggcccatccggttccggcaaatccacgctgatgcacacgctcgccggtctcgactccgccacttccggccatatcttgttcggcggcgccgacctgacccgcatggacgacaagcagctcaccttgctacgtcgccacaagatcggcttcatcttccaaagcttcaacctgttgcccatgttcaccgcagagcagaacatcctcatgccgctgactttggccggtgataagcccgaccgtgcctggttcgatctgctcgtagaaaccttgggactcaagcaacggctcaaccatcgtccgaacgagctgtccggtggccagcagcagcgcgtggccatcgcccgcgcgctgattaccaagccgaagctggtgttcgccgacgagccgaccggcaacctcgactccgtctccagcgccgaagtgctcggcttcctgaagcgttcggtcaacgaactcggacagaccatcgtcatggtcacgcatgatgcggtcgccgcgtcttacgccgaccgtgcgctcgtgttcgccgacggccagatcgtggcggacgtaaacaagccgacagcagaccagatgagtgaactgctgatgaaggaacgtgaggccgccacaatgaatgtggcttccgcgagacattcccgctaaacgcactgtagaagcattcgaagaagggaacagaatccaccatgtggtccatcactttgaaactcatgcgaaaaaccaagcgcatgctcatacccgcaggcatcgccatcatgatcggcacggcgttcatcgccagcaccttcctgttcggcaatgccatgaacgactccctgacacggcagctgaccgccatgttcggaaacgccaactatgcggtgagcatcaacagctccgacctgagcgataaggaactcaacgaggcgtattccagcactgtcggcgactttcatctcgaccagatcgccggcatcgaaggggttggcggcgtccgtgcctcggtggaaaccggcgtcagcgtttccaagggagacagcaccgtcagcggcgagatcatttccaccgcggcacagaagaacatgctccccgtgaatatcacggaaggggaccagccgaaggattccaacgaagtcgcgctgccggaagacatggcgaaacagctgaacgtcggcgttggagacactgtaagcctgacctcccgatatgcggtaggcgacgatggcaaagccaaggcggacaacgtgcgcgtggtaggactcacatccgatccgaacggcgcctactcatactatggtggtgcgatcgtaggatccaacaatctgcttgccgcaatgcagggagtggacgatttcaacgccaccggaacaacaatggtgtatctcgaccttgccttggatggaaacagcgtatccgcaaaaaccatcaacggtgtgaaagcgttgctgccaaagcatttcgatctgatgtcacgacagcaaatcagtgacgaaagcatcaaatccttaagcggcaaccaaaccaacatcgtcaccacattccttatgtgcttcggcgtgcttgccatgttcgtggcggctctggtgatcgccaacacgttccaagtgctcgtggcgcaacgccgccgcacactcgccttgctacgcaccatcggcgcaaagaaaggccaactgtatggttccgtgctgttcgaagcggtggtgctcggcttcgtcgcatccgtgcttggcgtggtgctgggaagcctgctcatgtggggcatgtgcgtcagcgacatcatgcaagagggtatgcgattcaatttctcttggcaagccgccgtcgtacccattcttttcggtattgtggtgacggtgctcgcatccttgggatccgcacgttccgctactgcggtgacaccattggaggcattgcgcccgatcgaactgaccgacaaccgtcgttccagcctcacgcgagccataatcggtattctgatggtggtggtcggtatcgccatggcagtattttccatctggcaggtacaagccaccaatggcggcgaggaagcgaacagcgatcaattcacgatgattctgctcatagccatcgccggtgccgcactggtgttcctcggcatggtagtcaccgcggtgttttggatgccggccctcatgaagggcgttggagcgttggcctcgctgacaggcccttccgcaacggttgcgcacgccaacattcagaagaatccgcgacgcatcgcagcaaccggtgccgctctgctcatcggcgtcaccctggtttccaccatcgcaaccggtgccgctagcgccaaagagactatgaatggtgcgctcgccacccgttatagcgtcgacatcgtggccatgggcgatgacatcagtcagcaaatggtcaaggatgtagccgacatcaacggcgtgtccgacacattgtatgcgccggcggtttccgtgaccttggagaaagcggatggaacccagcctacgtccgcattgctggtcggtgtgaagaacatcgatcaggtcaagcaggtcatgcgtgccaacttgggtaacgcctccatcgacagtgatagcgtgctcatgccaacatacaatgcgcaaaccggcaaggaactgcagttcgccaatggcacggctgatttctccaccgaatggaatcaggacggcgtcactacgcgttcgctgacattgcaagcaaaccaagccgactaccgtcgcgtatccgcacagtatggagctgtcggattcgtggatgaaagccatttcaccaatggtgaccttgacgccgccacccatgtgttgctggtcaaggcagatactgacaaatcgggagtttccgttgacggcatctacaacaacatgcaggccgcattggagaagagcactgatgcaacagtgaccggaccgattgccgaacgcatcgaatgggcgaacatgatcgactccatgatgatgcttctggtggggttgatcgccgtggccgtgctcatcgcacttgtcggcgtagccaacacgctgtcgctgtcagtgatcgaacgcacccgagaatccgccacactgcgtgccatcggcatgactcgaggccagttgcgacgctccctcgcggtggaagccctgctcatctcgctggtatccggcatctcgggcgtactacttggcaccctgttcggctggctgggcgcatacgtggtgttcagtatgtacggcaaagtggtgttcccgttcgaatggggcattaacggcatcgtactcgccgtggcagccgtggcagcattgctcgccagcgtattccccgcacgcagggcagtgagcacgcctcctgttgaggcgctcgccgaagcctaagcttcatagcaaacacaacgaaaaggactcctgccacaaacatggcaggagtccttttcgcgtatcatgcatacgcaaaacaacaaatcaatcagaccaaatggttttcgtaagcgaacaccaccgcctgcacacggtcacgcgcattgatcttcgccagaatatgcgccacatgcgttttcaccgtcggcaggctgatgaaaagcttatcggcaatctcctgattcgacaatccatgcgcgatctcaataagcacttcgcgctcgcgatcggtcagttcatctaattccggatcggtgtacgtcgaatcagaagtggaagaagcagtggaatttccatgtgcgccaacattcgcagccatgaaatcgccttccatcattttctcgataagacgtttcgtggcggacggtgcgataatcgcattaccttgaaaaaccgtgcgaatcgaattcaacaacgtttccggttccgtatctttcagcagaaaaccggaagccccggcagtgatcgcagccataacatattcatccaaatcgaatgtcgtcagaatgatcactttggtatgagtgacttctgattgcgttccatcggcagcaaagcgatgctgcaacgcactgatctgccgagtcgcctcaataccatccatgccgggcatacgcacatccatcaacaccacgtcaggatgcagcgtttccgccaacgccacagcctctgcaccatcgcgagcctgcgccgcaaccgtcatatcaggctgggagccgatcaccatggcgaaaccggcgcgtaccaattcctgatcatcggcaatgaccacacgaatcttctgttcttcactcatactctccaccttatcggcattgttccgctcacagcgcgaaacaaacccttaaatctccctgaaaaacttgaatcggctatcgaggcacgcgctgcagctgctcctccaatggtgctgcgggcctcaactgcagttcgctcgcactaccggcatgagcgtcatcgctgaaaccagtctcacgaagcacgccaagcaattcgcgcatacgcttaagcgcggcgcgcccctgctcgccaatggctttgaacgctgcggaaatctcgtcggcggtagtctctttgccttgtgcttcggcgctatccagcatgcggataccatcgacggcttgactaatcacgctgttcaacgtggcggtgacttcagcctgaatgctggcactgatacggtcacgttccatattcgccgcgagaatacgctgcttctcctgctcggccaccagtgcctcttcgcgagcctgcaacaccagtgcgtttgaatcactggaacgcgcccaacgtgcccacgccatgatgccggcgcacagcatcagcactgcaaccgtatacatgacgccggtaaagaatgctgcactactacttgacgtggctgaaaccggttttgttaagcccacggaagcggcgatggcgccgaacaaggtagtgtatccgtgttgatcagctgcgattttcaagcccatcagagctgaacaggtgacagcggcaagaccggtccaacgccatgcgtgttcacgcccatacaatacggctgaatacagcgcacacagcgacgctacgatatgtccaacctcaatcaatcccaaaaaaaccaattgcacaaccgacaatacgaacacaataagcgcgcaagtctcggggaacctgcgtcgaagagccagtgccagcaagcagcatgcggcgatcgcatgagagagctgcgcatcgcgtgaactatcaaaaaagaatgtaatcgacatgcgattcagcagcatgaccaataccacggcaccaacggaatccatgagcacataatggtgctgcgtccacgcggaaacacgttccacccaattcagccctcgcgaattggatgtatttgcaagttctacggatttcagtttcagcgatgtgagcaaatcatgcagattgggtgcggtgatgcgcaagtgttgcagggcgttcgaacgatggtcgcgaccggttggttggttggtttcctgcgtctgttccgatggttgatcggggattcgcgccgatatgttgacggctgtgtgagatgcgattgcttcgtcggataatttcgctttgctggatatggcagttgtgttgcaagattcggactgttccgaggcatactgttcgccggtttcgtctgtcgctggctctttaccgccgtaaggcagggtggccataacttcgaagcctccgccgagttgagggccagcctgcaatgagcctccggccgattcgatgcgttccttcatgcccaacaggccgtaacctggcgtatgcccgtcgatattggccgccgcgccacgaccattgtcggtgacggtcaaagtgagtaaaccgttgttccatgactctttaatatgcacatcgacgtgcggccccgcatacttgcggatattcgtcagcgcctcctgcactacatggtaggaagctatcgaggcttgttcaccgagttgttctgggctggcggtgccggtgatattccatcggattcgaatgtcgggggagacgtttcgcgcttgttccacaagattgcctatatcgttataatcggcgtgcggtgaacccccgaatactcccagaagacgttgcatgtcatgcagtgcgcgttccgattcgtgtcgaatcgtctccatggtgtttctagccaccgcgggatcatgcgtgcctgcatagcggccgccatcagactgcacgatgatgattgatagggtgtgcgccaccacatcatgcatgtcgcgtgcgatgcgtgctcgttccgccaacgcggcgatatcgcgttcgtcctggtctcgtgcggcgatcgcctcattgcgttcccgcatcatacgaacggttgccagacgggcacgctgccagaacgctacaatgacggtggaaataatgcatacttcgaaaatcggcgtcagcaccaacatgtattgcgccaccatgttggcgacttccgacatggatgttcctgtgtagatggagccgagagtgtcttccgtgaccattgagccatttggatttgagccattccaactgctccacgtatgcactttgccaccggtgagcagcggcccattggtcatggtccatgccatcaacgccgaagccagaagaccgatggccaacgctagaataatgaaggctttcgtgtttttgggattgccgtagacgatcaccgaatacagcatgaccaatgccagaatatcggcgcccaatatgcaagggccgaatatgagatgcgtcaaggccaatgccacacagagcaacgctccggtctgtggccgccatcgacggatcagcagcgggatcagcattgccgcttcccacgccatctgtatggaaggattaaggtcaaacagcaatcccggattataggtgatgctgccggtcacgccgaacagcagaacacctatgacaagcgtgaggatgagatcgcctgcgaagacatgaccatgcatccacgacaggaaacgctgcttgaaattcgacatacgctccaccctagcgccagatatgctgtgacgccatcgtgcgcaggaatgaaataacggtaagataaagccgcttttgtgaggtaaggttatctccgcatgtgggtgagatggaatccatcaagaagtcactacccgcattgaatatgccgatgacgccaaaggaaaggtgaatgcatgacgttgctgagcgaatactacgtgcccggattgcatattgaggatcgttccatcaaggtgccgttggattgggcgggtcacgagcccggtcatgggttcgatggcgaatcgatcagcctgttctaccgtgtggtcaccgctcccgaacatgtgcatgacgacctgccgttgctcgtgttcctgcagggtggtcccggtggttccggtccgcgtccgctcggcccaagttccgatggttggatcgaggaagcgatcaagcatttccgcgtggtgttgccggatcaacgtggtacggggcgttcgtctcgtgtcgacacgcatgtgattgagggcatggacggcgacggcaaggccggtgccgcgtttttgaagcgtttcctcgctgattcgatcgttcgtgatttcgagcatctgcgtcgcaccgaattcgggggcgcacgttgggtcacgcttggtcaaagctatggcggattcctgacgttgacgtatctttcgctgttcccgcaaggagttatcgccagtttcaccacgggcggcattcctcatgttcccgccgatgcgaccgacgtgtaccgtcatacgttcccgcgcatggcggcaaagacgaagcagttctacgagcgttacccgatcgatatcgaacgtgtcgtggccgtcgccgacattctgcaatcgcgcaaggtcacattgccgaacggcgacccgctcacggtggaacgcttccaatgcttgggatccgatttcggtatgaagccgagtttcgaacgcgtgcattggattcttgaccaggcattccttgacggcgacggttcggcctcgacctcggcggaactgtctgacgaattcctatcttccgtgatggaggcgacctcgtctcgcccactgtattggccgttgcaggagttcatctacgccaacggcgagctgaaaacgccgatttgctgggccgcccagcgcgtgcgcggcgagcatccggaattcgcgggtgacatttgtccgcttaatttcaccggcgaggccatgttcccgtggatgttcgagcaggaacgtgcgttgcgtccgttcaaaccagccatggatgtgcttatggaagacacgcatttcggcacgatctacgatgccgaccagttggcgcgtaacgaggtgccgttgcaggccgccgtctatttcgacgacatgtacgtcgactccggtctgcaatttgatacgctgtcccgtgtgggacgatcgcactattggaccaccaacgaattcgagcacgacggtgtacatggttccgtggtgttcaagcacctgttcgacgaggcgttgaacaggggagacctggaagaactgttctgacattcccgaaattctccgaaaccatcgcatccaaaacaattacgtccattagaaaagacgacaaggaggacaccatgtccaatccaaccatcggattcatcggatacggcaacatggcgcaggcgatcgccgaaggcctggtcaatgccggcacaatcagcggcaacgacattgtggcttgtgcggcacactatgacaagctggaatgtaacgccgccaaacttggtgtgaaagcggtgcataccgctgcacaagtggccgaagccgccgacgtggtcgttatcgccatcaaaccgtatcagattgaagcggtgatttcaccgattgttgataagctggcgcagccaaacaccatcgtcgtgtccattgcggcaggctgggatctgaacaaattccgcgacctgttcggaacgtctttcgaacaggcacacatccaatgcaccattccgaacacgccgatggctgtcggcaaaggcgtgctggtcacggaaatcgacaacacgctcacgcaggaacagacggaaaccttcgaaagcctgttttcgtcaatcagcctgattgaacacgtggacaccgcacacatgggcatcggcatgtgcatcgccggctgcgcgccggccttcaccgacatgtacatcgaagcattgggcgatgccggtgtgaaatatggtttgcagcgtgccaccgcgtatcgtctggccgccaaaatggtggaaggcgtgggtgcgctctatctggccgacgaaacgcatccgggtgccatgaaagacgctgtctgctctccaggggcaccaccatcaagggtgtcgcatcgttggaggaaagtgcgttccgaggtgccgtgatcaaagcggtcgacgccatcgaagcctaatactaagctaaggaaccatgtctcttactatcggaattgtcggactgccgaacgtcggcaagtccaccatgttcaacgcattgacccgtaacaacgttctggcggaaaactatccgtttgccaccatcgaaccgaacaccggcatcgtgccattgccggatgaccgtctgccggtgcttgccaagctcgtgcacacggagaagatcgtgccggccaccgtcaccttcgtcgacatcgcaggcatcgtcaagggcgcttcggaaggcgaaggcttgggtaacaagttcctcgccaacattcgcgaagccgacgcgatctgcgaggtcgtgcgtgccttcgaagacgatgatatcgtgcacgtcaacggcaaggtcgatccgtccgacgacattgaaaccatcaacaccgagctgatcctcgccgatctgcagaccatcgagaacgcgctgccgaagttggagaaggatttgcgcggcaagaagatcgaaccggcctacatggaggccgtcaagcaggcgaagaccattcttgaagccggcgaaaccattgataaggcggctcgcgaaggtcgtttcgacaaggattccgtctacgatctgcacttgatgagcgccaagccgttcatctacgtgttcaacgtggatgatgccgaactgcagaacaaagacatgcaggccaagctcgccgcatccgtggctccggctccggccattttcctcaacgcgcagtttgaagccgacctgaccgaactcgacgaggctgacgctcgcgagatgcttgcggacgccggtcttgaggagtccggattggatcagttggcgcgagtcggctacgatactctcggcctttccaccttcctcaccgcaggcgagaaagaagtgcgcgcatggcagattcacaagggctataccgctccgcaggctgccggcgtgattcacacggacttcgaaaagggcttcatcaaggccgatatcgtctcctacgacgatttcgtggctgccgaaggttccatggtcaagatcaaggaggaaggcaagctacgtcaggaaggccgcgactacgtgatgcaggacggcgatatcgtcgaattcaaattcaacgtctccaaaaaataagtgtttctctggctcccctcttttgaggggagctgtcgctacaagcgactgaggagcggcacggataaggcctgagaagtcgtcttctcaggcctttgtcatgacattgttctgcaaggactggctgctgcggcagcataatgtgtgttttattattcggccttggcggcttgctggtcaatccaattgttaacgtcggtgaccgcctcgtcaagggttgctttggcggctttgtagtatttggaatctacaggttgacgatttccgcgccgaacggccagagtgcgagcttggccatcttgaacgattgcagtccgaacggaataccgataatggtgatgcagttgagtacgccggctcccagatagccgagcgccatccagcagccgaccagcaccacccacaggatgttggccaaggcagagccgactccgccgccgtattgcacggttttgccaaacggcgtcaaggtgagtcccgccatcttgaacgcttgaatgccgaacgggatgccgatgatggagatgcacagaatcagtcccaccaatgcccatccgattgcgatggccaatccaccaagaatgatccacaggatattgccgagaactcgcatgattagtccctttccgattccggtcgattccgcgcatgttcagcttcactattttgccagaaatcatgacggaaacacgagatgcaacccttagctcgcccctgattcatccccggaccgttattcaggcggagcgtatgcggtaagcccaatccttttgtgaagattttgtgtattgtcaggcatgcgtgggtttcaccgtcgatttgaatgatgataagcttctcgatgtctgccgtacgaagaccccatcaaggagatgccatgaacctgtatcgctacgcgatgttcatcgcacgcgcctgccgtgggtcgttcgtcggcaatgttctgtttgccaatccacgaatggccctattctcgatgctggtgtagcggggacacgccttatgccgggatgtaccgatggcccatccgcagtcgacgtcgcatgaatcgctcaccatagccatcaacttacgcaaagccgcgaatcgtttgccgtatatgaatgcggaacggatggcggcttttcctttacgtccggactcatcggtgtcctcgtgtcttgacacaagcatggggccggatcgccacacatgacgttaccaacagaaggaaatgctgtgacctcacagaaaaacgcggaactcgggtccgccaccagttccgtaaagcctattgatccgcacacccgattcatcgttgtgggtgtgatcgtcgtcggctcgttcatcgcgctgctcaaccagaccgtcatgtcaccggccttgccggcactgatgcgtgatttcaatatcaccaccggcaccgtgcagtgggtgaccagcgtctacatgctggtctcgggcatcatggtgccgatttcaggctatctgattgataaattctccacccgaaagctcttcgccggagctcttgccactttcatggtcggcacactgctgtgtgccgtcgcgccgaatttcatgctgttgctcgtcgggcgcatactgcaatccgccggctccggcgtgctgttgccattggtcgccgtagtgccgatgctcgtctatccgccggataagcgcggcaccgccatgggactggccggtatcgtcatggccgccggcccggctatcggcccggttgtcggtggtctggtgattgacagtttcggatggcgcccgatgttcattggcatcgcagtcgtggcactggtcatccttgtcggaggcacgatgatgctcaagaacgtcagcgagttgaagaacccaaagctcaacatcctgtccgtgatcctttcgaccatcgcgttcggtggcctgctttatggcttctcgtccgcttccacgatgggatggagcaatccggtcgtcattatctcaatcgtcgttggtcttgtggccttcgtcgcattcgtatacaagcaagtcaagctcgatgagccattgttgcgcgttgatacccttgccacccgcaacttccgcaactccgtgattctggtcactctgatcaacgccgcagtcgccgcaaccaacgtgacgttgcctatcttcatccagaatgtgctcggccaatccgccaccgtcaccggcatggtcatgctgcccgccgcggcggtcggcatcatcctgagtccggtcgccggcgccgcattcgacaaattcggccctcgcggcgtgggcatcggcggccttgcgctcatgaccatctctcttggtcttctcggcaccatcaacaccaggacatcagtgctgtttgtcgccgtgttctgcgcattgcaggcatccggtcaggctatcgccaacatgccgatcaacacttggggcgtcaacgctttgccgaacgacatgatcgcccatggaaacgccatcgccaacaccggccgccagatcgcggcagccattgcgacctcgcttctggtcaccgcagaaacatccatgaccgcctcgcacatgtcccagggtgtgaagtccgccacggccagcggcatcgcgttctcctacctgctgtgcgccgccatctcgctggtcgccctgattatctgcatcttcaccgtcaccagccgtgccaaggagaaggacgcgcgcaacgccaaggcctccgaggcgcaatcctccgccgaagtcgcggccgaaaccactgaaggccagcccgccgagcatcactacgccggcgcatacgtggcccccgccgcctccctgttcaagcaggcccaggaacagtccatcggcggaatcatggacgatcagccctacagctgcctggacagcgatgacatcacgcatgtggtgcgcgagttcatccgcctcaacgtctccagccttcccgtggtgaacggcaatggcaggctcgtcggcttcgtcagcgacggcgatgtcatgaaatcgattgccacctatgaatcccgtacggtttccaccggcaccggttcgacgatggtggtgttcgacgacgaaaccgtggcctccaaggtacaggcgctctccggcaagaaggtgatggacatcgccacgcgcaaggtcgttgccgccacgcccgaccagcatgtcggagaggtggcccgaatcctcgccaagaagcagttcaagaaactgccggtggtggatggtgatggcagactcgtcggtgtgatccgccgtaagtccgtgatggaacatgccttcgatgcgctgttcccaaaggatgatcggtgattaggcgccatcatcgctgaatagaatgaatggaatatgaggcttcccttctcgcgggggaagcctcattgctttgtccgcggagtcttacggcacctgcgcaagggcaacgtcacgccttcatgatacactattgaacagtgtgttcctatcgttgcatggtgacgctaacgcatggcgtcacgatactgaagtctgccatctaacggcgggtacggctcgttgctggagtcgtgcacgcatacgcgcgtcggcgtgcgtatgccgtgatgtgacctttgtagtggaattgaagaattgagaacactcgtatgtcttctagtcaaaaaacaactgaaccaactgtgcgcgaaacacccgaggtttccgacgatgacaatgtgaatgcgcgcgcagcggtccatagcgcgaacaaacccggtgccgcctatgccgcagcagtggccaatgaggaatccgagcgtgcgtggatccgccgtgtagtgcttctactcactggccaggcgttctcactgctgggctccaacatcgtgcaatatgccatctggtggtggattgtgatgcagacgaacagcggcatgggtatgctgctggccacgttgtttggcgtgatgccgcaggcgatcgtctcgattttcggcggctcctgggccgaccgtcacagtcgcaagttgctgattatgctgccggatatggtgattgctgtggtcaccgtcgtgctgtcgctgagcttcgcgatgggatgggtgagtctgaccatgattttcgtggtgctgttcattcgttcggcgggcggcggtgtgcagacgcccgctgtgcagtcgttcttaccggatgttgttccctcgggcaaactattgcgcgtcaactcaatatacggcgtgattaattcggcgaatatgattgtggcacctgcggtggctgctgtgcttatcaacacagtgccgctgtggtcgattctgttagtcgatgtgaccacggccattatcggcgtcggctttgtggcgttgatcaaagcgccgaagaagagcgcggaacatgttgcgaggcgtatggctgaagcggagaatagcgggcaacccgcactcgaaccgatgtcggatgccaatgctgatcgttcgctgattgccggcgtccgtcgtgtgtttgctgacttgaaagatggcttcagctacacatggcgccgggcgaacctgcgcaacgtggtgctcggtgacaccttggtgtgcttcgtggccgtggcgccgatgaaccttacgctgttgctcatgacccgcgaatatgagggcatcgatttgaatctcggattcatcaacctgaccaccgcctccgataaactcgccgccaacgagctggaatggagcatcggtatgctgctcggcggcgcgctgatgtctaccatcggtgccaagctcatccgcaacaacatgcgcgtggtcgccttcggcatcactctggtgggcgtctccgtcgttggtcttggcgtggttcacaatctgctggcgtatttgctgattgatgtggtgaacggtttggcttcggccatctgcatgggcccgatgcgcaccatcatccagaccgaggccgatgagaagatggtgggccgtgtattcggccttgacaccaccatgagcacactcagcatgccgctgggtatgttgatcttcgcgccgttggccgacgtgatcccgatttcgctggtgttcatcatcggcggtgtgctgactctgcccatcggcatctatctgttcggccaggcgcgccacaacaccagtgcacaggtgactcggacacaagcctgacagtcgcctgacagccacctcgcaggcgcaaagtcaactaccctatttgcgcatacagatcgtaagatgcatacttcggtagatcgtagacggtgatcgagaatggtgcggatcggccattgcccggccaatccacgaatgtgatatctccatagatgattgcgttctgtgcgttgcgcagtactagggaaatcttgatttgctgcccatcggatggcttgaatccgtctgttgtggcgcggacctcgccattgaacgtcgtgccgccgtccctgttgtctattttggatgttccgctgatggggaaggtagcggttccttgagcctcggtgacgttgtacgtatcagggctaagcacaacgaaatctacggtggccggggccgtgccctcgcccgcttggccggcgttatatacagtctgattcgggaatgccataatcagtgtttgcgtctgcgagaacacgatggaaccgcctttggcccgccccgtaatggtaatctgcggatactgcacctgctgggtcgtactggtgttgcgcagggcgaaagcgtagtggacatacccttgctggttcgccgaccagccggattccactattttcagaggattatcggtgacggtgtcttggccgtttccatcagcgccgtcagtgccgcctactccgcccgtgccattggcattgtcggttcctgccccgttcgaggagtgcccgccatcggccttatcggttgattggctgctggattgtgtcgaggaatcgggtgatgttgccgacccgataatgccaagttggcctgccaacacaatgcctcccgcaatagcggcgaccaccagcgccgctccgacgatggaccacagcacgatggcgcgtttgctcaagtgcagacgccgaaatagtcgagacgccgacgtgacgtcgttcgttgtgctcggtgatggcggatttgccgatgatgcgttcggcatgggcggattggactgggagaacagcgcctggcgaaactcctggacgctctgtggccgtttgctgggctcgaatgcgcacgcatagccgatgacggcgcgcagtcgtgccggtactgcggcatcatcggcaagtcgctgctcgtagtcgctggcatcgggatatacgccggtcagcatgaatccgagcagtcgaccaagcgagaacacgtcggaacgcgcgtcggttttggcgaagccatattgctcgggcgaggcgaaaccataagtgccaagcgccgtggtgtcccgcgagcgattgcttgacgctgaccatatgcgcgcaatgccgaaatcgatgagatgcgcgccgtcccgagccaggatgatattggccggcgtgatgtcgcggtggataacgccgtgctggtgaagctcctgcacggcttcgcaaatttggtcgataagctgcacggccacattcggcgcaagccgcccgttttcctccacaatttgcgcaagcgtgctgcccggcacgtaatcgtagacgatgacgaaccggtcgggcagctcgtacgtcgcttccacgcgcggcagacgattactctggcaggcgctgagcaccgcccacacattgcgttgcgctaggggagagggaatcttcttgcgtacgaacgggccgttgccgtcaatgctcaccagttcggtgacgccggaaggtccgcgagcaagcgtgcgctcaacatggtacgcatcgtcgatgctcatcgcatgcatcgcttgcttatcgtccatgtctctccttgatgccctcttacttgcgtctcactggtgagtgttgttgggccgaatgtcgtcaatcggccggcagcaacgtcgcctctcccatacgatacaactcgtcgtccgtggcaatgcggtcgaatccattgcgtatgcaccagatgataatcgcgtcacgtcgctgtttgcaccacagttcggaaacgcctgcaagacgaagcagccgttgggtttcgcgtaatgtgcacttgagaccaaaagccagcatgatggcgtgatctcggccggggcggcttttgccggagaaaatgtcataaaccactgtggcgttgaggccggatgcccgcaccacgtcggctcgtttcaggccatgggcttccatacggtcgaacagatagtcggtcagcgtgcgtgcgctgacgagtccctcatcgagatactgctcaatgctggcgctggcgagcagccgatccagcagttcctcggtcaaatgttcttcggggatgtctgccattgcctatgctccttgtcgctgtgttgcgggtgctgtgctgcgccatcgtacgcggttgctcgattcccagcgtacaggacgccgacttttcggaaacacgccgaaaaattcagttgtcagctgatgtatggcccgcgcgtgtcgccgacaatggtcgatgccatccgtgtaggtgcggtggcggaaaggatgttcatgcgcggtatcaagcatcgacaataaagctaacatgcatacaaaatgctaatttgcgtacataataacaacgccatacactggtttcgatgtatcgcagagcaaagcgagcaataagaagggacgcaatgatgagcgaacgataccggcttgccatggcagtcggattgaccgtaacggttgccgggcttgcctcttctgtgctggtaatgctgctgcttaaggaaagaagggcatcatgacaacgccatttgatcaacaacctcagccggttccaccgtccgaaggcacgaatgacgcaccggaagatcgcgcgaatgcgcctaccgtgccgaatactgtaccggctggccaaccgaacgtagcgtctgatggtgctaccaccactccgatggctccggctacggcatcgcagcggcccgccggcgcgccatttgatcgtgtatatgcggtcagtccgcaacagctgttccaagttattcacgaccagctgactactggcgccacgtttaccttggataacgaaaacacccagaccggagcgttttccttccactcctatgatggggtgaactgcacgctaaccgtagtcccgcagggtgcggcaggggccgccattcgtctggaggcgactggaaacgaaagcgccaagcgcgttgatgagttcctcgccgctctggacaagcgtattggtgtggctcctgcacccgccacacatggtgccggtgctgccactggttttgctggtgccgctgcgcctgccgtgcttgctccgaatgcacaaggggtgaagaagacttccaagctggctgtgttcgccattatttggggagtgttgttcgtactcgcccaatttgtggatgtttctggccgatcctggggcggactgctgttcgccacggtgattccggcactgctctcaggcttcgccgtatacgtgacccgcccgagtggcaaggtgcaaggccgagtgctggcctgggtggcagtcggtatcaccgttgtgggtctggtaatcggtggcgtgttcgtaattcgtgacgatgcgaaggccaaggctgatcgggcggaattggaagcatcgctcgccaccaagtgcgaagcatattcatggccggagtcggatatcgcggcgctgctgccgcagccgaaatccacaaagggtgaaattaaaagcgagtcttcggactatttctccatcgaggtgtgcggtaccgacgccaagcagtatgccgactacgtcaagtccgtgcaagacaacggtttcaccgtggactatagcaagtccgctgacagtttcaatgccaagaacgccgatggatacagtgtgagcgtttctcgtaacactgacgacgagaccatcatgtccatcactatccaggttccggaaaagaaggaagatacgtctacggacggcgacgccgcgaaacaggatgataagagcactggtacgggcactgattccagcgatgccaacaagcagagcgaccagtcttcggatcagaaggcgcagcagaacaccaatgacagtgctgacttcaaggccacgatggacagctacgaggcctttatcgatgagtatgttgccttcatgaacaaatatcagaaatccgacaacgtggtcagcatggctaccgactatgccagcatgatgaagcgttactctgagttctcccagaaggtagacgccattgacgaaaactccctcagcagtgaggattcggcctactacaccgaggtcatgactcgatgcacgcagaagctcgcatcggtgggccagtgatcagactggcgtatcgaggtaacggttttccaagaaaggaacgatgacgatacatgggtatacgcggcagacagtacacgccaatggatgagccggtcttcaacaaggccatccccggaacggaggctctggccggggcgctgaaggacacttttggcgcattccgtagtgggcttgggattaccgaacccgtggtttcggtgaattgcgaaggttgtggcgctccgctttccggtcatcgcaaagaagtcgttcgatgcgaatactgcgatcgcgaaacgcagctataaccaacatgccagcataacggccggtcttgcgattgcatagtcgcaagatcggccatatgcatgagatatcgaggaaaaaacagatggcagttattaaggcgttcgccggcgcgctcggcggtacattcgcggacctgtggcgtgatatcatcaccgctggtccgttcacggaacacaccgtcgttgtgccgggcattccccgcggaagcaacaacgatcgcggttcgaatgaatacggttccgagggaataatcaccaatggttcgcgtatctatgtgccagagaatactgcggcgttcattttctctgaaacaggtatcgaaaacgtcatcaccgagtcgggcggttatgaatatcgcaacggggagcagagcgtgctcgccggagacggcatcggatcgttcttcaatcaggttgccgatcgattcaccttcggaggtcagcctggccgcaccaaatatgtggccttcgtcaacctgcgtgagattcgtggcatcaaattcggcacttctgcgccgctggtgtataacgaccggttctatggcgtcgatttggaaattcgcgcacgcggatccatgtcgctaaaggtcgctgatccagttcgattcgttcgtaactttgtgcctgccactaccgtgtcgtattcattcgatgatgaagggccacgtaggcagattctgtctgaattcgtacagtcgtttattgtggccatcaatttgctgtccaatgaatatcgtatttcgcaattgcccggcaaggcgaatgacatcgcagcatgcgtgcgtggcgatcgggccaatgcaggtacgtggaatgatcgttttggctttgaagtgtccagtgtgggcatcgaaagtatcgagttcaccgagcaatcacgtcaactcgtgcagcagttcgcctcgaataagatgaatgttgccgcatacgagggcgtttcccagcaagctggcaatatggctgcccagcagcgcattgcgcaaggtattcaagacaacggctttggcgatggcggcatgttgcttggtatgaatatggcgcaagccatcaatcctatgactgccgccccggttcaagcgccggcacctgcgccggcaccggaagccgctgctcccgcctctcacacggcatccatgtctgtggaagaacaagtcgaggcgatgaagaaattgaaggaattggttgatatcggcattctctcccaagaagaatttgatgcaaaaaagcacgaaattctcggcctataaacggtgcattcatgcaactcgaaacagctgataatgagggaaacgctggtgcgacacggacaaaatggtgctcagggcttcgaactgggttgttcaatccgtttcgatatttcggcgactcagcgcttgttcgggccgccgtccgggaacatcaagtaggtgatgatgccggcggcggttccactggccaatgcgccggtgatgacggcgagagcctgcatcgccgtgctgagcgtgggcttgcccgttgcggcagtctttgaagccttcaatgtggcggcactgggcttgcgtttctcggtggcggcgttgtcggcaacgttgccaccgtccgtattgactggggcattgtcggcaacggcctcgccgtcctgctcttgagcgcgccgttcgcgaatgcgttgctcaatgggatcgtcgaccaaagtcttgatgatgcgtgccagatcgcggtcttcacgacgtgcgatttcggcgctgaacaccgtacgtaaagcgagatactgcagtttggtcatcgggcttttgccggtctccaagttagacaccgtctgtcgcgcgactcccagctcgtcggccagttgctgagtcgtccatccggctaccttgcgaatcggacccaggttctcctgaaacttatcaatccaccattgttcgatttcagacgccgccattacgcacctccttccacgctgtcaccagtgtacgttacctgtaccgaaatcaatccaaaaaacagtgttcatgtgaaattcactgcgtatttgcgctttcgccggcttaccgagattagccttaaacaaggaataacagagtagaagcagaaggtatgcgcgtattcgatttcgacggaaccatctatgatggcgaaagcctgttcgacttgtacctgtattccgcccggcacgacccgaaagtgttccgctacatcgcccccgtgctgcggtacgcagtcaaatacaagcttggccgggccacgcttgaacaaatggaatacggcgtgggtaagatgaccgaaggctatctcacggaactgagccgatccaaacgggtggcgagcgtcgaacagctcgtggacgacttctgggataggaactattcacgcatcaagccctggtaccagcctgagtcggacgacgtgatcctcaccgcatccttcagtctgacggtgggggaggcctgccgcagactcggcgtgaggaatctcgtggccagcgaggtggatgtggagacgatgaaggtcacgtacctcaacttcagcaccaacaaggccaaacggttccgcgaactgtacggtccggacgtcgtcatcgacgagttctacaccgactccaaattcgatcagccgatgatcgacatggcccggcacgcgttcatggtcaaggggaacaccatcacgcaagtcaagtaggaaacaacagaaaacaacacaacgtaaccaataacgaaaggggaacatatatgagcatgccgctcgatctatacgtaatccggcatggcgaatccgaagcgaacgtcatcgtccaggcgggcgagcagggcgacaattccctgtacacgcaggacaacgtcaccgtacccgaccgctcctggagactcaccgccaccggacgcaagcaggccgactgcatcggccgctggctggtcagccagcagcagctgttcgaccgctacatggtctcgccatacgtgcgcacccgcgaaaccgcagccaccatggccctgcccaaggccaaatgggaggagaaccgtgtgctgcgcgaacgttcttggggcgagatcaacaccatcaccaaggacgaattcaaaaacaactacgcgcgcaactggaacttcaagaacaccgatccgctgtactggcgtccgccggcaggcgagtcgattgccgatgtggccgaggaccgtgtgcacaacatcctgacctcgctgagccgcaaatccgattcggaatccgtggtcatggtcacccacggcgacttcatgctcgccctgatgctcaccatcgaggatttggccgacgaggaattcctgcatcgcgccgattcggacgactggaagatcaccaactgcacctgcctgcactatacacgccgcgacccggaaaccggccgcacctccaagcgtgtgcgctgggagcagaccgcccggcccgtgctcgacgagacgaccggccgctgggaggtcaaggtggagccgtggcgcgaattcaagcgcccgtatctctccaatggcgatttggtggatgtggtgcaggccgtcgacccacacctgctggagtattacggcaaatagcctttcccggaagagagacttcacaaaatcttcgtgagctagaatggtgcgtggtgcggctggttgtgaatgccgtgccccaagcgagagcgaggagagtagtaatgtccaatatcttccaatggcaattgcatggcgacggcaagacgctggcgcccggcgaggtagtcgagcccgatgaacgtctgacttgggtgcgcaccgccggtatcggcgcacagcacgtcatcgccatgttcggtgccaccttcctggtgccgattctgacgggcttcgacccgtccaccaccctgttcttcacggctatgtccaccgcactgttcctgcttatcaacaggaacgtgctgccgagctatttgggctcgtccttcggcttcattgcaccgatcaccgcggtctccaccgccaacaagggcattgcggtcgccagcttcggcatcatggtcaccggtattctgctggccctggttggcgtgctcgtgcattacgccggctccaaatggatcgacatcatcatgccgcccgtggtcaacggcgcgattgtggccatcatcggcttcaatctggcaccttccgtgtggaccaacttccaagccgcgcccgacaccgcactggttaccctgttggccgtgctgctcgtggccgtgctgttcaagggcttgctgggccgcctcaatattttggtcggcgtgatcatcggctatgtatatgcctgcatccgtggccaggtcgacttctccgccatcggcgacgccgcatggatcggcttcccgaagttccacctgccgcaggccgatttctccatccttcccatgttcatccccgttgtgctcgtgcttgtggctgagaacgtcggccatgtcaagtccgtggcccaaatgaccggccgcgactacgacaaccagatcggcaccgccctcatggccgatggcctgggcaccacgctcgccggcttcggcggcggctccggcaccaccacctacggcgagaacatcggcgtgatggccgccaccaaggtgtactccaccgccgcctactggtgcgccgccgccttcgccctgatcctgagcctgtgcccgaagttcggtgccgtgatcaacacgatccccgccggcgtgctcggtggcgtgaccacgctgctgtatggcatgatcggcatgatcggtatccgcatctgggtggagaacaaggtcaacttcgacaagccgctgaacatcatggtggcagccatcaccatgatcattgccatcggccaattcgcgttcactgttggtggcatttccttcaacggcattgccattggcacgatcgtgattcttgtggcctaccacggcctgaaggccattggcaaggcaaccggcactattgccaaagacgatccggatattttgtagtgtgttttagggctactgggctgtattttggctcagcccttttgcacaatggcccctaccttcacgggtaggggccatttgcgtgttccatggagcggtgctcgccttacgtggtggtaaaacccatggggcggcaaacatcccatggggtggtaaaaccctcatggggcggtaggtgaaaatggctttattctgcggtttcacaatttcttcaaaccgccccatgggcaagttaccgccccgtggggtcataagtaaagagtgggatgacagtgtggcgagcaccaagcaaagtagggggcttacgctaagctcggaaagcttgcgtaatttgcgtaacctttgacatgaaaggccactgtgccccgtaataatttcgatgatcgtgacgattccgctgatttccagatgaacgacagcgcggaatcccgcccccttacctttggcgaacttggcgtacccggaccgctggtgcgcgtgcttgcggcagatgacaagaagaccgcattccccattcaggccgacaccctgcccgattcactggccggccgcgacattctcggccgagggcgcaccggctccggcaaaaccctcgcattctccattccgctggtcacccgcctcggttcctacgattcgttcggcgaaatcgcgatggaggagttccgcaaggaaatcaagcgccgcaagaaggccagcctggaagagcgccgcgccgacgacttcctaccgcacccgcgcggcctggtgctggcccccacccgcgagctcgcgaaccagatcaacgacgtgctgatgccgctggcccacacgttcggcatgaacaccaccacggtgtacggcggcgtcaagtacatccaccagatccgcgatctgaaggccggcgccgatatcgtggtcgcctgcccgggccgccttgaggacctgctgcgccagcaggcgctcacgctctcgtccgtcgaagtcgtggtcatcgatgaggccgacgaaatggccgatatgggcttcctgccaccggtcaagcgactgcttgagcagatttcgcccgacgcccagcacatgctgttctccgccacgctcgatcacggcgtggatgaagtggtgaacaccttcctgcacgatcccaaggtgcacgaggtcgattcggccaccgccgaacccgacctgatgacccaccacgtgttcgaaaccacgcgcggcgacaagcacgaactcgtgcgcatgctcgcctcgggcgaaggccgccgcatcctgttcacccgcaccaagttccaggccaagaagctcgccaagaacctgacgcagaacggcattccggccgccgagctgcacggcaacctgaaccagaaccagcgcgatcgcaacctcgctgcgttcgattccggcgatgtgcgtgtcatggtggccaccgacgtggccgcccgtggcatagacgtcggcggcgtggagctcgtggtgcaggtcgagccgccggccgacccgaagtcctttgtgcaccgctccggtcgtaccgcccgcgccggcaaggcgggcgacgtggtcaccctcgtgctgcccgagcagcgccgcgagacgcgccgcttgctgaaccaggccggcatcaagaccaagatgatcgaagtgacccacgattcgcccgaagtgcttgagcttgtgggcgaccgcgccgagcgcgtggatggttggagcctcgacaagtcgcagcccgtgggcaacccgcgcaagggcaagaacaggggcgccaagaacgcggcgggcgacgagtccggccgcggcggcaagcgcaagcacaatcgcaatcgcaaccgtgacgagcagaacgttgccgagaccgagttccagcacgagaacgcaggcggcgagtttgttgccgaaggcgagccgcagcgcaagcacggcgacaaggccagcaagaaggccgtgaagaagaaccgcaaccgtgcggaacgccgcgcaggcatgagcaaccccgaggccgagcgccgcgactatctgttcgagcatggcgatgaccgccgcgaggagcgccgcaagggcgaccgtcgcgacggatacggcaagaaccggtacgacgagcgtcaggacaatggccgcgaccagcacggcaagaaccgtcgcaatgatcggtacggcaagggcgacaagttcgataagcgcgacagggccggatacggtcgcaacgatgatttcggcagccgcaggcacaatgcgggccgtgatttcgaacggtccgattcccgcgatttcgagcgtccgcgcaagcctcgccgcaatgaacgcagccacgaggattacggcttctcctatgacgagcgctcccatgacggccgcagacagtccatgcgcaacacccgtcagggcgaaggcggcaagcgcatccatcgcaagaacgagaaccgcatcgtacgcgacgagcgttcagaaggtgccaagcgtcacgaacgccgcatgatcgccaaatacggcaacacggaaggcccgaaccgccgtcattccaagaagaatcgccacaatgcgccattccgtatgaagtctggacgccgttagtccgacagcgcgtatgaatcaggcccgacgacctttgatggtcgtcgggcctgattgtgttataggccggtgtttgcgatgcggatgcctgttcgcctgcctagcggccatgacgattgcacttatcgccgcagtcgttgtgatcgtggccatgccgaaacggcggtaatggcctgtacgcaccctagaataacggatatgacgcaatcgcagccccgatccaaacgcacgcccacccttgaaatccacgggagaatccttgacgcggcaaggcggatcgtggaacgggacggtgtggatggtctgaccatccgtgcgctgtccgcacaggccgatgtgtcgcccaccagcatctaccagcacatcggcggcaagcaggcggtgtgcgatgcgctcatcgacacatacttcaccgatctgcgcgaacagctcatcgccattgacgaatccgaccccgtgctgcgcctgcgcagggcgggcataatctaccgtgaacacgcgctggacgcccccggcatttacgcgctggtctggatggggcaggcgtcggactcggcccagcactgcctggacgccatcacgcagatcattcgatacggccaggcagcatctgtattccgcggcgatgacccccatctaatcgcatcctccatctgggtgtccatacacgggttcatccaattcgaactgcgttccgcacaaccccgcacacgcggccgcgagcgggtcgaccggtcgtacggttacctgctcgacctgctgatccgaggcattcagaggtgaatgagttagctccctctgatgagggagctcagtattgatacgctgtactgccatcggcgttgcggatggtgaaagtgggggattgctcgatgttgaggtccacggtcagggaatgctgggcgtcggcgctcgtcgaacgatagacgaagtgcttgttttccagcttcacggcctcggtacgcgcatccagcagccatgggttgcgacggcgcagcgcgatcagcgcctgatgcagccggtatgtcggctctcccagcgtggacagttcggcaggggagtcggggaacttcggacgtacgtcgtcatcgccgccgaaacgctcctgcttgacgcccacatagccctgttcgtcgccgtaatagatgcttggtacgccgccgaccgtcatgagcaccgccaatgccaacgccgccttggccgggccaatctgcgatgcgatacgcgtcacgtcatggttgccgatgaacgtctgcggcacgaaggaatccaggaacgcgttgtgccgcttcaagttccaatccagctcgaagaagttctccgtctccagcgcatgctggatcgacttccatagctcgtattgcgtgatcgaatccatcgtggattcctcgatgatgcgcgggtaatcgccatggatcacctcgccgaaaatccacgaatacgggtgtgcggctttgacttgcggcaacacgcgcgcccagaacgggctcggcacggcatacgcggcgtcgaggcgccagccggcggctccgcgatccagccaatggctcatcacatgggccacatagtcaacggtctcgtcagccgaatggtccagcgccaccagatccccgtgcccctcgaacacatccaaagcgggttcgccattatcaccgacatgcgcgcggaccagaccatgccacgggttgtcggccggattcaagcgtccggcggtctcgtcaagcgccgtctgaacggccggatgattgcggctcacatgattgaacacgccatccagcatcacctgcaatcccatgtcccggcaggccgcgacaagctgatcgaacgcggcatccccgcccaatcgcacatcgatatgcatatggtcgagcgtgtcgtatccatgcgtcgccgactcgaacaccggacccagcagcaggccggacgcgcctagatcgcgcacgtactccagccagggaattatcgcgtcaaggccgcggccatggaactggcgcgggccggcgggcctgatatcggcaccgcagaagcccagcggatacacgtgccagaacaccccgtacttcacccaatcgggcattgtgcggctcgaatccatgcttacaaccactgtgcacctcctgattgacaccgtgtccattttcgcacatcgcggtgcgaatcccgggtaatcggcatgaaacgcagtccgtgaacatgtggccaagctcacatattgggacattttcctgaggcgctacatgccgtggctacgcttccaaccagtgccataagcagacgagagataccccaaaagggtcgcaatgaagagaacctttcccgcaaaggttattgaagaggaacagagggttattatgaccaccgccgcagcccaggccccggcacctggcaagttggaattcaaggacgattacacgccggacgaagccgaacgtgtgattcgcaattcgaagggactgcccgtaggcgtgcgtcccaaaatggtatggacatggaagaaggccctgctgtgggccgccatcgccatcgtatgtgcctgcggatgggcgattctggccgtctcgcgcggtgagcagatctccgccatctggttcctggtcgtggcgctgagctcctacgccatcgcctaccgcttctatgcctattacatccagatcaagatcatgcgcaccgacgacgcgaacgccaccccggccgagcgcgtgcatgacggcgcgaacttcgaacgcaccgaccgccgcgtgctcttcggccagcactttgccggcatctccggcgccggaccgctcgtcggcccgatcctggccgcgcagatgggctacctgccctccactctgtggatcatcctcggcgtgattttcgccggcgccgtgcaggacatgctggtgctgtggatctccgccaagcgccgcggtcgctctctgggccagatggccactgatgaaatgggtaagttcggcggtatgatcctatccatcttcctcgtggtgatgacggccatcgccatggcattcctggcgctcgtggccatcaaggccatggccgcctcgccgtgggccgtgttctccatcggtatgaccatcccgatcgccctgatcatgggctgctaccagcgtttcctgcgccccggccgtgtcattgagaccacgctgctcggtttcgtgctgctcgtgctcgacatcgtcgccggcggatggatcgcctctatcccggccgtggccgccgtgttcacactggacgccaagcagctcgtcatcgccctggtgatctactcgttcgccgccgccgcgctgccgcactggctgctcgtcaccccgcgcgactacctgtccacgctgatgaagatcggcacgctcgtgctgctcgtcatcggcatcatcatcgccaacccgtccgtcaaggtgccgggtctgaccgaactggcctccacctccaccggcccgaccttctccggcaacctattcccgttcctgttcatcaccatcgcctgcggcgccctctctggcttccacggcgcggtgagctccggcctgaccccgaaggccgtggagaaggagaaccagattcgcatgatcggctacggttcgatgctcgtcgaatcgttcaccgccgtcatcgcgctgatcgccgcgatcaccatctcgcagggcgtgtacttctccaccaacatgtccgccgcacagatcaccgccgcatccggcgtgagcatctccgccacctccacgccgggcgaacaggccgatgccgccgtcaaggccgtggagtcgatgaaggtctccgacatcgaaggcaaccagatgcaggtcacctgggattccgtggacgagaacggcgcggccaagacctacgaaggcgccgcggcgcttgagcaggccgccgccgacatcggcgagacctccatcgtctcccgcaccggtggcgccaccacgttcgccatgggcatggccaacttcctcaagtcctacctgggcggccacgactcgatggccttctggtaccacttcgccatcatgttcgaagccctgttcatcctgaccaccgtggacaacggcacccgcgtggcccgctaccagatcggcgaaatgctcggcaacgtgcgcaagctcaagaagttcgccgacccgacctggaagcccggcaacatcatcaccacgctgatcgccaccgcgctgtggggcggactgctgtggatgggcgtgtccgacgcgaacggcggcatcaacgcgatggtgcctatcttcggcatctccaaccagctgctcgccgccgcctgcttcgtgctgatcaccgtgtgtgtggccaagatgggctactggaagcacctgtggataccggtggtaccgctcgtgtgggacatcgccgtgaccttcaccgccgacttccagaagatcttcgggccgctgagctacttcaccaccgcctccaagtatcaggcgcagatcgactccggcgagctgaccggcgaggcgctgaccaacgccaaggccgcgctgtccaacgcgtatctggacggcgtgctctccgtgttcttcctggtcatgatgggcgtcttcgtggtagtcggcatcgtggtcgtggcgcgcacgttcgccgctggcaagtacggtgccgaaacgacgtccgaggagccgttcgtggaatcccagtggttcgcgccctccagcctggtcgccaccgcgcttgagaagaaggtgcagcgcgaatacagcgccaagctgcatgagcttgtgcggaacgggcaggttgcagcgtagtgcgtcattggctccccttttttcaaggggagccaataatcagcgaaaggagacaaaatgctcggcaaactcgttgccgtatggcacggcatcgtctggtatctgcgtgagatcagcggcgaggcccgctacgaccattatcttgagcatttcgcggccgagcatcccggcgaaacaccgatgagcgaggtcgaattcattcgcgcccgcgaggaatacgaccgtctccaccccaataccagttgttgctgctgacaggccgcaatagcataacaacaccataaaacccgcgcgccatgggaactacgtagccattcttccgttacaatcagtgtgacggcttccgccccgaagaagaaggtgttaattccccttggacgtctcactggcgcatttcctccaacaagtgctttccaacccggctctgaccgtcacaacgttgctgacgctgggagtcatcttcgtcaacggctggaccgacgcacccaacgccatcgccacctgcgtgaccacacgatgcatgcgcgtacgctccgccgtcatcatggcggccatcttcaacttcctcggcgtcttcatcatgacgcagctcaacgcctccgtggcctccaccatcagcaacatggtcgatttcggcggcgacacgaacgcggcgctcatcgccctatgcgcggcgctgttctccatcgtcgtatacagcgtgggcgcctcgctgctcggcatacccacctccgaaagccacagcctgatcgccggcctgtccggagcggccatcgccatccaaggcggcatcggcggcatcaacatgggagaatgggtcaaggtgctctacggtctggtcgcaagcctcctgttcggcttcgccgtcggctggttggtatgcaaggccgtgaccctgatttgcgctggcatggaccgccgccgcaccaacgggttcttcacctacgcgcagatcgtgggcgcggcggccatgagcttcatgcacggcgcgcaggacggccagaagttcatcggcgtgctgttcctcggcatggcgttctgcaatggccaacccagcgtgaccggtgtgatgattccgatctggctcatgattctgtgcagcaccatcatgggcgtgggcacgtccgtcggcggtgaacgcatcatcaaatccgtgggccaggacatggtgaaactcgagaaataccaaggcttctcggccgatctgtcaagcgcgctgtgcctgctcgtcatgaccgtgctcggcatccccgtctccaccacgcacaccaagaccagcgccatcatgggcgtgggcgcggtacgccgcctctccgccatcaacttcggcgtggtgcgcgacatgatgctcacctgggtgttcaccttccctggttgcggtctcatcagcttcgtaatggccaaactgttcatggtcgtgttctagaaaggaatccacccatcatggcgagacaaaaagacacgttctacttcgacggattccgccgcagcgcggactacgcatgccaggccgcgaagctgctgtccgaggtcatgcacgacttcaatccgggccagctgcgcgaacgcatggacagcatgcacgcgattgagaagtcagcggacgaggtgcgccacgacatgatggacgaactggtgaccgcgttcatcacgccgttcgaccgcgaggacatcgacgagctcggccacgtgctcgacgacgtgaccgacagcatcgaaggcgtgctcaaccgcatgtactacgacaacgtgaccgacatgcgcgacgacgcggtccagatgtcggatatggtggtgcgcgccacggaaagcatctgcgagctggtcaacgaactgccgcgattccggcattccaagacgttgcgcgaactggtgttcgccatcaacacgatcgaaacggacgccgaccacctgttcatcgagtcgatgcgcacgctgcacaccacctgcaccgatccgctgcaggtgttcgcctggcatgacgtctaccgtcacctcgaacagtgctccgacgactgcgagcgcgtggccaacaccatcgacagtatcgtcatgaaaaacagctgaggttggtttttcacaacctccctctgatgagccgagccgtgaagaaaacgccggaggcgtttttaggcgagggtgagtgacaacgagcgaataagaggtcagctgcaagctgtcctgaatcgcgttcgaggtggcatcgcgaagcgatgtcggagggagaggcctacttgaccaaaagccccctcacctatgggcgttgagccagaggatggcgagttgggtgcgattggtcaggccgagcttgtccagtatcgcgctgatgcgattgcggaccgtgccttcgctcaggaacagtctggcggcgatgtcgcggttatcgaggccctcggcgaccagcgcggtgatctcacgttcgcgctcgccaagcaggccctcgatggaatcggcggtatctctggaatcgtcggaatcggcaggatccggagttcgttcggtgagcttgccgagcacttccgcgccgagcaccacctgaccggccatcaccgcctgcagcgcgggcccgaccgccgccacatcctgtttgatgagatagcccttggcgccaagtcccatcgcctgcgcgatatacgactggtccgcaaacgtggtcaggaacagtatgcgcgcggccgggtccgtggccagaatctcgcgcgcggcatccaaaccgctggtgccgggcatctgaatatcgatcagcagcacgtccggtcggctcgccggtgtctcgaaataacggcgcacggcggcgtctccgtcatttgccatccatagcacctcggccgtgccggtggccgtcagaatcgtctccaacgactggcagacgatcggatcatcatccacgattgcgattctcatcaatccctcgattccatggtccaacgcttcttcggcacggatacgaacacacgccagccgtcctcatacggcccgcagaccgcggtgccgccaagggcgcgcacgcgcgattcgatatccgccaaacccatgccgcgcatcagctcatcggccgaaccacgcatatcggcaacgccgtcggcggcgagtcgcgagccgacgtgcgtggcgcgcatcgcacgcgggcgggcagcggccgtccgggacccatcggactcggacacggccggccccggatcctgaatgaccaactgccagaacgcggggaagtcacgcaacgtcacgctcgcctcgcgcgccgcgctgtgatgcaccacgttcgacaatgcctcgcgaatcacggtcgcgaaacagcgcgagaccggcgcaggcgccttggcgatatcgttggccagcgtcacggcgaaaccgggggagatgccgtcgaacgacgtgacggcatcatcgatctgcgcggcgaaatcagtgccatcatcctcaagatcatgcaccgaacggcgcactatcgtcatcgcatcatccaacgtcgcacccaacgtggcgaacccttgcgcagcgaccgtatcgttcgtcgccttggccaccgttttgccggcctgcgcctgcatgatcgcgcgggtcagcagatggcccacattgtcgtggatctcccgggcgatacgcgtgcgctcgccgagggtcgccatgcgaatcgactgggcgcgttcctcatcgatgtcggcgatgcgcgaacgagtggcccgcgaggattcgcgcgccctgtcctgcgcgtgcagcaacgcgcgccgcgcctcgtccgaggaggcgcgggcccggcccagaacgaatccaagcagggcgaccagcgtcatcaccagcgtctggagacggtcggtgccacgggcgaaccagagcgcgatcagcggcaacacccatatccagcgcgcggcggccgaaagccacggggccgaacgcattgcatcggcaagggaacggcgagaggccgcggtccgcgagacactgggggagcggccacttgccgcagtccgtgccccagcccgggctccggtcgaggcgagggccggcagccgtgcagtatcgtaggcgatgagcggcatgaacgcgcaccatgaaggcaccgccacggcgatgacgagatacgccgtacacaagacccaagaccattgcgcgggacgcagccattccaccaatccggcgacggaaacggccaacagcaggccggcgatgaacacgccatcggaccgtagcctgacaagccaggccaaagccaggcccaacacgagtagcaagcccatctcggccaacacgcgcatggcacctccccggctcgacgctcttccaccaccagtctagcggtgtgcggaacacgacgaacttgacgggcgtgcggaattacccgcatgacggtccaagacaacgggcctacacttcccgaatagatgaggcacaagcgtcggatgtcgtcgacacaaccgtaaagggatgataccgatgattacgcaaagccacagggcgtccaactattcgatggacgagatcagcctgatgccggtcgataaggtgtacaaggccatgcagaccgacgccgaaggactgtaatgacaaatgtcacgcctgtacggccaagtcgtgacgtttgcctgtggcggcgtccggccccttcttgggatgatggaatcgccaaggaagggagtgactatgacaaccgacaacagagcttccgaacacgactcgacaaccaacccggctctggccgtgcacgtcagccaactggtcaaacgctacggcgacatggtggcgctcgactattttgaccttgacgtgaaccagggcgagattttcgggctgcttggaccgaacgggtccggcaaaaccaccgcgatcaactgcatcctcgcgctgctcacctacgattcgggcacgattcgcgtgttcggccagccgatgacgccgacctcctacgcgctgaaacgtcgtatcggcatcgtgccgcagaacgtggccgtgttcaacgaactgaccgtcaccgaaaacatcgactacttctgctcgctgtacgtgccgaagaaaaccgaccgcgcgccgctggtcgaggagtccatcgaattcgtcggactccaggacttccgcaagttccggcccggcaaactgtccggcggtctgctgcgacgcctgaacatcgcctgcggcatcgcgcacaagcctaacctgatcttcttcgacgaacccacggtcgccgtcgacccgcaaagccgcaattcgattctggaaggcatccagcggctcaaccaggccggcgccacggtgatctacaccagccactacatggaggaggtcgaacagatctgcgaccgcatcctcatcatggaccacggccggcacctggcgctcggaaccgccgacgagctcaagaacatgatcgacacgggcgagcgcatcaccatcgaaacgctcgatctggcggattcggcgatggccgaggtccgtgcgctgccgtgcgtgatcgaagccacctacgacggcaaggaactcgacgtgcgatgccgtcgcggcgaacacaacctgaccgacgtgctcgacgcggtgaaacgctccggcgccaacatcggccacctgaccagtcgcccgcccaccctcaacgacgtgttcctcgaactcaccggcaaagcactgagggactgaccatgctcccctcagtcggcaagcaaataacttggctcccctctccgaggggagctgtcaccaaaggtgactgaggggagttcctgagtaaggagacatcatgtggaccacatttctggtcgcattgaaagcgaacttgcgtaaccggtcggcgttgttctggatgaccgtgttcccgattgtgctggcgaccatgttcaacggactgttcggcgggctggccgaagcatacgaactcaagccggtgccgatggccgtcatcgaagacacccgttggcagcaggcggacggtgcccgcaccttcgtagacgcgctggccggggaaacggaatcggcctcagacgacacgacctacgccgaaatcgaccaaaagctgctgaccatcaccacagtcgacaccgtgaaggaggccgaacaacggctcgccgacggcactgccaacggctatctgaccgccgacaataacggccgattggcgatgaccgtgagccgggaaaccgccgtcacagccaaggactccacgcaaaacagcggactggacattagcctcgcggccctgcgcagcgtcatcgacctgtacaaccgcaccgacgccgttacccggcagaccatcgccgacaatccacaggccgcgctcagccggaacttctggaacagcgtcgggcagaacgtcgacatgacccatgagacgacgctcacgcatttccagcctgacgagatcgcccgatactattacgcgctgctggccatgtcctgcatgatggccatgggatactccatcagcacagtcgccgccgcacaggcgaacctgtccgcgctgggcatacggcggaccgtagcgccgctgagccgggccaaacagctcgtcgcgggcttcctctcctgctggctgtgctcgtcggtcgccctgtccatcgcattggcctatatccggctcgcctgcaacgtctcgctcggcggacgcgaaccggcggcgatcctcgcggtcatcatcgcctcgttcatgaccagctcagcaggcaccctgctcggtgcggtgccgaagctctcgtacaacacgaaatacgggctgtcgaccggcatctcctgcacgctgtcgctgttcaccggactgtacggcgggtttgccatgcagatcagcgactggatagcccgcaacgcgcccatactcggcaccatcaaccccgcacagcaggtgacgaacctgttctacgacatcctgtactacgacagctaccggccgttcatcaccacctgcatcattctgctggcgatgagcgcggtattcctcttggccggcatcgcaatgctgaggaggcaacgttatgaacacctgtaaagccacgctgcgcgtgctgttcgcgcaccgggtctacctgatgatctacctcgtattcataggcatcctgatgatgtccatcagctgggcgatgctgacctccgcatccggctccatgtccgcggtgttcgaatcgaccaagacgcgcgtcgccatcatcgaccgcgactccgaccggggtgatatcgccacgtcgatgcgcgcctacctgcgcgattccagcgaactggtggacctcgacgacaccagcgaaacgctgcaacaggccgtcgcctcgaactgggtggacctgatcgtcatcattcccgacggattcgctgacgattatgtcgccgcggcggcggacggcgacaatccgccgaacgtggacacggttaccagctacgcatccggctccgggtcgatggcgcggatgaacgtcggcgggttcctctcgctcacccgcaccgcactgatcggcgcgcagacgagggtcgaccaggcggcgctcgccggcatgatgaacgctacaggaggggccgccggttttgatggcgcgagtctggaccaagacatgctggactcgctgccggaagggcaagtcgacaagccggatatcaaggatctgtcccaggccgccaaaatggccgccgaatcggccagcgatacagacgtgaaccatcagatcgccgtggtcgatacgccgaccgaggagtcggcaagcgctgcggatacggcggtcagcggattcggcggcaccatgaaaaccgcgctgtacccgctgtccctggcgatgaccatctgcggatcgatgatcctgggcgcgttcaccaccggcgaggtgcggcggcgtctcaccgcctcgccccgacgcatggtcctgatgggactccagcggttgctgacgttgggcggattcgcgctcgtcgtatgcgtcggctatttggtgctgtcaatcggtctgatgatggcggcggggctcgatccgttgcacctgagcgtcgggggagtgctgatgacgttcggcgcgacctgcgtgtacgcgctgatgaccgtcgcctgcggattcatgctcagcgagttcgggctctcggaagaggcggccaacgggttcgccaacatcttcggcctgctcatcatgttcacgtcgggtgtcgcattgccgattgacatgatgcccggcgtgatggtgaccatagccaagttcctgcccggctggtggtattgcaccgcgatcgacaacgcgctcggcttcggcacggcggcggaaaccggcataagcgtcgccggctggtccggctcgctgggattggtcgcactgttcggtgtgatgttcatctgcatcggcctggccgccggccgcttccgccgatcccgccccgccctggccgcgcctgccaccacgcagctggccgagtgagaaatcagcctttcaaccgataccgctgtgccgggtcgtcggcgaacttgacttgggcgacccgcccttccttcatcagctcgcgcataccggatgtggcggccagcggcgtcaactgtagttcgcgcatgatctccttgacgctcatggccgaatgccgctccagtacggtcataatcgccttgaccacgtcgcccggtgaactgttcgccatcgtgcgctgcttggtgatggtcatcgtgaacgtgttgatgtcgttgcgcgtggtcgccggctcgatgccggcctcgcgcaacgcggcggcgatgcgctggtagccgtcgccgccttccgggttcacaaacccgccgcccggatacggcgtggactccagcagcgtgaacaggaactggtttcgggtggagacgaacggcgcgcccgtcaccggatgagggctcgccagcacatcatgtgtcaccatgccgtacaggccacccggattggtgatctcgatgcgatcggtgaacacgctgatatgcacctgcgtgccgcgcgcatcgggcgaataatcacggtgggtgagcgcgttcgcaatcgcctcgcgcaacacgagcggcggatagtcgggcttcttcgcgccaatccaacgcatcaacgagtcgaccgcatcgtcgatcatcaccggaatcgaaccgaccaccgacttcgaggcgaccaatcgttcgtcgccccggaacacatcgtcccggctcgtccccggaaacacggctatcgaaatgccgagccgcggatagaacttctgcggatagcggcccaacgccagcagtccggccaaggtggggcgcaggattccgccgacctccgactcgtcggaatcatcatggcgcaacacctgcagatccagcagcacatcgatgccgtctcggtcggcgaacacgcgcggatgctgttcgcgcacgcgtgccaacagtccggcaacaagctgcgggtcgaggtcatcggtcgtggcgtcgggcacgatatccagatcgtatgtgggctgcagatgctcctcgatgagccggtcgacctcataggaggtcatgcgccggtcgccgtcgccggtacggatgaacgagccgccgtgcggtccgagcgcggtggtgaagcagggcttgtcgcgcggcagcatctcgtcgatgcgcgcgaacaccagattcgcgccttcgaacgggcaggtgacgattacgggccgcaccaccggcgtcatcttctcgcacgcctggctcagcgcctcctgcatggcgcgcgcgtcgaatccctcgaccggcgtgaacccgttcttttcggacaggcccaggataatccagccgccggagccattggagaacgcggacagcgtatcggtgatggtcgaggagatcttgcgcttgcattccttgacctcgcactgttgcgtatcgttgccgatcagacgcatgagttcgatcagctcagtcattttggcagtatagtcatcgaccatggcggcctccttgaaaccattgtgccccataatccgccgcccgctcgcctccagccccgccagttcaccccaattcatgcagaattcatgggccaaaccagacgaaacgaacgtcgatgtagggttcggttccgcgtgttcgccgatgatatcggccggtcgaggcgggcgggctatgttgggtggcgtgggaatcttgcgcgtgattgatgctacggctgtgtgcttcgctctgggtatatccggcccgatcagcgggactcagccaatgtgatgccgcccgcagccatctgcttgcgggccgcaacaccaagttcctcgctgaccggcacggtcagatcctcgaacacggtgacctcgaagccgagcttcttggcatcgagcgcggtgtccttgacacaatgcgattcggcgatgcccaccacatccacgcgactcacgccggcggccttcagcgcgttggccagcgtcttgccggcggattgctcggcctcgacctcctcgcgggtctggatacggtcggtattgtcctcgataccctcaaaaccggaatatgccgccgaatactggcccttcttgaaatgatgctcgatattcagcgccttgatcgccggatgcaattcggcgttcagcgtgccggccgcaccatgcttcggccacgtgtccacgaaatccggctccgccgaccagtgcgcgcccggctcgatatgccagtcctgcgtggttgcgatatacgcgtactcgctgcgatgcgcgttcacataatcggcaatccgctcggcgaccgcgttgccgcctgcgacacccagttcgccgctttcacagaacgtcggctgcacatccaccacaatcagtgccttggtcatcgtcattccccttattgccttggattcgttttgaatattgtctcgaactcgacgtgcgattgctctcatcatagccatgcgcggccctgtgggaaacgttcgggcttacactgcaagcagcaatcgaatacaagaaccaggggagggcgaccaagaccatgctggaccatctgacgttgcacgtgaaagacatcgaccgtagcatcacattctacaaacaggcgctcgcaccgctcggctatatcgtcaaggcgcatcatgagcctacgctcggattcggcgtggatgacggaaccctgcactccgatttctacgtgtcaccgattgaagggctggaggcggaggcttcgccggtcacgccggtcacacacatcgcgttcttggctgacagtcagcaagccgtgcaggcgttccatgcagccgcgctcgccgccggcggccgagacaacggcgctcccggtccgcgcccgtaccatcccggctattactccgcattcgtgctggacccggatggcaataacatcgaagccgtcgtggattgggctcattcgaacgagtaaaaacatatccgtatcgtgcctcaggcggcatcgacggcgtaggctccaaccagtcggatttgtggtcgcaacggcggtataggtcacatcacgcaagcgtgaaggtgatggtctgctcggcggtttcggtgccgatccatgtgccggctttgcggttccaatccatgccgtccgcgtgcagtgcgtcaatgccgtattgacgtgcatgcgtgaccagccagcctgccgtctgccagcaaagtcgagtgcggttgtcggcggacaggccgtccggcagcgtgatcgtcaacgttgtgctggccgtattggtcgcagcgccgttgttcgtgccggttttgccatttgggggcacaaccgagacattgacattcggcagtgtacctcctatggcgacaaccaacccgtccgcgtccgaggaggttgctggctccaacgcgcacgtgacgcccgccgaccgttcaccggtcagccccgaggcccaagcgcgtgccatcgcatcccatgcggcatatagttccgggtagcctgagcgctgcacctcctgcgcggcgtcctccaccggaatcgtctcccaatccggcacctgcagcagatgatcgtagaagatgtttgtcgcataggtcatgtcggacacctgctccgccgtgccccagccttggctgggccgctgttggaacaggccgagcgaatccaagtcgccgtagtccagattcgtcagcctcgactcctgcatggccgtggcgatggccaccgtcgccgcgtgatccggcagtccgcgcgtgacggcgatgttcgcaatcagcgccgcgttctgcgcctgatcaggcgtcaaggtgcggcgggctccgtcggacgacaccgccgcgcaatatgcttcctcggccgtgcgcgcggtctcgcgaggcgtgaatagccgtggcagcagcgtccatgccgcgatcagcgccgcaacaacaagtatgacggctgcaatcagcgcgcccgcgccatgggagcggcgtctgccgtaccgcacctgttgtcccattgcgcctccaatatttcggtgtcatggctgaccgtgaccggctggcctatgcagcatgcgggatttgccgtgttccggctcggccgtcatcatgacagcgtggcatatccacctgaacggcggctgcgtcatcacgcgactttgtgacaagtcttcacgcttcatgacatccgcgcaaatcagcccctcgaaaccgagaatggcggtcgggattgctccgacaccaagggagctgctgccgctattgtgtgaaaggcgatttgtaccgggttgaaggagaggaacacatggcgcaattgcagccgtactgcgcgattgagggcaatgatgatggattgcccgtcgtgttcgtgcatggcatgggtgtggaccatcgttcgctgatgatgctcgacaaggcgtttgacggcaatgattcaattcgccgtatatatctggatctgcccggtttcggccgtacgccggcattgcccgagcatgcctgcgggctgccggaaatggcggattggctgcaaacggccattgacggtcttgtcggtaaagcggctccattcgccatggtcggcaactcgatgggcggtgcgcttgtccgcgaagtattggcgcgcgaacctcgccgagtggccggtatggtattgatcgcgccggtcgtggacccgcagcatgccggccggcatgtggccgaacatgtggttgcacagcccaatcccaagctgacgcactccttgccgcaggaacaggtgttcgatttcattaccatgggcgtcaaccagtcattcgacgcgtggcgacgctaccaacggttcatcctgcccggcgtggcgttgtgcgaccgtgcggcatgcgaacgactggatcagcgctattggctggccgataatcccgaggaaatgctcggcacatatgcgggtccggtgctcatcgtcaccggcaagcaagaccagatcgtcggatacgaagatcagcaagccctgttgccgcactatcccaacgccaccttcgtgacgctggacaatgccggtcacaacgcgcacatcgaccaacccgaagccgtcatcacgctcgtgcgcgaatgggtggctcatatggcgttcgctccgttgagctgacggtctgctgacagtctgccgaagcctatatgtatacgagcgaccaatgccggttgacgcaatacgccttgcaaggtatatcgtttttcgatatagtcatatcgatgttcgcggtgtcgccaaaaaaacgtcggcacctgaaaggaccgggctatgaaaaactacatgaaccgatgggtgttgctcgcgttgaaagccatcgtgattctggtctggctggcctgcctatggggccaactattcgccgtaccgggattgagcggcgcgctggccggcctctacccgagccagacgtcgatgcactggccatatctcattatgggcgtgctgttcctgttctgcatcgaagcggcgttcgtggccgtatggaaactgttctccttgtccggctcgggcgcgaactcgagcaggtgatttgagatgacgattcgcatcaatctcgacgtcatgatggccaaacgcaagattggcgtcggcgagctcgccgaacaaattggcatcactcccgccaacgtgtccattctgaagaacggacgtgccaaagccgtccgcttcaccacgttggacgccatctgcaaggcactcgactgccaacccggagacatcctcgaatgggaagatgacgattgatcgacacgccaccggctcgaactcatggttcaacttgtagtctctcccaaaatcaatgatgccctatcatcctgcaagacgatagggcatcatcatgtgattatgcgcagctgatatgttgcgttgttatcactcggcgtccgcggccggtgcctccttgggcgcagagaggaagtgctcctcgctgggcagcacggtgttcaggatcacggccaccacgaacgccacggcgatgcagttcgaggcgaagatttgttggaacagtgccgggaactgcgtgaagatgtcgctcacctgggtgaagccgatgccgatggtcagcgaaagcgccgcaatcgtgatgttgcgctgcgtgaagcccgcctcggcaatcatctggaagcccgaaagaatgatgttgccgaacatcatgatcgtgcagccgccgagcaccgcctgcggcagcgagttgaacacctcggcgatggccggcacgaagctcgccagcaccagaatcagtccgccggagagaatcaccttgcggttgacgaccttggtcatggccaccaatccgatgttctgtgcgaacgaggtcagcggcagacagccgaacaggccggatacggtggagatcaggccgtcgccggcgatggcgcccgcggtctcgcgttcggtgggcgtacggttcaggcccaccttggtcagcgcggcggtgtcacccagcacctcgaccgaggagacgacgtagagcaggccgatggagatgatcgagccccagtcgaactcaggcttgaacggcatgaactgcggcacggacacgatggcgaggttctggaaaccggagaaatcgaccttgcccatgcagatagccgccacatagccgaccaccagaccgaacagcacggacagctgcttggccgtgcccttcatcaacagctggaacgccaggcaggcaaccaaagatataagcccgagcgtcaggttctgccaggaaccgaagtccttggctccgctgccgccgccgaagctcgtggcacccacgttgagcagcgagaagccgatcgacgtgaccacgatggcggagacgatgggcggcacgaaccgacgccaatacttggccgtcaaacccagcacaagttccagcagaccgccgaccattaccgcgccgaccaccgcgccatagcccttgtccgcgcagatcgccacggcggccgccacgtaggtgaaggagatgccggtgaccatcggaagtcgcgagccgatgagccacgcgccgtacagttgcaggcaagtgcccaggcccgcaaccagcaggccggactggatgatggtggccgattgggccggggtcatcttcgcggccgaggcgacgatgaagatcggggcgaggttcgccacgaacatggccatcacatgctgcaggccgaacggaatgcccttccagaaggatactggcgcgtccagcgaagacaacgcctcaaaggatacggaatgattggttttcttctctgacatgattctcttcttctctctgttgctcccgccggcgggagcagccaatgtgctcagtgcctaaatgtgatttcgccggtctcgggattcatggactcgacgatggccagcgaatccacatcgtagccttcagcgcgcagcgcgtcaccgccgccctggaagcccttctccacggcgatgccaatgccctcgaccgtggcaccggctgcttcgcacagatcgatcagaccgcgcaacgccttgccgttggccagaaaatcgtcaataagcagcacatggtcgccggcgttcagatacttcttggccacgatcaccgggaactccttctgcttggtgaaggaatagaccgtggtggtgtactggtcgccgtcaaggttgatggactgcgccttcttggcgaacaccaccggcacattgccgaaatgctgggccgccacacacgcaatgccgatgccggacgcctcgatggtcagaatcttggtgatgtgcttgccggcgaaatgagcggcccatgccgaacccatgcggtcgaacaggcgtacgtcgcactggtggttcagaaacgcgtccaccttgagcacattacccgccttcaccgttccctcgctttggattcgctcctcaagttcctgcattgaacctcccattgttgtatgtcagtgaatgatatggatactcgtaagtgtacgttgtcctgcgctgacccgtgcatgtggtaaacatgaatgtcgcgattcaaagggaggcaacagtgtacgacgagccggaagtcatcgcacgcagcgcacaggaactcgtgggcgacctgaacccgcagcaggcggaagccgtgcaataccgcggtcaggcgctgctgatcggagccggtgcaggctccggcaaaacccgcgtgctgacccgccgcatcgcctggatcttgagccagttcggcgcatggccgagccagattctagccatcaccttcaccaacaaggccgccgccgaaatgcgcgaaagactcggctcgctgatcggcccggtggcccagcgcatgtgggtctccaccttccactccgcctgcgtgcgcattctgaggcgcgacggcaagtccatcggactcaagtccggcttctccatctacgattccgccgactccgagcgactcgtcaaaatcatcgccaccgaattcaacctcgacatcaagcgctacactccacgctcgattctcggccatatctccgacctcaagaacaatctgaccggttggaaggaaaacctcgccgttcacgcgcccgacttcacgcccggccagcgcggctaccagttcggcacggtgggcgaccttgaagccatctacgcggtgatctacgccgaatacgagcatcgcttggccctggccaacgccgtcgacttcgacgatctgatcggccgcacggtcgagttgctgcgcactgacccggccgtcgccgagtactaccatcaccgcttccgttacattctggtcgacgagtatcaggacaccaaccacgcccagtacgtgctcgtgcgcgagctggccggcgtggacacgggggagaaggccatcccgggcgcgcctaacgccggcaagtccggccccgcctggatcaccgtggtgggcgattccgaccagtccatctacgcgttccgtggtgccgacatccgcaacattcaggacttcgagcaggacttcccgaacgccaagaccaccatgctcgaacagaactatcgttcgacgcagaccattctggatgcggccaacgcggtgatcagcaacaacgagggccgcaagcccaagaaactgtggaccgcgctcggcaagggcgagccgatcgtcggctacgcggcggacaacgcccagcaggaggcccagtgggtggccaccgaaatcgcgcgcctgcacgccgaagcgggcatcgcctactccgacatggcgatcatgtaccgcgccaacgcccaatcccgctcgctcgaagaggcgctgatcaacacgaatcagccgtatcagctcgtcggcggcaccaagttctacgaacgtcgcgaaatcaaggatgcgctggcctatttgcaggcgctcgtcaatccggacgacgatgtgaatctacgccgtattctcaacgtgcccaagcgtgggcttggcgaccgcgccgaaggcgtgctgctcgcctacgcgcgcgagcatggcaccagcttcttctacgcactcatgcacttggatgagatcgaggtgccgacacgcaccgccacctcgctacgagcattccgcgatctgatgggcgcgctctcgcagttcacgcgcgcgcacgactccaagcccagcgagatcgtggccgaagtattggagaagtcgggcttaagggccgaactcgagaaatccgtggacccgcaggacgcctcccgtctggagaacctctcccagctgcagtccactgccgccgaattcgaacagaacacgcctgacgccacgttgtccgcattcctggagaccaccgcgcttgtggccgactccgaccaactacccggcgaggcggaggactccggcaaggtgacgcttatgaccttgcacaccgccaagggcctcgaatacccggtggtgttcctgaccggcatggaacagggcaccttcccgcattcgcgttcgatggaagacaccactgaactgcaggaggaacgccgactcgcctatgtgggcatcacgcgcgccaagcagcgactgtatgtcacgcgcgccgccgtccgctcccagtggggccaggccgccgatatgatgcccagccagttcctcgacgagattccggattcgctgattgattggaaacgccgtgaagccggcgtggagcgtatgcgcgccagctgggagaccgatggattcgccgacgatttgggcggctgggatgatgacgatttcggcggcgccgcgtttggcgggtcgtcgacgttcggctcgcgtggttcgtccggttcgggttcgtcctatgggtcgcggtcgcggtatgggtcgtcgtatggctcgggttccggctcttcgtcgtatggttcccgttcatcgtcgtatggttcccgctccggctcgtcctcctatggttcccgctcccgttcgggttcgtcctatggttcttcaggctccggttcgaggtcgtcctacgggtcgcgttcccgttccggttcttcgtccggttcatatggtggcacccgtggcggcaaggtcaccacgcgccgtaccgcaccgaaatccgattcgaccggctctgccgtgcctagctcgaagctcaccaaggacaatggcctgaatatcgccgacttcgccgtgggcgacatgatcagccacgaccagtacggtctcggcaaggtcaccgacgcacaagacaagggccgcaattcggtaatcaccgtggacttcggctccgccggcgtcaaacgcctcatgctccgcgtagcgccgattgagaagttgtagataaattggcccctctgacgaggggctgagttatataccaaataaattcgcaaaaaacaagacttgtgttcttcatcacagtgtgggcataatgcggaggttgtgcctacgagccctgggaacaggggagaggaaaaagtagttatgaagaacaagctgtttgcatccgtgcccaatattctgttcggcgcgctgatcaccatcgcgccccagacctttgcgcacgcctgcaccggccatgacatgccgggtgcctgccactactcgcagcaggcggccaccggcatcggcgtcgtcatcctcgtgttcggcgtcgtggctttgttcgtcgccccgcagattcgcatcggcctcaatatcgccgccgcagccgacgccctgctactactcgccgtacccacctttctgatcggcatctgcaagggcgcgatgatgcactgtcgcatggttatgctgcccacgctcatcgtgctcggcgtgctcaccatcgtgttcgcggccatcgccatctggctcgactctcgcgccgccaagcgcaactgatcgagcagacggccggagcccagccattccgaacgctggactccggcctcgcttattgcaaccgcactataagcaacataaggattcatcgtgccatcccatatcgcattgcgcggccttccgattgaaaacctcaaacgcaagccgttccgcaccggcgcactgctcgccgtcgtcaccatcctcgcgctgacattcttcggcggcaccatgctgaccatgaacctcaacactggcatgaccagtatggaaaagcgcctgggcgccgacctcatggtcgtgccgcaaaacaccgtgcagaaggccgaagcgctgctcaccaacggcaatcccagcactttctatttcaccaaagacatcgccgacgaggtcatgcaggccgacggcatcgcacaggccaccgaacagacctatatatcatcgctggccgccgcctgctgtgccgaaaagctgcagatcatcggttacgacccggacactgacttcgtcatcgaaccatgggtcgcctcccagttcgaaggcccccttgaagacggtcagatgattgcaggcgcaaacgtcaacgtgtccaccgacggcaccatcgaactctacggccgttcatggccggtcgtcgcccagctcgccaacaccggcaccagcctcgacaactcggtgttcatcaaccaaaacaccgtgcccgacatggtcgccgcctcggccaaggtctccaagcaggtcatgtccgccgaatatgccggcaaagccgtctccaccgtgatgattaagacgcagcaggggtacgaagcgcagaccgtagctgagaacatcaagcgtcttgattcccgattcgccgatttggggtacgtataccccggcggcatcaccgccaacaccagaacttcgctgaccgcgcttgtcacctacctcaagattttcgtggcggtgatctgggtaatgggcgtgattgtgctgctcgccgtattcgcctcgtcggtgaacgaacgcaaacgcgaattcgcgtccctgcgcatcatgggcgccacgcgcggcatgttgaatgccatcattctgaaggaatccgccatcatcggtctgatcggtggcgtaatcggcgtcggcgcggccagcctggtgattttcccattcagttcgctgatcggcaaacagcttcaattgccgtatctgcaagccagcccggttgcggtgatcggattcattgccgtgaccattgtgtgctctacggtcatcggcatcatcggttcgctggccaccatgtggcgtctcggccggcccgaagcctacctgaccctgcgagaggggagtgatatgactgagacaactacgccgcttcagccgaccacggttgagccgaccaagctccagccgaccacgccagctcagccgaacgcgccgactgcgccggattcgccgcacgtaaccgagacgccctccccggaccatctgctgaccttgacggacctgacccgccagttcgtccgccgcggcacgccgttcgacgccgtcagccacgtgaacctcaccgtcgatgccggcgaattcatcgccatcgtcggccggtcgggcaacggtaaaagtacgttgatcaacatggtcgctgggctgattcgcccgacctcgggaaccgtgagcgtggctggacgcaatgtggccgacttgggcgataaagcactgtccgtgctgaggaatcgcaccatcggattcgtgactcaaagccagaccctgctcggcaacctgaccgtgctcgacaacgtgattctgcccgcaacgatgtttccggagccgctgccgttcgcccaaaacgcagaagcaacggatgccgtggcgcaagccgctgccaccaatgatgaagcggccgccgattcagccgccgacccgttcatgccggatgtcattgcgccaatcacagaccgggaaaacacgccgtcaaacacggctgcgagccgttcggacctgttcgccacccgagctcgcacgctgttcacccagcttggtgttgccgatctggcagacagctacccgcgcgagctgtccggcggtgaaatgcggcgcgtctccatcgcccgcgcgctgatgaaccagccgagcttgctcatcgccgacgagccgaccggcgacctcgaccaagagagcaccgacatcgtaatgcgtctgctcagagaccaagccaacaacggcacggcgattctcatggtcacccatgatcccgatgcactcgaatacgcagatcgggtgtatcgcatggacgccggagtgctgtccatagcctcggtgtaatatggtctgctggtgtctgccaacaggtagataccgtctggagtcatagcccatcagcgggtcggcggtaggtaatcgcaagaaaaccaacccgttcgtgtttattcacgacgaagcgctggggaggcccgactcagcgcttgttaggcatatgcaaggcaagcgttccgttcagataacgacagaaggattaatccaatgacgaacgttcagcgttctcgccgtcaggtgcgtctgtctcgcgccctcggcatcgcactgacccccaaggctcagcgcatcttcgaaaagcgtccgtacgctcctggcgagcacggccgtgaccgccgccgcaccgagtccgattacgcggtgcgtatgcgcgaaaagcagcgtctgcgcgctcagtacggcatctccgagaagcagcttcgcgccgcttacgagaaggccacccgtactgccggccagaccggtaacgccatgctgaccgacctcgagacccgtctcgacaacctggtgctgcgtgccggcttcgcccgcaccaccgcccaggcccgtcagttcgtggtgcaccgtcacatcctcgttgacggcaacatcgtggaccgcccgtcctaccgcgtcaagcccggccagaccattcaggtgaaggccaagagccagaccatggttccgttccagatcgccgccgaaggcgtgcaccgtgacgtgctgcctgcggtccccggctacctcgacgtgaacctgccgtccctgaaggccactgtgacccgtaagccggaggtcgaagagatcccggtgcaggtcaacatccagtacgtggtcgaattctacgcccgctgattcgggccctctggtcaacaaatccaggacataccgctcgaaccccgcgcttctttcgagaagccgcggggttcctgcgttgtagggcgattactggccgcacaccgcctggcgaatcatcgtcgcgtacgcataggcaccggtcatattcggatgaatgccgtcatcgttgaggtattcgctatgaccttcgctatacccatgccaatcgatgatgcccacgttcttgttcttcttggcggcctcacgcagcatcgtattgttgttgttctcctgccacgggtatggcatacggatggtgatgaagtatgtcggcttgccgccggtcaggtcaatgagctgttgcacttcctgctcattcgaaatcacgccgttcgtgccgaggccaaacaccaccacactgccactgtggccggcagcggtgtcctgctgatacacatccaccgcctgcggcagctgacggttcggcaggccatcgataaaagcgttcgggaatgcggcctggatggcgtccgaagtacccgacgtcactgaatcgccgaccatcatcatatccgcgttgcagctttccgttgccggatcataggcgtacttcgaaatgtcaagattgtttggcaccttttccgcaatcggtttgatgatgggcggctgagaatccgaaccgttcttattcgcgtcagcggtattggtttcgccgttcgcggcatttatggcagaagactcgggctcgggcttcgccggtttcttgaccggcttggcgggtgccgcgagttcggggcgcagctgaatggctcgcgcttgagcgatgccattccagtccaccggtgcccacgtcagcgccacaacggtcaccaatccgataaccgacatgacccacgcgcccgggcgcagccggtagccggctttcggcagcggcttggcgtgttggctacgaggcatctgcaccgatttacgggccgcctcgaccagctggtagaaggcttccgacgccgccaacaccacgacggcctcaagaacccaaccccaccacggcaacgcctgcgttcgtgtcgccgggttcatgaactgcagcagcggataatgcatgacgtacagcgagaacgatcgcgacccgatatagcgtaggggagcacaacccagcacgtgcgaccagattgagtcattgttcacggcacaggccaaggcgcacaacgatatgaacgcggtaatcaggtacccgccttggtacatgtacgacagatacccgttggcgaaccagaatccggtcagcagtgccgccaaagccgcggtgccaagaacattgcagacgatagtgagacgggcgcccgtcttgtcgccggcctgacgttcgatctgcactgtttgcgaagccgctccagcttccgcagcttccgtacctcgcgaggaaggcgcaatccagatagccaacagtgcgccggcggccagctcggcgaggcgagtatcggtaccgtaatacacgcgggaggtattggccgggtcaaacagcagcaccatgtcggcggtggaagcagccatgatgacaagaatcgccatggagcgcacccatttggacttggtgattttgccgagcaccaccatcagcaacggccaaaccagatagaactgcatcgtcacgcccaagaaccacagatgggtcagaggagaaggcaatccggccgcctcgaaatacggcaccttgcggaagatgtacacccaattgctggcgaacaaggcgctcggcagcgaatcggaaaccactttctgcaacaggctgggagcgaacatccaagtgagccaaggcaccacggcaatggtcgccagcatcaccggccataaacgagtaatgcggcggatcagatatcggccatatccaaaggacccggtgcggtccaccatgttcagtaccgaacgtgtggcaagaaaaccggtgataacgaaaaacatcgtcacgccaatgaatccgccctgcaatagcgacgggcgggtgtggaatgctatgactccaagaatcgccagagcgcgcagtccatcgatacccctgaaatgggcaggcacagacgatcgagatggtgcaggtttcaaggttatgctcacagtattctaagtgtactctcaggaatcgttaggtatactgcccggattacgcatatctcaggtagtgacctatgccgttatgacttatgacttccggcaacccgcaccgaaaccgccggaatggtgacataatcagaaccatgattcttcatctgcatctggtccgtcacggacagacctatttcaaccgatacaaccgtctgcagggatggtcgaattcgccgctgaccgagtcgggcgtcgccgatgccgtcaaggccggtgagcgactgaaaggattgacgttcgccgccgcctactgttcggacaccacgcgtgcccagcagacggccgagaaaattctcgacatcaacgaagccgcgggtaacccgcgccccgcactcgtgacggacatgcacttccgcgagcagttctacggctactacgagggacttgacatggccatggcctggtacgccgcgggagcgccccacggcgtcaaaacctacaaccaaatcgtcgagaagttcgggttgggggcctcgcgtgattttctcaaggaagccgatcccttccacgacgcggaatccgatgaggaatattggacgcgcgtcgaaggtgcgttccgtcttatcgccgacaacccgaatctcaaggacggcgacgatgtgctgcagatttcgcatggcaacacactgcttagcctcggtcaccggttcggcggccctgacctcgatctgaacgaacgcccggccaatggttcggtaaccgtgatcgacttcgacaccgacaagccgttcggcgaagccgtgaccatcgtttcgtacggcaagtagcaaatagcaagcaatacatatcgaatagcacgtacggtccacggcggcacgccgcaaacgaaagcgtcagcaggacagcctttcgcctatagccgcatacgcctacgcgcacggttttcgccctgcgcatgcaatggtatgccaagaaatagggaaggagtgctacccttaggcgagtaagtgtgaccgcaaggaggaaacaatgggagtcggagagatcgctggcctgatcgcggccatcgcgttcgcagtattggccggtttcatgatctatccgctgatcaggctgggcaagatgtttgatcagatatcgcagacggtccgggagtccggtgaacacgccatccccgcgctggacgaaggcgtgaccaccgtcaagcaggtcaacaagtcgctcgaagacgtgaacaagatttccgccgcggcttccaccaccgccaacaacgttggtgcgttgaccgatctgtatggctccttcctcggtaagcccatcatcaagatcgcttccaccttctacgcgctgaaaaccacgggtcagtccttccttgcgaagaacgccgcgaaaaccaccgtcaacgacaccgccgagaagggggagtgatgttcaaacgcatcttctgggtcggcgtcggcgtggccatcggaatcgttgccgtcaccaaggcacaggcctatgtcaaggccaatacgcctgatgcggcacgccagttcctgcttggccccgatcaggacaatgtgccgatgaaaacactcgaagggttggtcaacgagttcaatgccacccgtcgagcccgcgaggctgagctcaaccgtcagtacatcgagcgcgccaactgacacgcgcatgccgccttgccatctagtcactgaatcagctagaacaaactaatcctcataatccagtcttttccaccaataccaggcgcaactgcgcccattacccaaacaaggagttcatccgctcatgcgcactgcggacatcgcaaagcgatacctcgattattttgccaagcacgaccatctcatcgtgccctcggcatccctgatttccccgaaccccaccacgcttttcaccatcgccggcatggtgccgttcatcccgtacctgatgggtgagcagaccccgccgaagcgccgcatggcctccaaccagaagtgcgtgcgtacgctcgacatcgacgaggtcggcaagaccacccgccacggcaccttcttccagatgctcggcaacttctccttcggcgactacttcaaggaagaggccatccactacgcctgggagctgctcaccacctcgcaggatgagggcggctacggctttgaccccgagaagctgtggatgaccacgttcaccgacgatgacgaagcccgttccatgtggatcaacgagggcgtggaccccgagcacatccagaagatgggcatggaagacaacttttggaccaccggtggccccggacccggcggcccctgctccgaaatctacgtggaccgcggccccgccttcggcaaggaaggcggcccgattgccgacgagaaccgctacatcgagatctgggacctcgtgttcgagaactacgaggtcgacaacgtcaagtccaagaccgacctgcacatcgtgggcgagcttgagaacaagaacatcgataccggtgccggcttggaacgtctggcctacctgctgcagggcaagaacaacatctacgagaccgatgaggtcttcccggtcatcgaggccgccgagcagctctccggcctgaagtacggcgagaacgaggacgccgacgtgcgcttccgcgtggtcgctgaccacgtgcgctccgccctgatgatcatgtccgacggcgtgcgcccgtccaacgtgggccgtggctacgtgctgcgccgcctgctgcgccgcaccgtgcgctccatgcgcatgctcggcgtgaccgatccggtgctgcccaccctcttcccgacctccaaggccgccatggaggccagctacccggagctcaacgacaccttccatgaggtgtccgaatccgcgtatggcgaggaagacgccttccgccgcacccttgagaccggcaccacgattctcgacgtggccgtcaacaaggccaagagcgattccgccgagcccgtcgtggccggcgaggacgccttcaagctgcacgacacctacggcttcccgattgagctgaccctcgagatggccgccgaacagggcgtgaaggtggacgaggccaagttccgcgaactcatggccgagcagaagtcccgcgcccgcgccgacgccctcaagaagcgtcacaacgtggatctttccgtttacgacgacttcaagaagacgctcgtcagcccgatcgacttcctcggctacaccgacatgtccgcccgcgccaaggtgatcggcatcatgcaggaaggcaagggttccgtgcccgccgtgaccggcccggccaacgtcgaggtcatcctcgaccgcaccccgttctacgcggaggccggcggccagctcgccgaccagggcgagatcctgtccgacgacggcgccgtgctcgaagtcgacgatgtgcagaagcccatcaaggacctcatcgtccaccagtgccgtctgaccgaaggcacgctggtcgtcggcgccgaagtcaacgccaacatcgacctggcccgccgtggcgccatcgcccgctcgcacaccgccacgcacatggtgcacaaggcgctgcgtgaggagctgggcccgcaggccacccagcgcggctccgaagacgccccgaaccgtctgcgcttcgacttccagtggtccaaggccccggccaagtccgtgatctccgcagtcgaggagcgcgtcaacgacaagctgcgcgacaacctcgccgtgaccaccaaggaaatgaagttcgacgacgccatcgccctcggtgccatgcacctgttcggcgagaagtacggcgacatcgtacgtgtggtctccatcggcgaagacggctggagccgcgagctgtgtggtggtacccacgtggaccacgtcggcaagatcggcatggtcaacatcctgtccgaagcctccatcggctccggcgtgcgtcgtgtcgacgccgtcgtgggccagggtgcctatgacttcaacgctcgtgagcacgcgctggtctcccagctgtccgacaagctcaacgctcgtccggacgagctcgccgagcgtgtgaacgccctgctcgccaagctcaaggaatccgatcgtcgcttggcctccatgtacgagtcccagctggccgcctcggttccggcgctggttgctgacaccaagaactccgcggccccggtcaaggtggccgtcaagaacgtgggccactttggcgcggtcgatgccctgcgcaagaccgtactcgacgtgcgcgcccagctcggtgaagacgcccccgtggtggtggcccttgccggcgtgaacgaggatgacaagccgatggtcgccgtggccaccaacgaggccgcccgcaaggccggcatcaaggccggtgatctggtgcgtggcgcagccaaggtcctcggcggcggtggcggcggcaagccggacttcgcccagggtggcggtgtcgatgcctccaagatcgacgaggccctcgaagcgctcaagcacgaggcgcagaaagcctgattccgccagtggtgtggttaggcgttgatttgggtaatgcccgggtcggactggcactgtccgacccggagcttacctttgcacatcctgctggcaacattcatgttgccggcgactatttctttgctattgacgaggtcctgaacgtcatcgaagacgaacatgtggaccatgtaatcgtcggactgcccctgcagatggacggtacagaaggcaaaagcgccaaaaaagcgcgcaggtgggcggccaatctggagaagaggctgcaagcagagagtgaagacagtgattctacggagtatcagattccgcaggtatcattgatagatgagagattgacaacagtcagtgcgcatcgtcagctgttcgaggcccataaagcttcgaacaagcacaggccggtggttgaccagcagtcggcagtggtgattttgcagacggcactcgaccgtacccgggagcagtgaggtatcggttatgaccgatgattttaacgagttctttgatgacaacacgcattgggtcgaacaggggtcagaaccaatgcgcggggccgagccgccagaaccgccgaaatcccgcagggagatgcgcaagcgacgtgcacagcgcaggcgcaagcgtatcagtggcattatcatcgctatcgccatcgtcgccctgcttatcggcggcggctatttcggcgtaaccaagctcatcgcatggcgcgacagccggagcaaccagtcgacggccatcgcggactatccgggaccgggctatggcgaggtcgaattcaccgtgagcgagggccaaggcgcggcggagatcgccgataatctgctcaaggccgaagtcatcaagtctactgccgcgttcaccagcgtggtcaacgccaatagcacgacactctatccgggaacgttcacattgaagaagcatatggccgcatccaaagtgatcgacgttctctccgacaccaaccaggcggcgggcttcctcgaggttcgtcccggtgaacgtgccaccgatgtgttcgccaacgccgcgaagctttccggcattgcccaaagcgaattcgacacgattatcaagaacgagggtaaggatattctgcccaatgaagcgggcggtagctttgagggatggctggagccgggaacctacaacgtcaagagcatgaagagcgcttcggaaatcctcaaggccatggtcgataagcgtatcgccaagttggatgaattgggcgtgccggccggcggtgaccgcgaacgggtgatgatcatcgcctctatcgccgaggccgaggtcaacaaagccgattactacggcaaagtgacgcgagtcatcgagaaccgtttggagcagggcatgtcgttgggcatggattccaccgtggcctatggcaataacgtcaagcccgcgcaggtgaccaccgagatgacccaagacgagtccaacccgtacaacacgtacaagatctccggcctgccgcctacgccgatcagcaatcccggcgataacgccattcaagcggcactgcaccccgaaggcggcaattggctgtacttctgcacggtcaatctggacaccggcgaaaccaagttcgccgcaaccgccgatgaacatgaccagaacgtggccgaactacgcaagtggcaagccgaaaaccagtagtcatcccgttagcttccttcgcttggggaagctgatcggacgttggtctcttcattggctccctcgccgaggggagctgtccgcaaaaaagcggactgaggggagcactgcagggaatgtaacgctcaacttaagcccggggctcccgcgaagcggatggaagaaatctaggacaacaccccaacagccaccgccacaatcgcgcccgccaatatcaccggcacatacggcaccttgcccgcatgtgccggtgatgtgcgttgtgggtcgaatcgcgtccacaaggcaatccatgtgatgccggcaacgcccatcgccagccaccagaccaccacaggcaacaggccaaacagtccgacagacaatcccataggtatcagggcggtcacatcgccgaatcccaatgaccgaggcaccagcaacgccaacgcgaactggatcaggcaacatagcacggtgaacaacagcgcctgcaacagcacgaacaggtcgttcaccaccactccatacgcgaaatcggcggccagctgaagcaacgcgcccgcagccacccacgcgatcggcacccgccgatgacgaacatcctcaatggacagtgcaagcccacatagcagaccgggtagcgtgaacaggtatggcatggcttaacattaacccctagctagacgtacacatagacgtacacacatgaaacgagggaagttatgctgcgttggcagacggcaggggagtctcacggagaagcattggtggccatgattgaagggttgccggccggcgtgcgtattagcacggacgatatcgtttccgcactggcacgccgtcgacttggatatggtcgcggtgcccgcatgaagttcgagcaagacaaggtccgtctgctgaccggtgtacgccacggcctgaccctcggctcgccggtggccatcgaaatcgccaacaccgaatggccgaagtggaccgaggtcatgagcgccgatgcactcgaccatgacctgccgcgcgaaggccgcaatgcgccgctgagccgcccgcgcccgggccacgccgatctgaccggcatgcgcaagtatggttttgacgacgcccgcccggtactggagcgctccagcgcccgtgagaccgcctcccgtgtggctttgggcgaggtggccaagcagttcttggatcaggcgttcggcatccgcaccgtagcccacgtggtggcgcttggtggcgtgcagaccaaccccgacctgcctctgcccacccccgacgatctggaagcgcttgatgcctcgcctgtccgtacgctggacaaagaggccgaagcccgcatcatcgaacgcatcaacgaggccaagaaggcctccgatacgttgggcggcgtgattgaagtgctggcttacggtgtgcctgccggcatcggcacgtatgtggagtccgaccgccgactggacgcggctctggcctccgcgatcatgggcattcaggcgttcaagggtgtggagatcggcgacggcttcctggaagcctcccgccccggttcgcaggcgcacgatgagatcgtggtcaacgccgacggccgtatcgaccgtctgtccaaccgcgcaggcggcattgaaggcggtatgtccaatggccaggtgattcgcgtacgcggtgccatgaagccgattccgtccatccccaaggccctgcgtacggtcgacgtgctgaccggcgaatccgcacaagccatcaaccagcgttccgacagcaccgccgtgcctgcggcatccgtggtggccgaggccatggtgcgtctgactttggcgaagtacgcgctggataagttcggtggagacagtgttgccgaaacacggcgcaaccttgagtcgtatctcgcctcgtggccggagcacatgcgctgaacgaagggcgtatggtttcgtgacgactgccgcggaaccatcagcaactgtactcaccaatcgtcgagaggattcgtagattatgaccgcacgcccccgcgccgtcatcatcggcatgatgggagccggcaaaacacgtgtcggtaaggaagtggcgcatatgttgcgtctgccgttcgccgatgccgatgtggagatcgaacgtgaagtgggcatgaagattccctcctacttcgaggaatacggtgagccggcattccgcgaggtcgaggccgatctcatcgccgatatgcttgaggatttcgacggtatcttttcgctgggcggtggcgctcccatgacgccatccacccagcatgccctcgcctcctacatcgaccatggcggtcgtgtggtctaccttgatgccgatccggcggaagccatggaacgcgcgaaccgtgggggaggccggcccatgctcaatggcaacgccaactcccgttggaaaaaactgttcaagcagcgtgacccagtattccgcgaggtcgccaacgttcatgtccatacccgggggcttacgcctcagggcgcagcgaagaaagtgattgatatggtatctgagcgagcagtgcatgttaccggagcggcaattgagccgtatgatgtggtcattggcgaaggtgccatgaaccatctggtcgacgtgctgggacccaaacccgccaaaatcgcgcttatccacactcagccggtgcagcgacactccgatcgtgcccgcgccctgttgcgtcagggcggctatgaggtttccgacatcgtgattccggatgccgaacccggcaagaccattaccgtggccaacggcatttgggaacgccttggcaacgaaggtttcacccgatccgatgccgtggtggggcttggcggcggtgccgcaaccgatttggccggtttcgtggctgccacgtggatgcgcggcgtgcgctatgtaaactgcccgacctcgctgctggccatggtcgatgcctccaccggtggcaaaaccggcatcaacaccccgcagggcaagaacctcgtcggctcgttctacacgcctgccggtgtgctggccgacaccaagacgctggctacgctgcccaatgacatcttcatcgagggtctcggcgaagtcgccaaatccggtttcatccgcgaccccgaaatcctgcatatcctcgaagaccacgcagctgaactgcgcgctttcgacggctctacattcctcggctcgccgctcgaagacgtggttgccgagctcattgagcgcacggtaaaggtcaaggcctaccacgtctcctccgatttgaaggagaagggtctgcgtgaattcctcaactacgggcacacgatgggccatgccatcgaaaagctcgagcatttccgctggaggcatggcaatgcggtggccgtcggtatggtgtatgccgccgagctggcccatctgatcggttacatcgatcaggatctggttgactatcaccgctcgttgcttgcttcgatgggtctgccgacgtcgtggaatggcggctcgttcgacgacgtgctcgcattgatgcatcgcgacaagaaggcccgcggcaatgagctgcgcttcgtggtcctcgacgagattggtcacgtcgtacacctcgacaacccgcccgccgaagccgtggaagaagcattccgtcgtatccagcagtaattgaacggccgtaggccgtgccgttcgccatcccctcagaaaaaagtacttggctcccctctaacggaggtaccccggagtcggatttaccttctacctccctctgatgagggaggtgccccgaaggggcggagggagagaagcacaaacaaaaggagtcccaatgaccaaagtcatcgttgtcaatggccctaacctcggacgtctcggcgtccgccagcccgacgtctacggtcgtcaagacctcgacaccctgcgcaagctctgcaccgaatggggcaaggacctcggcctcgaagtcgaggtgcgccagaccgacgacgaagccgaaatggtgcactggatgcaccaagccgccgacgagaaaaccccggtggtcatgaaccccgccgccttcacgcactattcgtatgctctcgccgacgccgcgcacatggtcattgacgagaacctgccgcttatggaagtccatatttccaacccgtccgcccgcgacgagttccgcaagcgttccgtaatcagccctgtggccaccggcaccatcaccggcatgggtttctacggctacaagctcgcgctcgatgctgtggcgcacttgctgagcgaatagaaccaagccctccagccaatcccgggtagcagtcgacgttgcgcccgggattcctgttacctgaggaaaccataagcgtccaagtaaaggaagccatgactctcaccgccacggaacgtgatctcgtcgatgccgcgtcacgctggtttgacgcccaccgcgcacagttcgtcgatgagctgtgtgagctgctgcgctacccgtcggtttccgacgaatcggacccgaatcctcgtccgggcgcgccttatggacccgaagtacgccgtgtattcgaccatatgctggccaaggcaggacgagacgggctgcctacgcgcgactacaccggccacgtcatggaagtcgtttatccacaggagaacgtggagaccgaccgtgacatcgccttcgtcgaccacctcgacgtagtccccgccgacgacggttggacgcacgatgccttcgatccgcaggttattggcgatattgttatcggtcgcggctcattggacaataaaggcgtcgcgctgaccagctatttcctactccgtttcttcaaggaacacgaccaccgtttccgccaccgcgtacgtatactgttcggcggctccgaagagatcgcgctcaacgacatcaaatggttcgtcgccaacatcggcgcgccgtaccaggccatcgtcaccgatggtcccttcccggtgaacaatatccaaaaagggctgctcgatgtggatgtcgaactgccggtcgggccgcaattgcgcggttggcatgccggcaccgccactaacacggttcccggggccgccgcaatcaccctcaccggcgtcgacgaatctaccgtgcggcaagcattctgccagagcggcaacatcgctccagatatcgccgagcgattgcatatcaacgcaacagcgcaaggcgtcacgattgaggccaccggtgtcgccggtcatgcctgccagccgtccggtaccgtaaacgctatagcggtgctcactacggcgcttgcccggtccggtctgctcgaaggccgtgacctcactgcagcgcaggcgattgcccaatggacaaaagactcatatggcaccggcttgggtatcgattgcgagaatgcggaaagcggaccgactaccgccaatggtggtttgattataccggcgaatgagttcgctgaagcagacaaggtattaggcgcggtatcaggtgagacttctgaagatgccatcgtattgcacttcgacatccgttatgcggtaggccaggcacacgaacaaatcatcgagcgtattcaagcacaagccgaagcggcgggcggccgcattgtcgacatccttaacgatgacccatactacgtgcaggctgacgacccgcgtgtccagttgctcaccgcaacctacaacgacgtgctcggttgcgaggctcgacccgtggctgtcggcgacggcacccacgcccgctttatcccgcgcgcactcaacttcggtcccgaattccatgccgaccatgtgccggcggtcgacggcatcgacctggagaccccgccattcatcgcaccaggtgccggcaacgcgcacggtgccgatgaatgggcctcgctgaaaaacctgaaaacagcgtttgtcctatatgcgttaggcctagtgcgtctcgaccaatacctgcaatagctggcggataagacgtttgacgtgattatgaccttgcgtatgctttttgacgagcctactattcgtattgttcaagtacgccatgtcggggccgacgcgtctggtgaacacgccgggtcatacacggatgatagagtgaaattccatggttagaagaacacatggtaattctcaagaacacgtcaccaagcatattttcgtcactggcggcgttgtctcctctctcggcaagggcctgaccgcatcttcgctcggtcgtttgctgcgcagccgcggtatccatgttctgcagcaaaagctcgatccgtacatcaacgtcgacccgggcaccatgaacccgttccagcatggtgaggtctacgtgaccgaagacggtgccgaaaccgatctcgacatcggccactacgagcgtttcctcgacgtcttcctgagccagaaggccaacgtcaccaccggtcagatctatcaggaagtgctgcgcaaggagcgcgccggcgaatacctcggccagtgcgtgcaggtcatcccgcacatcaccaacgaaatcaagtctcgtatgcgcgcccaggcttccgatgacgtggatgtgatcatcaccgaaatcggtggtaccgtcggcgacatcgagtcccagcccttccttgaggccgcccgcgaagtgcgccgcgatctcggcccggacaactgcatgttcgtgcacgtttccctggtgccgtacatttccgccgcccacgagctcaagaccaagcccacccagcactccgtgatgatgctgcgccagctcggcatttccccggacgcccttgtgctgcgctccgaccgcccgctcaatcagtccatcaaggacaagatctccctgatgtgcgatgtcgatgccgaaggcgtggtcaactgcgtggatgcgccgagcatctacgatgtgccgaagatcctgttcgaggagggcctcgacgcctatgtggtgcgtgagctcggcctgccgttccatgacgtcgattgggacgaatgggccgacctgctggagcgtgtgcaccaccccaagcacgaggtcaacatcgccatcgtcggcaagtacatcgatctgccggacgcctacctgtctgtcaccgaggccatcaaggccggcggctttgccaactgggccaaggtcaacgtcaagtgggttgcggccgatcgttgcgaaaccaccgaaggtgcggccgccgctctcgacaacgtcgacggcatcgtgatccccggcggcttcggcatccgcggcatcgacggcaagatcggcgctctgaagttcgcccgtgaaaccaagctgcctgccctcggcctgtgcctgggcctgcagtccatggtcatcgaatactcccgccacgtgctgggcattgaagacgcgaactcttccgagttcgagcccgattgcgccaacccggtgatcgccaccatggaagagcagaaggacatcgtggccggcaagggcgacatgggccacaccatgcgtcttggctcctacccggctgagctggaggaaggctcgctggtcgccgaactgtacggcaccacgcatgtcaccgagcgccaccgccaccgttacgaagtcaacgtggcctacaaggatcgtctgcgcgaaggcggcctgcgcatctccggccagagcccggacggcgagctcaccgagttcgtggaactgccgcaggacgtgcacccgttctatgtggccacccaggctcacccggagttcaagtctcgcccgaccaagccgcacccgctgttcgccggcctggtcaaggccgcgctcgaccatcaggcggcacgctgactcacttttgtgccgtgcataatatcgcggcatgatgtgctggctgccgtcatcggcgtagcgcaagacatacggtaaagacgtggtggcgaaacatctaatgatgtttcgccaccacgtctttttttgttgtatgagcatcatgcagcatgatgtattggaaggcgacggtaaaaaattaccgtttctatggtgtgttggtagtatgcagataacgcttagtaggccatcgcagaaagaccgaccatgaccgaacaccttgatgactcgacccagcagtttgcgcctctgtttggtgcgaataatgccgtcagcggcactgtggcagacagtgtggatgctgctgcatcagattccattcagggcgatgagatgaggaggcgccgcatctggccgtgggtggtgattgcttgtctgctggttgccttgggggctgcctgtggcggcggtgtttggttcttccaagatcacgtgctgcctggcacaacgctatggggaaattcagttaccggcaaaaccgagcaggagattgtcgacctaatcaacgaccaggtcgacaacaccgcggtacgagcgaaataccaggggcagtcggcgacgttcacgctgaaagatctcggcatcgaagttgatggtgaagcaatcgcatccgatgtcatcaatgcccaacgcggtgacgcatggtggcaacagtatgcgttctggattacgcatgatgtggccccgcaaatcaatcccgagctcgctgatggcagtgtggtagataaggcgctgaacattgatgcacaagaacctgttgacgcgcaagtcgcattgaacgataacaacagtggcttcaacgttattgcgggagaaaatggccagggagccaacgccaccagcattgcgaagcaagccatttccacagtggagtcattgggcagtgtccagccacagaccgttcgggtggaactcgacgtaaccgaaccgacgattaccaatgcaattgccgatgaggcgaaaaccacgctggaaaccctagtgaacaatgccgtggccatcaaggtggcggataaagacatcgccaccgtgaatgcgtccatgctgggttcggccatgcgcatcgacgccaaccagcagtcaaagctgaaagacaatgaagtacgtaatggctacgtggtctttgatgccgataagctgcagcaatactatgacgagcaaatcaagccgaatctcaaattggaacgtgaagacaagaaggtcgtcgtcaataatgctggcgaggtgctgagcactgaaacagaaggccatgatggcattgtgattgccgatggcgcggatacggaggttggtgctcgcttggctcaggtgctggccacgggaactggctcagtgaatgtggacggcaaggtagatcccaaacaggaagtcaaggtcgctcatcgcgtggcgattgacctgtccgaccgtaagctctatgcctatgagaatgacacggtggtcaagacattgaatgtcgtggtcgcggagggcaacgacaacgtcaccggcgaatgcgttggcatgatgtgtacgccgacaggtgacttcaacgtatggcaaaagttgcccagtcaagatatgagcggcacgctgaatcttgccgatggcacggtggaaacatgggatgtcaaagacgtgggcttcgtcaattacttctcctccggttgcgcaatccaccgtattgccggcggatatgtagcggatgccgtaatgccctccattgccaacggatctcatggttgcgtgggtatcggatgggatgtggccgaatggttctacaactggtgcaatatgggcacgagcgtgcatatccaagtgtgatatgcaacagtgtgatatgtaacaaatacggcatgcagtggtgcgacacataatgccgcatacgcgatgttcggtgtgcatgggacaagcttgcccggctccaatatcgctgtatcgcattcgtgtaatcaagcccacagccaatatgcgtcagggcggctagtgtttgcacttgggttctgctaggttttcataggattaagtgtgatacaaggaaggcaggatggtgaccgaaaacacagcaccaaacgccgccgctgacgtggagatgagccagtatgtggctgatcgtacccgcgtcaacgaggacaagatcaagaaggatgacgagatcatcagccagttcggcgactacaactatggttggcatgattctgatgccgccggcgaagccgcaaaacgaggcattgatgagaacgtcgtacgcgcgatcagcgccgacaaaggcgagccgcagtggatgctcgacatgcgtctgcgtggattcaaggcgttcctcgaaaagcccatgcccgattggggtgtggatctctccggcttcaacgcagacgacttcaagtactacgtcaagccaatcgacaagcaggcgaaaagctgggacgaactgcctgacgacatccgcaacacctacgatcgtctcggcatcccggaggcggagaagaaccgcctcgtctccggcgtggccgcccagtacgagtcggaggtcatctacaactccatccaggaggacctgaagaagcagggcgtcatcttcgtcgacacggacaccgctgtgcgcgaataccctgaactcgtcaagaagtacttcggcaccgtcgtgcctccggaagacaacaagttcggtgccctcaacaccgcggcatggtccggcggctcgttcgtatacgtgccgaagggcgtgcatgtggacatcccgttgcaggcgtacttccgcatcaacaccccggccatgggtcagttcgagcgcacgctcatcatcgcggacgaaggctcctacgtgcactacgtggaaggctgcaccgccccgatctggtccgaggactcgctgcacgccgccatcgtcgagatcatcgtcgaaaagcacgcccgcgtgcgttacaccaccgtgcagaactggtcgaacaacgtctacaacctcgtcacccagcgtgcctacgtgcgcgagggcggcacgatggaatgggtcgacggcaacatcggttccaaggccaccatgaagtacccggcctgcatcctcgccgaaccgtacgccaaggcatccaccatgtccctcggcttcgccggcaagggccagtaccaggacacgggcgcgaagatgattcacctcgccccgcacaccagctccaccatcgtcgccaagtccatttcccgtggtggtggccgctccgcctaccgcggtctggtcaaaatcgtcaagggcgcgtacggttcgtccaactcgaccgtgtgcgatgccctgctggtcgacgacttctcccgctccgatacctacccgcatgtcgacgttcgcgaagacgacgtttcgatggcccacgaagccaccgtttccaagatttccgaagaccagctcttctacctgatgagccgaggtctcacggaggaagaggcgcgaggcatgatcgtgcgcggcttcgtcgaaccgatcagccgtgagctgccgatggaatacgcgcttgaactcaacagacttgtggaacttcagatggaaggatcggtgggctgattccgatgaccgacaacacaacacccgtcaaggaaatcaagattccggtcgccgaccccaacgacccgtacgcgattccggccgctatgccgtcctccgtggaccatgccgtgcgctcgttcaacgcaggcgactacccggagcccagccgcaagcaggacgaatggcgctacacgcctatcgagcgcatcaacgagttcttcaccgtgttcaagccttccggcgaaacgcagatcgaagtctccatgattgacggctcgccgttggccgaaggcgtgaagctcagccagatcaagctcggtgagggcctgtccggcactgtgtccaagcccaacgaccgcgtctccgcagtcgaatgggaatccggccgcaccgcaaccattctggaactgtccggtgagatcgcccagcccgtgctcgtcaaggtgcacggcgcgggggaggacctcgacgctttccatctggtgatcgccgccgccgacaaggctcatgcggacgtcgtcgtggaacacgacggtgacgcacgactggccgaaggcgtggaaatcaccaccggcaaggactcgcacgtctccaccacgttcgttcaggaatgggccaaaaccgccaagcatgtggccaaccaccgcatccacgtcggcgaaggcgcatccctgcgccactccgtcgtgaccttgggcggcgacatcgtccgcatccgcatggatcaggacttcggcggcgaacagggcgacctcaacatgctcggcatctacttcgtggaccccggcgagcacatcgaacaccgcacgatggtggtacacaaccaccccgactgcaagtcccgcgtggtctacaagggcgcgcttgacggcaagggcgcgcactccacttgggtgggcaacgcgctcatccagcccaccgccccggcaccgactcctacgagctcaaccgcaacctggtcctgaccccgggcgccatcgccgattccgagccgaacctcgaaatcgaaaacggcaacatcatcggtgccggtcacgcctcttcggtgggccgcttcgacgacgaggaactgttctacctcgaatcccgcggcatccccgaaaccgacgcccgcaagctcgtggtgcgcggcttcttcggcgaactcgtcgaggagatcggcattcccgccatctccgaacatctgatgaccgtgattgaccgccgactggcccgtggtgaaaacgacgccatggcacaggtcctcgaagacaagtaagaacagcatttttaggagcacaacaatgtcaacactcgaaatcaaggacctgcacgtccacgtcgaaaccaaggaaggcatcaagccgatcctgaagggtgccaccctgaccgtccactccggcgaaacccacgccatcatgggccccaacggttccggcaagtccactctcgcctacacgttggccggccaccccaagtacgtggtcgactccggcgaggccctcctcgacggcaaggacatcctcaagatgactccggacgagcgcgccaaggccggcctgttcctggccatgcagtacccggtcgaaataccgggcgtgtccatgaccaacttcttgcgcaccgccaagaccgaaatcgacggcgaggctcccggtattcgccagtgggccaaggacctgtccgcagccatgaagcgcctcaagatggacccgaagttcgcctcccgttccgtgaacgaaggcttctccggcggtgaaaagaagcgcgccgaagtgctgcagctcgaactgctgaaaccgaagtttgccgtccttgacgaaaccgactccggcttggacgtggacgccctgcgcatcgtgtccgaaggcgtgaaccgcgccaaggaagccaaccagttcggcatcctcatggtcacgcactacacccgtatcttgaagtacatcaagccggacatcgtgcacgtgttcgccgacggccacttcgtcaagaccggcggccctgagctggccgacgaactcgaagagaacggctacgaccagtacctgcccgaaggcgccgactccgagtccgcactggcctgagtccgtgaccgtgggagtctgacatgccctattctcgacacgctccgggccgcttaggccaggtctttacggtcgcgaacaggccatgtcagactcccactcgtttcgtacaattgttacgtaagtagggggaacataatggttgattttaaggcgattcgggcgcagttcccgattctggatcaggagattcacgggcacccgctcgtgtacctggattctgcggccacctcgcagaagccgaatgcggtgatcgacgccgaggcgaacttctaccgtacaattaacgccggcgtgcaccgtggtgcgcacgagctggccgcccgtagcaccatggcctttgaggaggcccgagccaaggtggccaagctggtcggcgcgaatgcggccgaaggtgaagaggaggtcgtcgtcaccggtggtgccacggccggactgaacctgctcgccaccgcattcggcaatgcatcgctggggcgtgggggagaagccgccaagcgttttgccctgaagccgggcgatgagatcgtcgtctcgcgtgcggaacatcattcggtgctgctgccgttccaggagctgtcctaccgtaccggcgccaccttcaagtggatcgacctgaccgaggacggccgtgtgcgtacggacaacctcgacgaagtcatcaccgagcgtaccaaggtcgtggccgtcacccacgtgggcaacgccacgggtgccatcaccaacatcgccccgatcatcaagcgtgcgcatgaagtaggttcgatcttcatcttggacgcttgccagtccgtaccgcacctcaaggtcgatttccacgcgcttgatgtggacttcgccgcctggagcgcgcacaagatgtacggtcctaccggcgtcggtttcctgtacggtaagcgcgacctgctcgaagccctgccgccggccaacttcggcggctccatggtcgagctcgcctacatggaccacgaggcccaatacatggcccctccggcccgcttcgaggccggcacccggccggtcgcccaagtggtggccgcaggcgtcgccgccgaatggatgatgaacatcgggctcgagaacatcgaagcccatgagaagaccatcgccgccgaactgctcaagctcggcgacgtcgatggcattcgcatcctcgggccgcgcgaaaacgtggaccgcatcggcaccgtggcgttcgacgtggccggcgtgcatccgcacgatgtgggccagttcatcgacgcccagggcatcgcgattcgcgtgggacaccactgcgcccagccggtacaccgccacttcggcctatacgcatccaaccgtgcctcctccggtgtctacaattcggtcgaagatgcccaagcgttggtcgaagcggccaagggcatccgtaagttctttggagtggagtaaaacagaacaccatgaacgaattcggtatgagcggggatgacctcgaacagatgtaccaagaggtcatcctcgaggcgtcgaaacatccgcatggcaaggaatcctttgcgcccaacgcagcggtcgaacagtccgcggacgcagcggccaatgtcaccgtacaagccagccacgaatactgcacgcccggtgaatcgcaccagttcaacccgacctgcggcgacgaggcgaccatccatgtcgaagtctccgatgacgaaccgcacaccatcaagcgattggtgtgggacggccacggctgctccatttcgcaggccagcctgtcggtgatggtcgatctggtggacggcaaaaccgttgacgaggccatggatctggaacagacattccacaagctgatggaatcgcgcggtgccggtctggacgacgagaacctggaagaaaagctcggcgacgccgtggtattccaaggcgtgtcgaaataccctatgcgcatcaaatgcgctctgctaggctgggaagggctgaaggactccatcgccaaagccctcgctgcaaagaactgaggaaatatgtccaacgataatttggttcccgaaccacagccgtccgttttcgatgctgtcaacggcgtcctgcaggacgaggaggccgctcgccgcgtgatggccaacccggccttggccaagggcttcccgaacggacgcccgatcgagcactctgctgcgtccggcgatgacacctgtgcgtgtggcggtcaccacggcaaatgcggttgccaggatgacgaacagtccgatggcagcgagattccgatcaaggcgattgacgatatcggccgcgccactgccgaagacgtgcgcgaggcactgcatcaggtgattgatccggagcttggcatcgacgtgatcgatttgggtctggtctacggcattgagatcgatgagctaggccgcgccattattacgatgacgctgaccacgccggcctgcccgctgaccgaccttatcgaggacgaatgcgcatccacgctggccggtctggtcgaggagttccgcatcgactggacgtgggatccgcgctggaccatggagcgcatcacgcccgaaggccgcgaccagctcgccgccctaggcttcagcttcgacaatatgccaaagtactgatagcgcttagtaagttccctcatcagagggagctctatacgagaaaagccccgcatgatgcggggcttttccatgtctggactggtcaatcagtcatcgacgatggtgttcttcgggacaaccgtgatgccatccggcgtgacggtgaagccacgggccagatcgtgctcggtatcgatgccgacagtggagttctcggtgagcaccacgttcttgtcaagaatcgccttgtacacgcgggcgcggcggttgatgactacaccgtcgaacagcacggaatcgacaatctgtgcccacgagtggatacgcacattgggggagagcacggagtggtgcacttcaccgccggagacgatcacaccgggggagacgatcgaatcggtggcgtggcccagacggtcgcggccggcgtgcacgaacttggccggcggcaggttgccggacatcgtgtaaatcggccaatcctggttgtacaggttgaactcgggcacataggcgatcagatccatgtgcgcatcgtagaactgcttaatcgtaccgacgtcgcgccagtaagcgtgatcagtggccgtggagcccggaatctcgttcgagttgaagtcgtagacgccggcttcgttgcgggaagcgaagtacggggcgatgtcgccgcccatgtcgtgcttggtgtcggcagccttctcatcgagagccagagcctcgaacagggccttggtgttggcgacgtagttacccatggaggccagaatctggttcggattgtccggcagaccggtggtggtgggcggcttctcctggaagttcttgatcatgttcgggtgatcgggatcgacctcaatcacaccgaactggttcgattcctcgatgggctggcggataccggccacggtgaactcggcgccggactcgatgtgctgctgtaccatctgttcgaagtccatgcggtagacgtgatcggcacccacgatcaccacgatgtccggctggacatcctcgatgatgttgatggtctggtagatggcgtcggcggagccgagataccagtgcttgccgagacgctgctgcgcgggcacaggggagacgtacgagccaagcagcggggagaaacgccagacctgggagatgtggcggtcaagcgagtgagacttgtactgggtgagcaccacgacctgacggtacccggagttcaccaggttgctcaacgggaaatcgatcagacgatacacaccaccgaagggaacggcgggcttcgcgcgatcacgggttaacggcatcaggcgggtcccctcaccacctgcaagcacaatcgacagaatcttgggattcttggtcatcgtaactgtcctctctgttactgagcgtctttcgacaccgcactgccgggccggatgcttccttgcattcggtttacatagttaataattgcagaaaaaaacgaacatgcaaggctttcgcccccgcgtgccgtgaacttgcgatgaacagtttcgtagatttgttaaggatccggccttttcggagcgcgtgcgattccttagcgtgtcgcgtagaacgccactgcgctggatgccgccacgttcaggctatccacgccgtggctcatcggaatcttcacggtcaaatcggcgcgggcaatcgtatggtgggacaggccgtcgccctcggtaccgaagatcagcgcgagcttgtcgatatgcgtcggatcttcggcaggcgcgtgcagacggcgtgtcagttcgtccaacgaaatcgaacgatcctccaatgccatggccacggtggtgaagcccagcgacttcaactcgtcgatgccctggaacggccagtaatgcttgttttcggtgccgtcgtcgttgaacccggtgatacgggtccacggaatctggaatacggtgcccatcgacacgcgggcggcgcgtcggtacagcggatcaccgcaggagggtgtgaccagcacggcatccacatcgagcgcggccgccgaacgcatcagtgcgcccacattggtgtggtccacgatgttttccattactgccacgcggcgggcgctcttgcagacctcggctacggagggcaacggccagcgtcgcatcgcgcatagggcgccgcgatgcaaacggtagccggtcagacgcttgagctgctcaggtgaggccacgtagacgggaatatccgcgccccagcgcccgtcgatgaagtcgaaggtgtctttcatgccctccagccaaggttcctcgaccagcagtgacagcggttcgcggtcagcggccagcgcgcggtcgataaccttgggggactcggcgatgaacacgcccttggctggttccaagcgattacgcaactgcatttcggtgaggctcacatacgcttcgacgcgcgggtcgtcgacggtgtccagcgtgatgaactgcattggtggcctttcgtgtgtgcagataacgaaaaaccccttgcaatgcaaggggtttatctgtgcccgagacgggacttgaacccgtacgcctgtataaaataggcactagcacctcaagctagcgcgtctaccattccgccacccgggcaggtgtcgtttggacaacgagtagatagcttagcatgaaattacagggatgcaattcgcgcgtgtgcccggcgtgtcgcgtgtagccttgaagtcatgactgatgccctttttcttttcgacccgcaggtcgacgacgtcccggtgaacagcgacgaactccacgccggctggaagctaaccctgcccgctcacatcaagcgccatgccgtgcaggccatgcgactcaaggcaggggacagcctgcaactttccgacggcaacggcttgagaatccaggcagtgatggccgatcctgaagccggactggctgaagtcgtggaagtggggcgcgaacccgagccgctcacccgtttggcgctgattcaggcattggcgaaaaccggccatgatgagcaggccatcgatatggctactcagattggcgtcgaccaagtggtgccatggcaggcggaccgatccattgccaagtggaaggtcggccgtacagacaagaagtggaattcggtactggatgccgccaccgagcagtcgcggcgcgcctttaagccgcaactggaggcgtgcgcgtccagcaaggaggtcgtggccatctgccgcagggcctgcgtgcatggcgatgtggtgattgtgctgcatcaggatgctaccgatacgtggtccggcgtggaggagaaggttgcgcagttggtggaacgcacgctccaggacggccggccgcggactgtcagtgtggtggtcgggcctgagggcggcatcagtgagcaggaggtagctgatttcgtcaaggccggagcggtgagctgcgtactggggcgcaatattctgagagccgcgacggccggtcctgtagcgttgtcgctgttgtctcgggtgttgggacgttacgagtaacgcccacgcgctaagctggtgcgtagcaacatcaaaccaaggagcatgatgagcgaatccgacgattgcctgttctgcaagatcatcgcagggcagattcccagcagcaaggtctacgaggacgagacgacctacgcattcaacgacatcaatcccaaggccaaggtccacgtgctcgtggtgcccaagaagcactacgccaacgtcgccgaacttgccgccggtgacccgaccgagctggcccacatcgtctccattgcgcagaacatcgccgacaaggaatttcacggcgcctaccgactggtgttcaacaccggtctcgacgccggccagaccgtcttccacgtgcacgcgcacgtgatgaccggcgaaaagctcgacgagtagtaggggaatatccgcttcgtggcaacgactacacgtaccatcaccatcccgccccaacttgaccccgtcgccgtgctcggcccggttgacgaggtcattcgcgaggtagagcgcgcctttccggacctgacgattatcgtgcgcggcaaccgcgtggcgatcgtctcccgctccaagcagaccgaagcccaggccgcacaggccgaggatttggtcaataccatcatccaagccgcctacaccgcgcctatggacgccgacaccgtgcgtcgcatgctcgaccagaacgtgctcaagaaccacgtgcgcctcgaacatcccggtcacggcccggtgcgtgacaaactggcgcaatcgacctcaaacgaacgcgcccatgcacgttctgccggctcccacgacccgacgtaccgcaagcccacggttcccggcgtcatcacctttgctgccggcgtgccggtccgtgcgaaaaccgccggacaagtggcctacgtgaacgccatcgaatcgcacaccatcaccttcggcattggccccgcaggcaccggcaagacgtatctggccgtggccaaggctgtgcgtgccttccaggacaagcagattcgccgcatcatcctcacgcgcccggccgtggaggccggcgaaagcctcggctttctgcccggcacgctgaatgacaaggttgacccgtatctgcgcccgctgtacgacgcgcttggcgacatgctcggcgccgaccagctcaagcggtacatggacgacggctccatcgaagtggcgccgctcgcctacatgcgcggccgtacgctgaacgacgcgttcgtgatcctcgacgaggctcagaacaccaccgaacagcagatgaagatgttcctgacccgtctgggcttcaacaccacgatggtcatcaccggcgatatctcgcaggtggacctgaccgtgcctcgctcgggactggccaccatcgaacgcatcctgggcggcatcaacgacatcgcattcgtgcatctcaaaaccgaggacgtggtacgtcaccagctggtcggacagatcgtggccgcctacgaccgtcactccgccatcgccggcgaccaccgcgacatcgaacgcaagggccgccgcaaccataccgacttcgatgcccgccagcaagcggattcaaccaaccaaagcgagacagacgatgagcgttgacgtcaccaatgaaacccagtgggtcatcgaccccaaggtcttctccgatttgggtatttgggtactcgaccagatgcgcgtgagcacccagtccgacctgaccatcatgttcgtggatcccgatcccatcgccgaactgcacatgcgttggatgaacctcgaaggcccgaccgacgtgatgagcttcccgatggacgagctgcgccccggcgacggcaaaaccgtgatggaaggagtgctcggcgacatcgtcatctgcccgtgggtcgctgcccaacaggctgccgcagccgggcacagcaccatgcaggagatgctattgctcaccatccacggcatcctgcacctgctcggctacgaccacgtgacccccgagcaggagcgccagatgttcggcctgcagcgacagctgctgctcaccttcttcgccctacgccacgatgccaacgtgcaggccacgctgcccgccggcacacccgacgcgctggccctgtacgacgccgcgcacggtgctggccgcgacctcgattccaaataagctcccaaatcaatcacaccaaatccggattattcgataccgttcaaggacattcaaggacaccgaaaaatcattatggagtattccagtaccacgccgatcgccatcaccgtcattcttgtactcgtggcggccctgttcgtctggctctcgctgaccatggccgccgctgaaggcgccgtggcccgcgtaacgcgagccagccttaacaatctcatcctcgaggtgcagaccgactccgaagcaagccagttcctcaagatgaagaagatcgacaagattcatcgcgtgcaacggctcatcgccgaccgttacgccaccgccggcagctgtgcgttcttccgcatcgcctgcaatgtgctcgacggcgtactggtgtcttccatcgcatccctgtggggtgcggaactgtggattgaactgctctccggattcctggtcgcgattatcgtagccgtggtctccgtactggtccgcccgcgcaccgccggcatggccaagccggtcggcatcatgatttccaactcgcgcatcgtgtcgttggccaccaagctcacgccgttcgcacgcatcggtggcgacaagtccggttccaagggaccgggccgccgctccaaggactccgatctgtccgacgacgaggagcttgagaagattcagctcgagcagggcaaggccgccatcgaccgactggtggagtccaacgacttcgatccggaagtctccgaaatgttgcgcaacgtgctcaccctgtctgatacgttgactcgcgagatcatggtgccgcgcaccgatatgatctgcatggagcgcgactccacactgtcttccgcgctgaaactgttctcccgctccggcttctcccgcgtgccggtgatcggtgaggatgtggatgacctgatcggcgtggcctatttgaaggatgccgtgcgtgccaccgccttcaacccggcggccatggagcgcgcggtcgaatccatcgtccggcagccgctgcttgttcccgaatccaagccggtggacgacctgttccatgagatgcagcgttcccgccagcatgtggccgtggtggtcgatgagtacggcggcatcgccggcatggtgactatcgaggatgccatcgaacagatcgtcggcgagctggaagacgagcacgaccgcacccagcgtactgagccggagaaaatcggagacaacaagtggaagatgcccgcccgtacgccgattgccgatctggaggagatcttcgagatcgacattgatgaggacgatgtcgataccgtgtacggcctgctgaccaagattctgggccgagtgccgattgtcggtgcctcggctgtgacgcgcggtctgcgactgaccgccgtggactccgccggacgccgcaagaaggtgtccaccatcgtcgtagaaccggcgcacgtcgagggcggcgaggaaaataacaagacccatgaggaaactgacggcgagcccgtcgaaggcgatgataccgccagcaaggagtgatatgaccgatcagaacaacagcacgaacgacgtcgatgacattgacgttaccgatgcttccgatgttgccggcgttgccgaagtcgacgcgaccggtgaaacggcgaacgtgaccaagcaggacgtgccgtatcgctccggattcgtggccgtggtcggccgcccgaacgtcggcaaatccacgttgatcaacgcgttgatcggcaagcagatcgccatcgcatcctctcgcccggaaaccacccgtaaggcgatccgcggcatcctgaccgccgaccacgcgcagctcgtgctcgtggacacgcccggtattcaccgtccgcgtacgttgctcggccagcgtctgaacgacgtggtcgacgaatctctggccgatgtggacgtggtggccttcctgctgcccgccgatcaggaaatcggccccggcgacaagcgtattctctcccgactgcgtaccgacttcgccaccaagcgtgaggacggtacgttcaagtggcgcatcccgctgattgccatcgtcaccaagatcgacgagcttggccgtcagcaactcatcaacaagctcatcgaaatcaacgatttcgccgatttctcggacatcgtgccggtgagcgccctgaagcacgacaatctggctgaagtgaagaacgtgctcattgagcacacgcccgagggtccgcagatgtacccggacgatcagatcagcgaggagcgtccggaagacaccatcgccgaactcgtgcgcggtgcgttccttgagaccctggacgacgagctgccgcattcgctggccgtggtggttgattccatcgactatccggaagacaacgagaccggtcagggctatgacggcaaggcgcaggtcaacgtgtccatttacgtggagcgtgactcccagaagccgatcatcatcggcaagggcgcctcgaacctcacctacgtcaagaagaagctgcgcaccccggtcaaccgcatcgtcggccaaaaagccaagctcgacctccacgtcaaggtagccaaaggctggcagtccgaccccaagcagctggagcgcctgggcttctaaggcttatagacgaaaaaagctccctcgtcagagggagcttttgctatacggtttacttccgcttcgtgtacatctgggtgttgaggagggtggagtagcgcttgatgaccttgggacgaatcaccttcatggaagcggtcatcaggccgttttcctgagtgaactcctcgggcaggatgatgaacttgcgcacggactcggcgcgggagacgccctcgttggcctgatcgacccacttctgcacttcggcgcgcacggcggcgttcttggcggcatcctccagcggcatgttctcgtccaggcccttggcggccagccacgggcgcagcgactcctcgtccagcgtcaccaatgcggagatgaacggacgcttatcacccagcaccagcgcctgggagatgaactcgcaacgctgaatgacttcctcgatcgggccgggggagacgttcttaccacctgcagtgataatcagatccttcttacgaccggtgatgtacaggaagccatcgttgtcgatacggcccaagtcgccggtgacataccagccatcttcggtgaacgacagctcagtggcctcgtcgttcttgtgatagcgcgggaacacggcacgacccttgacctgaatttcgccgtcctcggcgatgcgcagggagaatccggggaatgcgatgcccacggaaccagcgtggaacggcgtacccagcgggctgaacgcgcacggtgcggtggtctcggtcagaccatagccctcgtatacaggcacacccgcgccacggaagaaagccagcagttccgggtcaagcggggcaccgccggccacaatccacttggcgcgaccgccgagcacttcgcgcagcgaagagtagacaatcggatcgaaggcagcgcggcgagtgcgggtcagtgcacctgccttgccattggcggagacctccttcatatagttctgcgcggccaccacggcggaggcgaacaccacgcccttggggccgtggccggccttctgggacgcggcgttgtacaccttctccagcacgcgcggcaccacgatcatgagagtgggcttggccacctgcagatcgctgatcagcgtcttgatgccggtggcgatgtagatgcggacgttcgaggagacgacgatgtagttgatggcgcgggcgaaggaatgggcctgcggcaggaacagcaggatggtgttcctcttgtcgtgcagcagatcgggcatgtaggccggcagattcagcgcggtctggcagtagtgctcgtgggtcatctccacgcctttcggcgcggccgtggaaccggaggtgtacacgatggaacacaggtcggtcttcttgaccgaatcgatgcgctcgtccagctcctcgtccgagaccgtggtgccgtaggccttgatctcgtccaagccaccggtctcgatggtgatgatgtgctccagggacgggcactcttcgacggccccatccgccttcttacgcatgtccgtgtcctgcacgatcagcagtcgggcatcggagttgttgacgatattgcgaatctgctcggcggaatcggtgtcgtagatggtggcgagcacgccgccgcacgccatgatcgccgcgtcggtcaggtcccagtcgtaggaagtgcggcacatgaatgccacggcatcgcccttcttcaggccgtaatgaatcaggcccttggccacggcacgcacgtcagccaggaactcgttggcggtgacggtcacccaatcgttgccggacttgtaggtgtacagcggctcatcgcccatacgttcggcgcggtccgcatacaggtcgtagatggacgtaccttcgtccagcggcggattgccttcggtggaggtggtgagcaggccggtggcggggtcgatgtcggtgacggtcaggtggccgtcgtcccaatcgtcgctgtgaggcaaagcgatattggcctcgaccggcacgtcggcgttggacaggtaatcgggctcgtccggggtgtcgtcgtggaccgggtggacgaagtcggatcccaacctgagcgccttacgggtgagattgatcgtgtgctgcgtgaaggaattgataaccgacaagtcttgctcctgtaaacctttcagtgtcgtccagccatgaggcgaacgcttctcaaagttcaaattgtaatcgcccaaaccgaactcgtcaccttacgcaaccgtaggattctggcgggttaggggagtgcgtggcaaaatattgcacaggtcccgatattgttgagtaaccgtgagctacgaaacggtgattgtcgataattattgagcggttggttgctgatcgatgccgggtgattgttggacgacttccgagcaattcatccgcaatgcacatggacacattcgtatttcttactaatttcgggttcgtttctatttcgattggcggaatctcaagtcatggtctttacctttcgactacacttaccatgcggataaccatgtccattttgaagtagaacaagaaagggctctcatggcgcaaaacccagaagccaccgtggtgttcggcgttttgaacgaaacgtccgaaacggaatcccgcgtcgcgctgacgccggatatcgtcacccggctgaagaggagcggtgtctcctcactgattgaagcaggtgccggcattgctgccgactacaccgatgaggattacgaaaaggccggtgcgaaggtgaccagccgtgacgaggtgctcgccgaagccgacgcgctcggttttgtggaccgaccgtccgccgagaccgtggccaagctcaaggccggccagtgggtcattggcatgctcggttccttcaccgatgccgattacgtggccgcgctcgagaaggccggtctggtgggcatcgccatcgaaaagctgccccgtaagctttccagcgcccagtccatggatgagatgacctctcagaactccgtgatgggctacaaggcagccatcaccgccgccgatgcttacggttccttcctgccgatgatgaccaccgccgccggcacgattcgcccggctaaggcgctggtgctcggtgccggcatcgccggcctgcaggccatcggtacgctgaagcgtcttggcgcggtcgtcaccgcgtacgacgtgcgtcccgcctcccagggcgaggtcgagtccctcggcgcgaagttccttgatctgggacttgacttctccaagggccagggcgagggcggttatgcccgcgcgctgagcgccgaagagcaggctcagcagcaggctgccgtcgacgaaaaggccgccggctttgacatcatcatcaccaccgccaaggtcccgggccgtaagcccccggtgctgctcaccgcagccggcgtcaagggtctcaagcgtggtgccgtgatcgtggactgcgcagcatccgacctcggcggcaacgtcgaaggctccgccgttggtgagcaggtcaccgagggcggtgtcaagctgatcggcgctccctacctggcctccggcgtcgccaccaccgcatccaacctgctttcgcgcaacgtggccgacatcctcgtgcacttcgtgcgtgacggcaagctcggccaggatctcaccgaagaactcgacgacgcgctggtggttgccggccgcgccgccgccccggcagctgctgccgatgccgagaagtccgagaagtaaggaagaaggaataccatgcctactctcgtcgtttccattaccctgttcgtcctcgcgctgctcatcggcatcgaggtcatcggcaaggtgcccgccaccctgcacacgccgcttatgtccggcgcgaactccatccacggcatcgtcatcgtcggcgttgtgatcgtggcagccgaagccaatagaccgctggcctacgtgttcatcttcctggccgctgtgctgggcaccatgaacgtcgttggtggctacgtggtcaccgaccgcatgcttgagatgttcaagtccagcaagaacgagaagaagggggagtcgaagtaatgacctccgcaaccgttggcgccatcgacatcgtcgcttggttcgtctacctgttctctgccgtcctgtttgtggtcggtctgcatttcatgaattcgccgaagaccgcccgcaagggtaaccagatctccgcgttcggcatggtcgtggccgtgctcatggcgttcatcgtgctcttcgccaagggcttcgtgaacattgtcgccgtggtggtgctggtcgtcggcatcctgatcggtgccgtggccggtgtcgtctccgccaagaaggtgaagatgaccgatatgccgcagctggtctccgtgttcaataccgtgggtggtggcgccgccgcactcgtggccctgaacgacatcctgaccaaggaaggcaccccggacatcgtggtgctcatcaccgctggtctcggtattctcatcggttctgtgaccttcaccggctcgctcatcgcagccggcaagctgcagggtatcaagtgggtcaagaagctgaacctgccgggcaagggcgtatggaacattctgttcgccgtgctgtctgtcgtctcgctggtcatgctgtgcgtccagcccgaacagcgtctgctgtggtcgattctgaccaccgtgttcgccctgtgctacggcttggtgttcgtgattccgatcggcggcgccgatatgcccgtcgtcatctctgtgctcaacgcatgcaccggtacggctgtggctatgtccggtctggcgattgacaatgtcgccctgatcgtggccggcgcactcgtcggttccgcaggtgtgaccctgtccatcctcatggctcaggccatgaaccgcccgctgctctccgtcttggccggtggcttcggcggtggtgctgacgccgccgctgctggcgatggtccggaaggaaccatgaaggagaccacgccggacgatctggccgttcagctcgtctacgcgcagaaggtcatcttcgtgcccggcttcggtttggctcaggctcaggcccagcgcgagctcgctgacctcggcgaactgctcaagggccacggcgtggaagtctcctacgccattcacccggtcgcaggccgtatgcctggccacatgaacgtgttgctggccgaggccaacgtgccctacgaggagctcgtggatcttgatgagatcaacccgcagttcccgcaggccaacgtggctctggtcgtcggcgccaacgatgtgaccaacccggctgctcgccgtcccggcaccccggtctccggcatgccgattctcgacgtcgacaagtcccagaacgtcgtggtcatgaagcgcggccgcggtatgggctacgccggcatccagaacgagctctacttcgaagacaacacccagatgctgttcggtgacgcgaagaagagtctgcagtccgtcatcgccgccgtcaaggaattgctcgcgtaaccattcttggctcccctctgtgaggggagctgtcgaacggagtgagactgaggggagtagcccatacgcgggtgctcccctcagtcagcttcgctggcggctcccctcacagaggggagccgagctctatatctactacagcccaaacacccgcttaacaaagctgttaacgcgacgccaatagcggtccggatcggtgctggcgctcatcgtgtggtcggcgccgggaatcagcagcttctcgcggtcgatgctggcgcaggcgttgtaattgatgtccagatacttcggattgacaaaagtatccgctccgccatgaatgaacatcatcggaatagtcgcgtgccgtaatgccttcacacaggaggcgtcctcaaaccggtatccagccttgcgttcagacacatgactggccactttgaccagcagcacggccaacgagtgcggcaaacggaacatcgcctcggcattatccgtaaactgcgagaccacggaactgtatccgcaatcggaaatcgcggcgacgacgttgcgggggagtcgcgcatcgccggccgccatcatcaccgtggcggcgcccatcgaattgccatgcaacagaatgcgtgcatccggatcagctgcggtgatcagcgaaacccagcccaacagatcgtcgctttccagcaatcccatacccacgtaacgcccttcgctcaactcatgggcgcgctgcgcgggtagcaggaccgtaaaaccgagttgcgcatagcgatgcgcccatttggccatttccgcgggctctccggcatagccatggcagcagatcgcgtatagatgcggctgtgggtcggaacaatccgggtccaacagccagccgtggagtttcaatccatcatggctgcgcagcgtgaccgattgcttggcctcctcgaaccaccgggcggcctcaagctgctcggacatgtcgaattcgatgcctttcggtgtctcctcgtgcggcatgttgaacatcgaacgtttggccttggtgtccagcgcgaacgtgaacatgacgttggcggccgcggctgtgacgccggctcctgtggcggctatcgcggcaagtgccgcagccatacccctgacaacgcgagtgtgtgcggcgatgacgtcatggccatcctcattgatgacgtcgtccgaacgagtcatatcaacctcccgatacggtactcaccatcgtacgttattttcgaaatcatccccaacttcgtgaaagaccgtacactgagtgtcgctgagcgtacgattttcacgaaatggcggacgatttcgtgaaaaccgtacgttgagaacgggtaagcgtacgttcttcacaaagttagggattatttcgcggaaaccgtacgttgacgtggctgggacggccgggatgcagtgtcatcgaagcatcaccgcgccaaagtccggagttggcgtatacttgacaattgttgctttggcgagggaagtgtgcgtgctgacacatgacacagcttccgttatcgactcggtgtatttcactccttgtagggtgtctttcggcgtgtcgtggcgtctgagcgagacagaacgaaacgaaactacaaggagtatccattatggctaccaccattaagcttgagggcgaggcccgttccgagttcggcaagggcgttgctcgtcgtctgcgcgttgccaacaagattccggccaccatctacgccggcggcgaagagcccgccttcgtgaccttgccgatgcgcgagaccaccctggccctgcgtcacaccaacgccctgttcaccatcgccttcgacggcaacaccaagatggccgtcgtcaaggacgtgcagaagaacccggtcaagcgcatcatcgagcacgttgacttccttgaggtcaaggccggtgagaagatcgacgtcgaggtgccggtcttcgttgaaggcaccccgaagggcgctgctgtggcattcgtcgacattcaggagctcaaggttcgcgctgacgtcgccaacctgcctgagaagatcgttgtgagcgtcgagggcctaaccgacggcaccaaggtgttcgctaaggacgttgttctgcctgaaggcgttgagctcgacgttgaggacccggaagagtccgtcgtcaccgttgaggtgccggaagatgcttctgagtccaccgccgctccggaagctgctgctccggctgccgacgctgctgctccggctgccgacgccaagtgagtcgatcgcttcgatagcgaacaattcagaacataactgaaacgtggaagcccgcagccgttgagaacggtgcgggcttcttcgttttttcaccatgtgaactctgccacacgagtaacacatgggtgtgcaaaagtatgcaacagagctcgcgccacaagcgcacagcacacaccccatatggtggctttcgggccgccaaagtcaagaagaagtagctagtaatgactgaaaacacgcaccacgatccggcagcgctcgacaagctcgccgaaccgttcaccgtactgccgaacgacaaccccgcatccgatgagaagcgccagtccctcatcgacaagccggctttcggccaggtgttctccgacaacatgacccacatgacctggaccaagggcgaaggttggtccgaccgccgcgtcgaaccgtacgcaccgctcaagatggatccgggtgcttccgtgctgcactacgcacaggagtgcttcgagggcctcaaggcttaccgtcatgccgacggctccacctggctgttccgcccggatgcgaacgccgagcgtttccagaactccgccaagcgtctgtacctgcctgagctgccgattgacgacttcctcggttccgtggccgcgctggtcaagcgcgacgccaactgggtgccgtcccgccgcgagtacacgctgtacatgcgtccgttcatgttcgcttccgagccgttcctcggcgtgcgcgccccgcaggaagtcgactactgcgtgatcgcctccccgtccggcccgtacttcccgggcggcgtcaagccggtgagcatctgggttgaagacaagtggttccgcaccggccctggcggcactggtttcgccaagtgcggcggcaactacgccgcctccctgctcggcgagtacaagggggttgagaacggctgcgagcaggtgtgcttcgtggacgccgccaccaagacctacctcgaagagctcggtggcatgaacatgatggccgtgcacaaggatggccacgtggagaccccgtccctgaccggtaacattctgccgggtgtgacccgtcgctccctgattcagctgctgcaggacaagggccacgacgtagtcgagaccatgattgccctcgaccagctgctcgaggacatcaagtccggtgaggtcaccgaggtgttcgcttgcggcaccgcagccatcatcaccccgatcggtcgcttcaagtccgagaagttcgatgtcgccgtcgccgacggcggctccggcaagctcacctgcgaactgcgtgacgagctgctcggcatccagctcggcgaagtcgaggacccgcacaactggatgtggaaagtgtgctgaatcgccttttgtttctgactaagaccccttggaacagcaacaattccaaggggtcttggcgtattggaaatgttcttggctagagagatacagatggatttagcaacattccgcaacaaataatatgatctaggtcttctgcacgttgcgggggtggttatggttcatccagatgagaacaggagcaaacctatgagcaagatgagtgacatgacggaataccatgcttcagcctaccgtttgccgtcaggcttcgaacactgctcgaaattgaagccggtggctgaggcagcgacggcgctggaccgggtcaaggccgtggtggatgtgctgtattcgccgggcggctgcccgtgggacggcaagcagacgaacaagtcgctgctcaagaatctgctcgaggaaacctacgaatacgtcgacgcggtggagactcacgaccgtgacaacatgcgcgaggaactgggtgatgtgttgctgcaatccgtgtttcaggcgcgggtctgcgaatcggatactgaggacccgttcggtattgatgaggtcgccgatcggttggtgaacaagctcatcactcggcatccgcatgtgtttgcggctgatgatgccggcaattcctctgattcttctgatgcttttgatgctgacagtaacgacgggggagaagctgcccaacccgaatccccggaagctgtgctggctctatgggaaaagatgaaacagcaggaaaagcatcgtaaatccgtgcttgagggcatttcccgcgttcaaggtgcgttgcctcgcgcggccaaagtcgtttctcgtatctccaaatcgccgaatgctgatagattgttcgcggcgtttgatgagtcggctgcggctgatgctcagcgagatgatgtacatcctcaagcggcgaaccaatccgaatcaagcggcgacaattccgctgaacgggagaaggccgatgcctacgccgatgaaatcctcgccgtcgtgcgcaaggcccgcgttgacggcatcgatatcgagtccgcactgcgcaatcgcttgcgtgatgtcgaagaaaaagtcgccttgattgaatcagaaatcaacaacgattaagtccatacatgttttttgatcacggatcgtaaaacttagaggtgctgagttgccaacgactaccggcaagctggcgtcattgccatcctattcacgtcttagtggccccttcctccccggccatactactcaggcaaggcctgttgtaggctcgggtacgacgggctgtagcgccgaataaggatgaacgggaacagaacgaagacggactgagacgaaccgaagcggtaccagaggggagtggctcatgcaggtggcgttggagaacaacatcgtttttgtggtcatcgagtatttagcaatcctgtgttggggattatcgggcggacttgccgccattcgcaagggctacgacatcttcaccatcatgctgtgcggatggcttaccgcactcggcggcggtcttgtgcgcgacgtgatgctcggtgccctgccgccggtcggcatcaccgacaaaggctatgtgctcaccacgctgttttccggcattatcgtggtggtggcccatccggagatcaccaaactcaaatggacgatgactgtcatcgatgctctgggcctcggactattcgcagtcagcggcaccgcaaaagctctggcctacggttcctcaggcatgacagccgtattccttggcatgttcacagcactggccggcggcctcattcgtgacatcttcattggcgacgtgccaatgattattcgagacaaacacctctatgctgtgccttcgttcatcggctgcatcctgaccgtgctggtatggcgcggcgtaagctacggctggttcgacatgcgctcggaaatgctgctcgacgtgctgatcgtcatcatcgtggtggcgctgcgactgctctcggtaggcttcaacgtcactctgcccggagccgtcgaacgtcatcgcgtctacctgcccagcgaaagccgatatctcaagcgcccggtcatccatccgcacgccgataccgtcgatcccggcgataccaccaaggacgaagaagacaagcctcaggatggttcaaggccgcctcagggctaactgtcttcaaagaggtacatctggccttctgcagaatgctaactgctttcaaagaggtacctgaagcacgaaacgttgagtataagtgttgcaatgatggcgtttatagttggtttttcccgtattcggtacctctctgaacggagatgtcatttcgcaagaccgccaatgtacctctttgaacggagatacaaaaagtcccgcaagccagatgacttgcgggactttctaaaaccttaagaggcttatgctcacagagcgttgatcgcaacagcgaggccggacttgcggttggcggcctggttcttgtggatcacgccagcgccagcagccttgtcgagcttctgggcggcaaccttgtaggcggcctcggcggcagccttgtcaccggcggcgatggcttcgcgggtggcgcggatggcggtcttcaggccggacttcacagccacgttgcgaaggtgcgccttctcattggtgagcacgcgcttcttctgcgacttaatgtttgccacgtttactccaaacgatgtgtgttataaggacatacaaaagttagaggatagcatgagccccggaaaaacccgcgcaatgccacgccgaatacagtccctcggctacactaggtgaagtttgagtatatgccaagaggaggaatgcgttggtcgtccaacacaatcagccgggttccacggatcagtcggtgattcgcaacttctgtatcatcgcgcacatcgaccacggcaagtcgaccgtggccgaccgcatcttgcagttgagcggcattgtgcccgagcgagagatgcgcgatcgcttcctcgaccgtatggatatcgagcaggagcgtggcatcaccatcaaatcccaggccgtgcgcgtgccgtggacctttgacggcaccgaatacacgctcggtatgatcgacacccccggccacgtggacttcacctatgaggtgtcccgcgcactggccgcctgcgaaggcgcggtgctgctcgtcgacgccacccagggcatcgaggcgcagaccctgtccaatctgtatatggccatcgaccatgatctggccatcatccccgtgctcaacaaaatcgacctgccgtccgccgagccggacaagcatgccgaggagatcgcaggtctgatcggctgcgagccgagcgacgtgctgcgcgtctccggcaaaaccggcgaaggcgtggccgacctgctcgaccagatcgtcatggacgtgcccgccccgcacggcgaccccgatgcccccgcccgcgcgctgatcttcgattccgtctacgactcctaccgcggcatcgtcacctacatccgtatggaggacggcgaactgcacgaccgcgaaaaggtccacatgatgggcattggcatgacccacgatcccattgaaatcggcgtgatcagccccgatatgacccgcaccaaggcactcggtgccggcgaggtcggctacatcatcaccggtgcgaaagatgtgagtcagtccaaggtgggcgacaccctgacttcggccgtccgcccggccgccgagccgttgcccggctatcgcgacccgaagccgatggtctacgccggtttgttcccgatcgacaacgcccagttccccgaactgcgtgatgcactcgacaagctcaagctcaacgacgccgccctgatctacacgccggaaacctccgtggccctaggcttcggcttccgctgcggcttcctgggtctgctgcacatggaaatcgtcaacgagcgactctcccgcgagttcggcctcgacctgatccagaccgccccgaacgtcacctacgacgtgaccgccgaggacggcagccagcatcatgtgaccaacccgagcgaattcccggacggcaagatcaagaagattgtcgagccgatggttgccgccgacatcatcacgcccaaggaattcatcggtgcggtgatggatctgtgccaggaccaccgtggcattatgggcacgatggagtacatctccaccgatcgtgtcgagatgcactaccgcattccgctggcggaaatcgtgttcgacttcttcgaccagctcaagtcccgcaccaagggctacgcttcccttgattaccatgaggatggcgagcagtccgccgatttggtcaaggtggacatccttattcagggcgagaaggtcgatgcgttcagtgccatcgttcaccgcgataaggcgtattcgtacggtgtgatgatgaccaagaaactgcgtagtctgattccgcgtcagcagttcgagattccgattcaggctgcgattggttcgcgcatcatcgcacgtgagaacattcgtgcgttacgcaaggacgtgctcgccaagtgctacggcggcgacatcacccgtaagcgcaagttgctcgaaaagcagaaggctggcaagaagcgcatgaagatgctcggccatgtggaggtgccgcaggaggcgttcatcgcagccctgtccaccggcgaggactccaacgaccgcgacaccaaagacaagatccgcgccgctcagaagaccgagggctagtgttcgaggtctacatccacgtcccgttctgcttgcggcgctgcggttactgcgacttcaacacctacacggctacggatcttggtgcgggggcctcgcgcggcaactatgccaatatggtcattcgggaaatgaaattgaccaagcagtggcagctcgaccacggcatcgaggagccgccggtttccaccgtgttcttcggcggcggcacccccacaattctcgccgcccgcgatctggtcgccatgctcgatgccgtccgcaagatctggagcatcgcgcccgacgcggaaatcactaccgaagccaatccggacacggtcaacgagtattacatcaatgagctcgctgccggcggcttcacccgtgtttccttcggcatgcaatctgccgtgccgcacgtgctcaaaaccctcgaccgcacgcatacgccggccaacgtggccgtaggcgtcaatgcggcgaacaaggctgggctgcgctccagcgtggatctgatttacggcgctccgggggagagccttgacgattggcgcacctcggtcacgaccgccatcgatcttggcgtaaaccacatctccgcctacgcattgaccgtggaacccaccacgaaaatgggccgtcaaatcgcggccggcactctgcccaagcccaatgacgatgacgaggccgctaaatacgagatcgctgacgacctgttcgccgccgccggcctcgaatggtatgaggtctccaactgggctcgccccggatacgaaagccagcacaacctcggctactggcgcaacgttgattgggccggtctagggccaggtgcccactcccactacaacgcggtgaccgaggctgaccacccccagtcggcttcgctgacagcccccgctggcgggagcaagtccgaagccattgcctctgcctcagctgatggacaggccaacgccgaactaggtatgatcaacgcgcatgggaacaactcccaagaaattcatgcccccgctggcgggggttgtccggcggatgccggactggggtggtttctgtctcacacggtctgcgcagctgggacatcgcgcacccgcgtttgtggggcacggccatcaacgagaaccgtgtgccgtgggccgatagcgagacgatcactcccgaggaaaacctcgaagagctcatcatgctcgggctgcgcctgcacgagggccttgacctcgaccgcatcaaccgcgccatcaacgatgcgggtatgagcagcacgccccagactctccgtaatgtttcccttgaccaactcgccccaatggtcagcgaaggcctgattaccgtatccgataatcatcgagtggtgcccactcgtcgtggccggttgctcaatgactcggtaatcgaacagttcttcgatttcgtcggtgtatgagtcggtggtatggtgcgcggcagtcgccattacctgttcgctagttgtggttacaccgtcagagggagctatttttgttttaccggcgggggagggaaccgcgtaggactacgtccggggcgctttgcacgtagatcaggcggttggcagtgccgccggtggcctccccgtcatcgcggttggacaggatgctgtccacggcggcctggcccatttcggccagcggcagatgcacggtggtcagtggcggaaacacgtcggcggagtaggggatgtcgccgaaaccggtgacgccgatttcccgacccggctcgatgccgttggcgcgcaacgcggtcatcgcaccgatggccatcacgtcgttgagcgcgatgattgaatcgatgcctttgccgtcgtacagtgcgccttcgcccggcttcagcagtccggatcgggccatttgcatgacggccgcatagccgtcggtacggctgaacttaccattcgccacggctttcggatccacggtgatgcctgcctcgtccaacacttccatcacgccggccagtcgttctttggaggagcgatgtgcgtcatcgcccttgagaatcgcagggcgcgtatacccggaatcgacgatcagctttgcgatggcgcgcgcgccgacatcgttcgccatgtccacggccgggaagggcaggttgcggttgagcacgaacacggcacgtccgccggatgcttcgtactgggtgagttccgtctgcaacgcctggcgttccggcgcgtcggtgtattcactttcggagatgatgatgccgcgcggcctggtggatacggacttacgcaccgcctccaactcttcgtgcggggtggctgccacgccgatggtcacggaaatgccgcgttcggccgccgccttgaccacgccttgagatacggatgcgaagtagggatcggagatatcggagaccagcagcacgatgttcggtgcggtgcctttggccactgcctgagcataggcgttgggacgatagttgagcttggtggctgcttccatcaccttgacatacgattggttgcgtaccttgcgggtgctgccgttgagcacgcgggatgcggtggcgatggagacttgggcttctttggcgacatccatcaatgtcgctggcgattgcgccttatcgttctgtacagccacgatcgaatcgatccttttcttccctgaaacggaaaacgtgtctaaacgtttaccgcaacgatatcgcatttttgcttgcaatagtagcattgtggattggaaagcctgaattctgaacaaaaaaataatcacgcgaattacggaaaacgtttaccgtttcgtcgtgtcgtgcggtatgctcgaagcatgacgcgatacttatgcgcccctgactccttcaaagagagcctgaccgccatggaggcggcccgggcgatggctcaggggattgagaatgccgaccacgatgccgaggtccgttgccttcccatggccgacggcggtgaaggcaccgcacgcgcgcttgtcgacgccaccggcggatcgatgcgcgccgtgccggtccacgacccgctcggccggcctgtcgaaggccacttcggtctgctcgccgacggcacgaccgccgtggtcgagacagccgaagccagcggactggcactgcttgaagccaaagaacgcaacccgttgatcgcctcctcctacggcaccggcgaactcatgctcgccgccgtccgttccggagccaagcgcatcatcgtcgggctcggcggcagcgccaccaacgacgccggtgccggacttctgcaggccctcggcgttcgtcttctggacaagaacggtaacgacttggcacacgggggagcggccctcgccaatctgaccaccatcgatatcagcacgatggacccggctctcaagaacgtcgccatcaccgccgcctgcgacgtgaccaacccgctgaccggccccaccggcgccagcgccgtgttcggcccgcagaaaggtgcgtccaaagatgatgtcgccacattggacgccgccctcgcgcattttgcgcaggtaatcgacagccagctcggcgttgccgtgaacgacgtgccgggtgccggcgcggccggtggcatcggtgcagcgctgaagggcttcctaaacgccgaattccgcccgggcatcgccatcgtcatcgaacaatccggactcgatgcggccgcgcaatgggctgacgtggtgttcaccggcgaaggctccatcgacttccagaccaagttcggcaagacgccggccggcgtggccgaaaccgccaagcgccacggcaagccggtcatcgcagtagccgggcatattggcaccggcatcgatgagctgcatgaggtcggcatcgacgcggtattcggcatcgcgcccggagccgccagcctcagcgaactgctggccgacgcggccgccaacgtgacccgcaccaccgaacaaatcgtacgaaccctacaactgtgagcaggctcccgctggcgggggctggcgggcttcgcccgactgggggggcagcgctgagaaccaccctcagtctcgctatgcgagacagctcccgcagcgggagcgagtaccggaaaggaagacgtgcgcgccacactggaaaccgtgagctgcggcgaactgaccgccgtgtatcgcaaagatagcgacaccggcatcgtggaactggtatcatggatcgtcgacgcgagctcggtcttgtgacatgattggtggtgatggaatcaacgatgagtccaacaaaacggcaccgcctcccattgcgcaatatcgcgcgcaatattacgcagcgtattggctctccgaatgcgtgtctgctaaacctcgtgttgctctatcagcgagctttccgactgcgcagctcaggcaacatcacgacgaacaggatgaccgccacaatcgcggtcagcagatcggcgatggcctgcgcggcgattacaccctgatagccggccagccgggagccgacgaacagggtaatcgccagcatcacaccctgcctgctgatcgacagcacaaaggcgccgaccgccttgcctgcggactggaaggtgcaggtcgtgaccatcacgacggctacgcacaccaggctcagcagctgaacccgcagcatgccggcgcccagcgtgatgatggtggcgtcctcgatgaagaatcccatcagtagacggtcggacaggctgagcaccacggtcatcaccagggcgaacagggacaggaacaggtaggaaaaacgcagaatgccgcgcagtcgaggcatattgcgggcgccgtagttgtagccgatcagcggctgcgcgccgaacgcgaatcccacgaaaaccagcaccgcgatcatgatgactttcagcgcgatgcccatcgcggctaccgcgtcggtaccgtaggggagcaggaacaggttgatcatgacgatgccgacgctctgcgtgaggttcgtgatcgccgaggggatgccgatggcgaggatgctcccgacctcccgggccgtgaccgccagacgccggcgcgcgcggtcgatgacggtccgcgggtcgatggacaggttgctgctgtgacgcagcgtgaaccagacgaaataggcgtcggtgcagatgttggcgatcacggtggcaccggccgaacccgcagcaccccagccgaatccgtggatgaacaggggattgagcacgatgttgaccgccgtgccggccaccgaaccgatcatggactgcacggcgtggccttcggtgcgcagcaggttggacggcgtcatcgacacgatgatgaacggcgagccgacgatgatcagcgtgtagaagtcggaggcatactgccaagtgtcgtcagtggcgccgagcagcgcgagcatcgggtcgcggaacgccaggcccagcaccagaatcagcaggccggtggcgatggcggcatagaagcagaacgcgctgagtcgcttgccgtcggcgaaccggtgttggccgaacaagcgcgagatgaccgaactgccgccgaggccgaagatgtcgccgagggcgatcatcacggtgaacactggcgcggtgagggagacgcccgccaccatatcggtgtttcccgtatgcgcgatgaaataggtgtcgaccatgttgtacaccaaggtgaccagcatgctgagcaccacgggcatcgccagcgagaaatacgccttcggaatcggcgccttttcgaagagttcgttatccatttccgtcccttggtgtttcgttcttcagtcactgtgcaggatgccgttcggcgtgcatcacaggcattgtagaggcaacagtgtggacaacggacggggagtatctcatgatgcggtgagggcgttgatgatgacgcatcgtgtattggcggccgtgtgcatcgtatgtgaacctgtgctggcgcggcgtacgcacgatgggaaaagaaagaatatatggaccccgttgtcccggttattgttcagttttactgtgttgaattattgcgttattcaattattgtggtgtgccggccgattgcggcctgcgggggattgccttcgtatgtgtcgtgcaatctcatgaacgggattgttcgctagattcagcgagcgtccttgttggcggcgttgatgatgtcggcgaacatcttggagtcggcgtagccggcgcgggcgatggcatccataccggagagggcgagaccgcgaatcatggaatccttgagagacataatcattacctttcgtttgcgcatcgccgtgagcggctttgcgattgttgtttaagctttgttgttatggggtccgtggctaatctgattggattgccggaccggagccgatggctcagcgagcgttcttgttggcttcgttgatcaggtcgacgagcgtgctgctgttggcgcgaccgcactggctcatggagctcaggccgtacacagccagaccgcgaatcatggaatccttgagagacatcatgtttcctttcgttggtcaaaaccttggggctttgagttttgtttatcggcttctttctgaaaccggtttcagaataacgcagtccgatgacaaacgcaaggggactattccgctctcggcgtttctggcggaatatcgccgttctttagataccattcggtagttaagaggttgtctagtcgaccttctgacggccttgttctgagcgtacggttttcacgaggtatggcctcatgtcgcggaaatcgtacgctgagtcgtcgtaagcgtacggttttcacgaaatggggcctatcttcaccggattttgggcacaccggccttgagcagcttggtctcaagattgatggggcgtagcagatcctcatagaacacatggacgatttcggtgacgccctgttcccggagatgccgatcacgtctgcggtcgtactccattttcgcctggaggcttgcgcgattcttgttgctgatgtcggcgtatttggccatgccgtcgtattctgccacgatgatgcggccgtctgcgagcttccaacagaaatcgacgcgatatgacattgcgggattgtcgggattcatgaactgcacctgcagcagggggatgccgaaagacaattcggtgatctggccacgcatcaatgattcgccgccgttttcgctcaggggatccgcgtacttcagcagcttggtcacggagacctcgtcgcagacgctttgaatcatcagcgactgcacctcttcgatggtcgtcagggactttctcagagccgaatcgtatatgggcagcgcctgtgggaatgggaatgccgcgcagtcgagcagcgttcgcgccggagtcgtcaagagaatgccgttatgcttccgcgtcggaatccgattgatatagatgcggttgagacgcgcctcgtctccgccgccgatgccggacttcgaggcgatgtgcactgtgccgtcgtgcagggaatagttgtgctgcagtccgtatacgcacgccgcactcaaccccgcaaatacccactgagggtggattgcggacaacgcacgtatgacctgcaatgactgttgctctctggtcatggtgttccaaagtgttcggtcggcgtacaggttcttatacggtgacaccagctccccggcatgcaggcgacgtttcagggcgcgccgttgcgcatcactggtgccatagcagcagcgacgctcctgcttcgcctgctgcagcagtgcagaaacttccttgtgttctttcatatctcgacgctaagggtgattttgatcgttgcacaagctcaaccggcaaatgtggatactatgtcacgcgaattgttgctgtggataacttgaatcgacgtcgacggctttgccgacggtcttgtcggaggcgatattagcctaggacaccttgctgcgccgccttccataccgaaaacagtcatcagtgacaccgggggcatcttcagcgtacgttcttcacgaaatcagctgccatttcgtgaaaaccgtacgctcagaatgactcagtgtacgttcttcacgagatgaggccccatttcgtgaaaaccgtacgttgacgacgattcagtgtacgttcttcacgaaattagggatgatttcgcggaaaccgtacactcaccgcaactcagcgtacggttttcacgaagttatcgatttgggtataggttcccccgtcatgaactacaatgaatcgcggcgaaaaacggagaaccgaagtcggagcgcggctgaacggatatgggtgtgactggatggctgtcatagtgatgccggttctctaacatacgcaataacaacaactgacaacaacaggggagacaaggatggcgagaagtgcgggccgcacccggccggtgatcaaggacgtggccaaactggccggagtctcggcaccgaccgtctcccggtatctcaacggcaccgtcaacgtcaccgaagacaagcgtgaacgcatcgccaaggccatcaaggagctgggctacgagccgagcattgtggcgcgcgctctgtcgaaccgggagatggactccgtggtggtgttcgcggccaatccttccgccttctccacgtccgaaacgaaccatggggtggaggccgccgcccgtaaacgtcggttcctgctcaatattgtttctttggacgagtccgacatggactccgtcaaggctcgcgtgcgcatgggtttgtcgatcaggccggcgggcgtgatcgtctacgagtacgaccgggccggcatcgccgcactggaatacattcccaaagatatgccgatggtcgtggtgggtggcagcctcggcgacggtgaataccaggtcatcaacgccgaaagggatggcggccgttggatgaccatgcatctgctggatctcggccatcgcaccgtgttccatgtggggcgtccggaaggtccgaccgataacacccgcaccaatgggtggcgtgacgcgctcaaggagcgcggcgtcacggcacctgacccaatcatcgtgcccgacgatgatttggaggagtcggtcaaggctggacgcaccttgggccgtcgtggtgatgtgactgcgattttcgccggcaacgacgagactgccatcgctgtgatccggggtctaagggaggttggtcgccgcgtgcctgctgacgtgagcgtcgtaggctttgacgaccgcaacttcggtgccatgtggaatccggcgctgaccagttacacccagaacttcctggacatgggggagcggtccttccgaatgctgttcgaacagatccaggccaagcgcgccggcgatgacgcgccgccctcgcaggtcgaggtggtgcaaggcaagccgtgtctgcgagcctccgaacgcgcgtacggcgacggtgaaatcgcgtagtcgatggggcgtgcgtatcaatcatagtgactgtagcgcatccatatcgtggtgaggagtctctcatgccgaactgtaagcgcttaccttaagtagtttgtaatatggtttacgtcatactaatagatattctaaatcatagtgttttgcaagggcttttgcggaaaatggctatttatcaacagttttcgaaaagtccgcatgacgggcgactgtgagcacgctttatggtaaccgctttctgtagcattatcgttagagtatgacttttgaacaatcggcaactctgaagactcagccccagacctcgggcactatctcagcggcagacgccgtgatgcaatcggcccgcgacgaacgcatccccggcaaactcatctgtacgatcatggccgtggtcattgttatcgtgttcgtcgccatgctccacgccctacgtaaccggaagtaggttgtaggcgggattggtctgactggtatccgccacagccgggttcggtagagcggctaccaatcggccagtgtctctatggcatcgaatcctgttctgcgatgttgttcgtcaaggttgttccagtaaggtgattcatcggtgagcatgtcgtacgggagcttgatacgtctgcgatccgtgtggctatgtagtcgccgagtttcggcatcagggtcggtgatgagggatgcgagcattgcggcatcgtacagatgtctatctccatatccggcatggtctgcttggtatgcggcgctcttaagaatcaacgcgccaagcagatccgcgtcggtagcgggacgcacgtcgagaccgcccatgatggcgtgcaactgcaccatgagaccgccggtgagcagtcatgattcggcaatgcgctcggccaccatgtatacgatattccacggatgagcgccgctggggattgcaatgcgggaaatcattgctcatttccttgttgtatgccgtgatgagttctgtaagggtttcgagcccctgcgcgtcgttctctcgggtcgttggattcggccagatcagcggcgcatacgccgatgggcatgggcccctgcccggcgggcagaaaatcagcgagatgccgtgattcggcgggaggacctgtactggcccagcccttctgttcggtagtggtaccgctacaccgactctccccgacactccagtgccgccgatatcagtgaatgcccagcctgatgtcggtagagtaaaggctattggcttggtctcgacggcgagacttctccaatggccaatatgcactgttgcaaaggagcatgcggtatgcaaccaatcaaagccattcaatacggctgcggcaaaatggcgaagtacacgattcgctatatgcacgagaaaggcattcaaatcgtcggtgccatcgacgtgaacccggaagtcgtgggcatggatgccggtgtgtttgcaggcatcggccccatcaatgtgccgattcgcgccgatgccgaggctgtactcaacgagtgcgacgcggatatcgcggtagtcacgctattcagcttcgagaacgaaatcgccaccatgtgcgagcagtgcttggcccgcggcatcagcgtgatcaccacctgcgaggaatgcatctacccgtggaccaccgatccggccaccacgaaccgtctcgacatcatcgccaaggaagccggtgccaccatggtcggctccggcatgcaggacatctactgggtgaacatggtctccaccgtcgccgccggatgccacagcatcaagaagatcaccggtgcggtgagctacaacgtcgaggaatacggcctggctttggccaaagcgcacggttgcggtctgaccgccgaggagttcgaggccgagcttgcgcatcccgaaaccgtggtgccctcgtatgtatggaattccaatgaagcgctggcccagaagcttgggcttaccatcgcatcgcagacccaggccagtgtgccgtatttcagcgatgtcgacgtgtattccgaaacgatgggcgagatgattccggtcggcaaatgcatcggcatgtccgccgtggtaaccaccgaaactaatcagggcatcacgttggaaactgcctgtatcggcaaggtgtacgggccggatgatggcgatatgtgcgattggaagatcgagggtgaaccggacgtggagttccacgtggtcaagccggcgaccgtcgaacatacgtgcgccacaatcgtcaaccgcattccggacgtgctcaacgcgccagccggatatgtgacggtcgatcagctcgatgagatttcgtatcttacgtatcccgccgcgctgtacgtggcatagccttcatattttcaaggatgaaggccggcactcataagggtgccggccggtatcaggcggccagagtcgacgtgcgtggcatcacctggaactggatatggtcatgggtgatgtcatcgggccgttcatgccgtaggttcgactcgttcagcgtcaccatgcgatcgataaccgtacgagccattgcggggacgtccatcgccacagtgctgatgggtgggttggtgcaggcggagaaggggataccgtcgaatcccatgagccgtacgtcgtcgggcgcgtggatgccatgttcggtgagttcgcggagcgcgccgatcgctatggtgtcagacatgcacagttctcatgttcccgctggcgggagctgtcatgcgaagcatgactgagggtggtccacagccgccaatccgtaacatcacccaacgcagcatttcacgatacggacgtttccgtatcgtattttcgtgtggtcaaatagacatttcgagcgaaaaagttcgaaataccccataactggccataaaaaaattgcttgagaatcactattgacttttatggcgactcggtatatggacacatgaaacgtaaatgacatggagcgacggtactgtgtcaacagcaatgaacgaagaggcatgattttcttacgtgcccacaaccaattgaggtgatttcggtgacattcaaagccccgctcgatctcacggtccacgctccggacggtatgtatgatcccgccaacgagcatgacgcctgtggtgtgggtatggtcaccactttgaacaagcgtcctgagcgcaagatcgtcaccgacgccattgaggtgctggtcaaccttgatcaccgtggtgccgtgggtgccgaggagaacacaggtgacggcgccggcattctgatgagcatgccggatgagttcatgcgtgccaccgtgcccgccgaactgccggaagccggtcactatgcggcaggcatcgccttccttgaccgcgacatcgaaacctccggtcagcaggaacaggccattgccaagatcgtgcgcgaggagggactcgaagtcctcgcatggcgcgtggtgcccaccaacccggacggccttggcctgcaggcccttgccgccatgccaggattcaagactctcgtggtcgcctctccggacggtgctctggccggcgtggacttggatcgcaagaccttccgcatccgcaagcgcgtcgagcatgaggtgggcgtctacttcgcatccctgtccgcccgtaccatcacgtacaagggcatgctcaccaccatgcagctcacccacttcttcgaggatctgaacgacgagcgcatgaaggccaccatcgccatcgtccactcccgcttctccaccaacaccttcccgagctggccgctggcccagccgttccgtctgctggcccacaatggcgagatcaacaccatccagggcaaccgcaactggctctccgcccgtgaaggccgcctgagcagcgaactgctcggtgaattcgagccgctgctgccgatcaccaccccgggctactccgattccggcaccttcgacgagtgcctcgaactgctgcacctcgccggccgctccctgccgcacgccatctgcatgatgctgccgccggcttgggagaagaacccggatctcgatccggacgtgcgcgccttctacgagtacaacaacacgcttatcgagccgtgggatggcccggccgacatcgtcttcaccgacggcacccaggtcggcgccctgctcgaccgcaacggcttccgtcccggccgctggcagctcaccgatgacggctacatcgttctggcctccgaggccggcgttctgccggagatcgcgcaggaacacatcgtgtccaagggccgtcttgagcccggcgagatgttcctggtcgacaccgccgaaggccgcatcattcccgatgaagaggtcaagaggaacctcgctgcccagcacccgtaccgcaagtgggtggaaggcaactccgttgaaatgagcgacctgccccgccgcgagcacgtcagccactccggccagtccgtccagcgccgtcagcgcgccttcggctacaccgaagaggatctgaagctcctgctcacgccgatggccaacaccggcaaggaaccgctcggttccatgggtaacgatgcgcctatgcctgcgctttccagccgcagccgcatgctgttcgactacttcacccagaagttcgcgcaggtcaccaacccgccgctggactgggagcgtgaggagatcgtcacctcgctcgaatccgccatcggccccgagccgaacctgctggccgattccgagctgcacgccaagaagatcctcatcccgctgcccgtggtcaactctgatgagatggcccagctcaagcgccttgacaaggcccgcatcctcggcggctactaccgcccgtacgtggtcaagggcctctaccaggtcgccggcggcggcaaggccctcgaagagcgacttgacgagatcttcgccgaaatcgacgaggccatcgccaacggcaagaacttcatcgtgctctccgaccgtgagtccaaccatacgtggggtccgatcccgtccctgctgctgacttccgccgtgcagcaccacctgctgcgccgccacacccgtacacagatttccatggccgtcgaggccggtgacgtgcgcgagattcaccatgtcgcgctcctcatcgcctatggcgccgcctgcgtgaacccgtacttggcattcgaatccgtggaagatctggcccgtaacggctacctcaaggtcgacgcggacaccgctgtgaagaacctcaccaaggccctctccaccggcgtgctcaagatcatgtccaagatgggcgtctccaccatcatgagctaccgtggcgcgcagctgttcgaggctgtgggcctgagccaagaagtcatcgacgaatacttcaccggcaccacctcccgtgtgggcggcgtgggccttgaagaaatcgccgaagaagtggccatccgccaccgcgtggcctacccgaaccagtggagcgcgtccccgcaccgcaacctgcgcaccggcggcgactacaagtggcgtcgcaccggcgaggaccacctcaacgatcccgaggccatcttcctgcttcagcagtccacccagcgtggcgactaccagatgttcaagaagtattcgcaccacatcaacgacacgtcgaaccgactcatgaccctgcgtggcctgatgaagttcaacaccaaccgcaagcccatcgacatcgccgaagtcgagccggcctccgagatcgtcaagcgcttctccaccggtgccatgagctacggctccatctcgcaggaagcacacgagacgctcgccatcgccatgaactcgattggcgcacgctccaactccggtgagggcggcgaatccgacgaccgtatcaatgatccgcagcgctacagccgcatcaagcagatcgcgtccgcccgcttcggcgtgacctccgattacctcgtgcacgccaccgacctgcagatcaagctcgcccagggggccaagcctggtgagggtggccatttgcccggtgccaaggtcccgccgtggatcgccaaggtccgtcacgccaccccgggcgtggagcttatctccccgccgccgcaccacgacatctactccatcgaggatctgaagcagctgatcaacgatgcgaagatggccaacccgaaggcacgtatccacgtcaagctcgtttccgagttcggcgtcggcaccatcgccgcaggtgtggccaagtgccatgccgacgtggtgcttatctccggctatgacggcggtacgggtgcagccccgctcaacgccatcaagcacgccggcaccccgtgggagatcggcctgtccgaaacccagcagacgctgatcctgaacggcctgcgctcccgcatcgtcgtccagtgcgacggcgagctcaagaccggtcgtgacgtggtcatcgccgctctgcttggtgccgaggaattcggcttcgctaccgcagccctgatcgtggaaggctgcgtcatgatgcgcgcctgccagaagaacacctgcccgcagggcattgccacccaggatcctgagctgcgcgcccgctttaagggcaagcccgagtacgtggtcaacttcttcatgttcatcgctgaggaggtgcgcgagatcctcgcccagctcggcttcaggactcttgaggaggccatcggccacgttgagtgcttggatcaggacgaggccatcaagcgctggaagtccagcggcatcgacctgtccaacgtgctcaagcaggccggcccggtacccggcacgatcctgcaccagaccatcgagcagaaccacgagctggagaaggcgctggacaacaagctcatcgaacttgcccagccggccctcgaacacaaggaacccgtgcgcatcgaaatgccgattcgcaacgtcaaccgtacggtcggcaccatggtcggctacgagatcacccgccgttacggcgaggaaggtctgccggacgacaccatcgacatgaccctgcacggttccggaggccagtccatcggtgcgttcatcccgcgcggcgagaccatgcgcatctacggcgaagtcaacgactacgccggcaagggcctgtccggcggtcgcatgatcgtgcgcccggaagatagcgtcaccttcgacaagcacagcaacgtcatcgccggcaacgtcaccggtttcggcgccacttccggccagatgttcgtggccggacgcgccggcgaacgtttcggcgttcgtaacggcggtgctacgtttgtggtcgaaggcgtgggcgaccacggctgcgagtacatgaccggcggcactgttgtggtgctcggccccaccggacgcaatttcggtgcaggcttctccggtggtaacacttatgtgcttgacctcgatatgaagaaggtcaacccgggtgccatcaagtccggtgcactgctcttcaagtcgcttgatgccgaaacctccaagctggtgtacgcactggtcaagcagcatgctgaagagaccggttcgcagttcgctgcggctttgctggaggactggaacgagaccgtcaagcggttcactcacgtggtgccgaagcagttcgtggccatgacgaaggccatggaagaggccaaggccaacaatgtagatttcaatgcgcccggcgcctgggaaaaggtgtacgagcaggttatggaaggagcgcgctgacatgggcgacccgagaggatttctgaaggtccgtacccgccgagagctggctgaacgccccgttgaggaacgtatcaaggactggttcgacgttcacgccgaaaccggcctgcaaccgtggacccaagcgcaggcggcccgctgcatggattgcggcaccccgttctgtatgaccggatgtccgctgggcaacctgattcctgagtggaacgatctggtccgtcagggcaagtgggaggacgcgtacaaccgtctgtccatgaccaacaacttccctgaagtcaccggtcgtatctgcccggctctgtgcgagcaggcctgcgtgctcggcatccaccagccgccgaccatgattcgcaacgacgaatgcacgattatcgatcaggcctgggatcttgacatcgtcaagcctttgccgccgcagcgtctgaccgaccagacggtcgccgtcgtcggctccggccctgccggcctcgccgccgcacagcagctcacccgcgccggccacaccgtcgtcgtctacgagaaggacgacgccatcggtggtctgatgcgttacggcatcccgaacttcaagcttgaaaagggtctgatcgaccgccgtgtcaagcagatggaggccgaaggcacccgcttccgcaccaacgtggaaatcggcaaggacatcacgtgggatgacctgcgtgaccgttacgacgccgtcgtagtggccatcggctcccgcgtgccgcgcgatatgaagattccgggccgcgagctcgacggcatccacttcgccctcgacttcctgcccgacgccacgcgccgtatcttcggcgtcaagccggtgcacgacatcaccgccaaggacaagcacgtcatcgtcatcggcggtggcgacaccggttccgactgcctcggcacctcgatccgtcagggtgcgaaggacgtcaccgtgctacagatcatgccgaaagagccgtcaagccgtccggacaacagcccgtggccgaccttcgcccgcacctaccagaagacctcctccatggaagagggcggcgagtacatctactccaccgactccgtgaacttcgagggcaccgaagaggagaaggccaaggtcaccattgataactcgaccaccgccgaaggcttcgtggccgatgagcgtggtcatgtcaccggcttgaaggtcgtctccgtggctcccggcgaaaatggtccgttcacccgccagcccggcaccgagcgcgtgctgcccgccgatctggtcctcatctccgtgggcttcctgcacccggacaccgagaccatcctcgaccagctgcccgtcgaactcgacaagcgtggcaacatcgctcgcaatgacaagttcgccacctcccaggatggcgtgttcgtgtgcggcgatgccggccgtggccagagcctcgtggtctgggccatcgccgaaggccgctcctgcgccgcagccgtggacgagtacctctccaaggaaaagagcgagctgccggccccgatcaagtccagccagcgtccgatgatgctgcctcgctgaatactttccaaacagaaacatgaaaatcccttcttcatgaggggatttttgcgtttctgggattaattactgccttgagtcttaagtaatgtctatatttcgagaatattgcatacgtggttaacatgaagctcctatggtgtctttcgtcgccaaaaagacgacgccagaatatttgggagagattcatgaacacacgtcatgtcacttcactggtcgcggccggtgcggcaatcgtcatgctgctcagcggctgcggatcgaccggtacctccaattccagcaatgcttcagattccaatatcatttccgtgtacggcagtgagccggcacacccactattccccggcaacaccactgaggccggtggcggcaaggttgtagaccagctgttcgcaggtctggtgacctacgatgcgaagggcggcatccacaacgaggtagcagacagcatcacctccagcgacaacgccacgcattacgtcatcaagctcaagagcggatggaagttcaccgacggcactccggtgaccgcgcactccttcgtaaacgcatggaattacaccgccaacagtgccaacaagcaggccagcgccagcttcttcagcacaatcgaaggctatgatgatctgcaaaagccggacgtggaccccaaggccacgctgagcggcctgaccgtcgttgacgacaacaccatcgatgtcaagctcagccagcccgactcggcattcccggtcaaggccggcagccacgcctacatgccgttgcccgaatccgcgttcaaggacccgaagaagttcggtcagcacccagtgagcaacggcccatacaagttcgtgtcctggcagcacaaccacagcatcgaaatggtgaagaaccctgactacaagggcaatcgtgtcgccaagaacgatggcctgaacttcaagatctatacctcgcctgattcggcatacgccgacctacgcggtggcaacctggacttcacgaacacgattcctgacaccgcacttacctccttccaatccgacaagtcgctgaaggcatacaacgagcccggtggcaatacgctcaccttcaccattcctgaatggctggaacacttcggccagaacgaggaaggcaacctgcgtcgtcaggccatttccatgtccatcgaccgcaagaccgtcgccgagaagatcttccacggcaccgccacgcccgccgtcgacttccttgcagccccaatcagcgcctactccaaggaactcaagggaaatgaagtactgaagtacaacccgtccaaggccaaggaactgtgggccaaggccaacgccatctccccgtggagcggtgagttcggcattgcatacaatgctgatggcactgcgaagaactgggttgaggcaatctgcaactacatcaagaacacgctggatatcgatgccaagagcatcccgatgtccacttccgacgagttcctgtccaatgtggattcaggcaagatgacctccgcataccgtagcggttggggccctgattatccatccgcggacaactatctggtacagctgtacgattccagttcggccgacggcaagggcggcaacagcggcaactacaagaaccccgagttcgatgccatgatggacaaggctctttccgccccgtccaccgaggaagccgacaagtattatcagcaaggtgaggagattctgctgcaggaccttccggctatcccgttgtggaaccagaatgccaccgcagccagcacctccgcaatctccggcgtcgcattcgactacggcggcggcccagtgttcaccgcactgaccaagaagcagtaagcagtaagtaataaacagacagcgctagcccccgctggcgggggctgtcggcaaagccgactgggggtggtctcaaacagcagaccacccctaatcttgttatatgagcgagctcccgtaagcgggagcaatcgagaacatacaggagcacattaactatggaattcaccgtatccggcactaccgtgcgattcgatgaacgaacaatgcagttcgcttttacgcgcgacggtgccgaatggaatacctgcgctgatttcaagccgaccctgcaatgcgcgcaaggcaccttcgcgttcgcggatgccacttccatcacccatgagcagcgtgaaaccggcacgggaaccggcattcgcagcatcttcaccggctttgggcacagcgcatactcctttgaaacctatgtatgggtggagcgtgcctcaggcgatgtgctcttcgaatggattccgctcaatgagcaaggcctgaacatcaccaatgtgacgtggcccgcagccatggacttcgattgcgccgacgaccatgacacgacactcatcacccatgagcaaggtgtgatgatccccaacacatggcctaccgccgtgagcaccaaagacatcgccttcgacggccgcttcgaaacggctggcggttacatgccgtggttcgcgcagctccgcgcagacggacacgggtatatcgccatctgcgaaactccatggaatgccggttacggcatcgaccatcccagcaatggcccgtacacccatatcaatacttggtttgagccaagcctcggcacaatgaattatcgccgcgtggtacgctaccagttcctcgaccacgccgatcacacggcggtgtgcaaggcctatcgttcgtacgtcaacgaacgaggtcgcctgcgtacgctcgccgaaaaggcggcgcgcaatccctccgtgcgtgacctgattggtcgctcgtgggtgcacatcggcatcaaaaccaaagtgcagcccgactcgtactactacgataaggaccaccccgagaaaaacgagtcgctggtcaccttcgcacagcgcgaaaagcaaatgcgaacactgcacggcatgggtgcaggccgactgtacatgcacttggatggttgggcacagcccggatacgacaacgcacaccccgactatctgccggcctgtcaggaggcaggcggctgggaaggcatgaagtcgctggtcgacgcctgccatgagcaaggcgatattttcggcacgcatgaccagtaccgcgattactacttcaccgcgcaaacctttgatgccaacaatgcgattcggctggcagacggtacgatgcccgaacacgcacgctgggcgggcggccgccagacctacctgtgcgccgagctcgcaccggactacgtgcgccgcaatttcacccagattgccgcgcatggcatcaaactcgactgtgcatacttggatgtcttcacctgcaacgaaggcgacgaatgctcgaaccccgaacaccgcatgacccgccgcgaatgctttgaccgccgcgccgaatgcttcgaatatctgctctcgcacggcatcctctcctcgtccgaagaggtatcggactgggcagtgccaagcctgatattctgccattacgcgccatacgacttccagatgcgctcacccaacgagccgcgccaaggtgtaccggtgccgctgtataacctcgtctaccatgattgcgttatcgagccgtggatgatggagcgtgtggtggacggcgacgattacatgctgtacgccttgctcaacggcggagctccatacctgattcgcgatgccgcatacatcggcgttgacggcgacatggacgacgaacagcgcgctcgcacggaaaacgacatcgaacgctgccatacggtcgctgcattccatgagcgggtcggcatgcaggaactggttcgtcacgagttcgtggatgatgatccgctggtgcagcgttcggtattcgcggacggcactgcggtcacttgcgacttccatacgcaaacctatcgcatcaccgactgcccgcatcactgactgaaaatacaatgacacacagtgggttccgatggactggtggcaaattgccgccgataagcgagtaatatagccaacagtgtcaccgtcgaaacaggagtagtgaaatgccgaatcgtgcagaacgccgtgcccaagccaaagcaggccgcaggggagtgccgtcgcagtatgaccagacccgtggccgtggccgttcgggaatgattgacgaataccagctgcagcagaagtcccagcgtctgcaggacggcaccgacggcaccgaatggaagcccagcggcggtacgattgcggacaccgaaaccctgctgaccactaacccgaactacacgaatccgaagatgttcaaggcaccgcattcgctgcgtcagtggttccgtgtgggcagctggacgctgatcgccatcgcgattatcgcgttcttcgtggttatgtggctgccaagccatccgatgtggctgatcatcaccgtttccgcggtgttcattgtgggtgtgctgagcctgttctttacggctggcgattccaagcataatccgaatttggatcagaacggcacggcagtctgatcttttgcccggtaaatccggcttgaaaagcaaaacgcacgacggaagttgtgcgttttcttgtatgcggtgccctaaagtaagaagtgcttgagtttctttctgacgcacgaaggagaggcagtccgatgaaagttgatattctaacccgcgaatacccgccgcatgtctatggtggggccggtgtacacgccgaggaactgtccaaggtgcttgccgagcgcatcgacgtaaccgttcgtgcgtttgatggcaagcgcaccgaggcggacattcctgctatcccgaatgctgccgatgctaagggcagcttgaaggtcgtcggctatgacacgccttctgagctggctgatgccaaccccgcattgaagaccttcggcgttgatttgcagatcgccaatgatgtggacgccgacatcatccacgcgcacacctggtatgcctgcctggcgggctacatggccaagatgctgcacggcactccattggttattaccgcgcactctctggaaccgttccgcccgtggaagcgtgagcagctcggcggcggctacaatctgagctcctgggctgagaaggatgcttacgagcacgccgatcgtgtgatcgccgtgtccggtggcatgcgcaaggatattctgactgcttacccgaacctcgatccgaacaaggtggttgtggtgtacaacggcatcaccatggccgacttcgctaccccggcaccagacgatccgggttggaaggtgttcgagcgttaccacatcgaccgttcgaagcccaccctgctgttcgtgggccgtatcacccgccagaagggcctgccatacctgctcaaggcactgcacctgatttccaaggacattcaggtggtgctgtgcgccggtgctcctgacaccccggaaatcgccgaagaggtcaagatcgcgttcgccaagctggatgaggaacgcggcaacatcgtctggattgaagaaatgctgccgaagcctgagctgaatgctttggaacacggctgtgatgccttcatctgcccgagcatctacgagccgctgggcatcgtgaaccttgaggccatggcctgcggtctgccggtcgtcgcatccgccactggcggcattccggaagtcgtggtcgacggcgaaaccggctatctggtcccgatcgaccagctgcacgacggcaccggcacccccaccgatccggacaagtttgtgcacgacatggccgccgccatcgacaagatcatggctgaccccgaactcgccaagaagatgggccaggccggctacgaacgcgcccgcgacgtgttcagctgggagaccatcgccgacaagaccgtggaagtctaccagtccgtgctcgacgagcagaagaagtaagtagcgctgcaacgagtgctcccctcagtccggctgcgccggccagctcccctcaggtaccggtttcttggctctcctctctgaggggagctgttaccgcaggtgactgaggggagtcgtcagaccgcgaatcataggtagtatttcactcatgacaaacaccgtcctccaactcgacaacgtcgaattccggcgtaaccgtcgcgtcattatcaccgacgtgaacctcaccatcaacgcgggggagcgttgggtgctgttcggtccgaacggcatcggcaaatccaccgcggtcggcatgctggccacccgcaccttcccctcagagggccgcgtattcatcctcggccatcaactcggcaaatacgacgtattcaaactgcgcacccgcatcggtctcgcctctgccgacctgggccggcagttccccgagttcgaggacccgctggacgccgtggtcaccggcctgtccgccgtgaccgggcgctggcgcgacacctacacgcaagaggaatacgcccgcgcccgccagctgctgcgcgattttcgcgtctcctatctggaaggcaaggagatgtggcgactgtccgaaggcgaacgcacccgcgtattgatcgcccgtgcgctgatgggagatcctgagctgctcatcatggatgagccgaccaccggccttgacctgggcggccgcgagcaggtgatgcgcacattgagccgaatcggcgaagagaactccgagcgtgccgtggtgctggtcacccatcgcttggaggagattccggccggtttcgaccacatcgccattatgggacgcaagccgattcccgctgaggacgccaccgaagcgggcgtggactcaatgggtaatcccggtgctggcaccatcgtctacaccggttcgttggagaatggcctgaccgacgaacgcttgtcggaattgttcggtatgcccatcgaagtccagcacacccacggccgctgggccgcctacgccgtgtgatgcttgtaggtttttaggcgggattttcttcgccccctctggagaggggctgtcagcgtaagctgactgggggcaaccagttacgaaggcaaccatgacaaccaatagcaaactcgtattcatcgatatcgacggcaccctagccgacgaaaaccacgtcgtacccgaatctgccaaaatcgcttgcaaacaagcccaggccaacggccacaagctcttcatctgcaccgggcgttccgtgccgaaaatcgagcgcagcatcctcgacctcggtttcgatggcgtggtttccgtggcgggcgctcaggcgaatatcggagacaggctgctgttccagcatctcgtccctcctgaagcggtcgatgcggcgatggcgtattttgccaagcatcatatcgagagctaccaatggcaaggtgcggatggcatgtacatctcggaaggctaccgtcaacatctggaatcgaaaggcaagacctggaatcgtggcgaattcgcgcgattctggcacctgttggatgaggtggaggtgccggctggctcgactttgggacagacgattcgtgtgagcaaggggtcatacttcacctcgccgaatcctgacgtgactttcgaggagactcaacatgatttgagcccatggtttgagctcgtgcatggttcgtatgacaagatttccccgaacaatggcgagttgctgattaatggcatcgacaaaggtaccgctgtgcgcgacgtggcttctttgctgggctactccgttgccgacaccatcgccatcggagactccgacaacgacactgccatgctcaaggccgccggcacatccgtagccatgggcaacgccattcacggcatccaagccttctgtgacttcaccaccaccgacattcacgaggacggcctggccaacgccttcaagacgttgggactggtgtgaggctatgtcgtttgctctcagacggaggatcctttcgtgctgtagtattgcgacgcggcacaacgtatgctgcgccgagcatagagaattatgaattcaaaatggtttgttcatcatgcgaagatagtggtcatctgtccgtcgcggttgcgcaatttacggtggcggaggagccggaacggaatctggagatcatcgacggattcgcgcgtgatgctgcggtgggcgatagggaagccgatctcattactgctgagctgagtcgtgagtgtcttgattccgcgcgtcgaacattgccggtgttgcagaatcgccgttttgccgatccgcagttgtgtgactgacctctaaataactttactagcgctgttgataagggttctatgatgggaatcatgaccactactgttgatagctctgattcaatgccggaacgtctgcaagaggggagcgcggcgcccgatttcactctgccggcggttatacctgggtttacagagagcggatcaatcaacctgtctgacgtgcttgatgccggccgcagggttgtactgtacttctacccggccgcgatgacgcccggttgcaccaccgaggcttgcgatttccgtgacaatctcgcccgattggcgtcgaaaaacgttacggtgcttggcgtctccaaggactcgcttgacaagctgcgcaagtttgcacagcgtgatcatctcacgttcccgctgctgtctgatcccgacctgaccgtgcacaagctgtacggcgcatatggcgaaaagaagctctacggcaagatacacgtaggcgtgatccgttcgacgctcgtcatcaatcccgacggctccgtggttatcgctcgttacaacgtacgtgccaaaggccatgtcgattcgctattaaaggcactggaaaagttggagaagctggagaagtagtgcgttctcgttgttcggacacagtggttcgtgcggtatgcgccgtatgaaccactgccgtatgaaccgccggttgacttctcggactcaccggcaaatagtgagaccgtgggcgcgcagtacgtctatggctggcatgtaatcgagcgatgttgcggtgggattgagcatcagttcgcggatggcggcggatgctgaggactcgcttgtcttcgaggattctgcggccgggaacagagcgtcggcgattagggagatgatacgggaacgtgcatcgccggcattggcattgttgctgctgttgccggcgtcggcagtggcggatttgccaataattgtggagctgtttcgtagaatcgtattcaacgctgcggcaagcggctcgggattgttctttgtcgcttcgacaatgtcatcgagctgatcgaataaggcgaacagccatgcacggcgttgcccctcatcgttgccagccgcaagcctttcattggtgacgcgcacgagttcatcaatcggtactgctggcgtctttgccggatcgcgatgctcgcggttgtcttcgatatctcccatcagatgctggattttgcactcgtcctgcaatacggtggtctcggcaaatgcggtggcgatggcgtccgcatcgatgaacttgccaccctcggactggaagcgcacgcgcttaggctcgctgtaataatgcgacatgccgaatgtgatgtactgcggcatctcgtcctgcaattgcttgaccgcatccgccactttgcgcatgtccgcaagctgctgatgcaccacaataaaggcaagcactgctttggcgtcggcgagagtgagcggctgaccgatgctggctccatgatggtgctcatgatgcgcgaacatgttcttcagcgaatcaaacaatcccataatgtcctccttcgaactgggcgaattagctgcatctgccattcacactagtccggaatgtatgagaatcatcgtggaacgccgagagcgaattattgacgctgcacgcagcaacgtgagaactgaaccgacaccaagaacacggggcatacctgcagcatgtcgagcaatgcgatggcattgtttgttaagagctcgaaaatatcgcacaggacgtagaagtgcttgtccgaatcatgtatggcaagaaggctctacagtttgcttgtgaacgactccactggctaactggtagagaagtagcggtttggtatacgcaaacagtgcgatcggcgatgaagatgactgtgaggttgtcatgtgtattcctcagaacgatgagcaagagccatggacttggtgcgtaatagcaaatgtcgtagatgagcatgaggttggtgttgaccatcatattgagcatggaacgaagatattcagtcctggaacaaaagtgtatgtgtcgactgaatggaggacgagcctaaaggatgacggtggaacattgtttgtgattgggaaagcgcgtaagcaatggcgaatggtaggtatgttcattccacgtaatcgattgacgaactttcgagttggacgagtattcgatccacgtgtactgcggcgtatggctaaggattgcaggcaatcagtgccagatccgtctgaatggggttggcgctggtggggcaatgatgaggatgcccaccaaacagtcattaagagggttgaatacttcagtcaagatggattttcgttgccagaagctggggctgaagatgattagaatcaggtgagtaacacgatgctgaagaattctgatgcgtctagtctttcttcttgagggaccttccaccgccaacaccgcgaccaggacggcttgcattccaatcatctattgttcaggtagctaacctttagtagtgccatatatacgtcaggttccggcagcttatatactgatgcgttcttgacgccgaggcgctcgctaacttctttggtgctgagaaacctaagtgccatttgagttcctctcatcttcgtggagatttcagtacgtcggtatattgagcatacctgcatattagcgaggcaaatcctctagtgaattgagatcttgactcactgataggcggttagtgaagcgattctgcggttaagccgagcttttgcttcgctgagcagtctcagtgagacaaatcctcgggcggaccgaggcattgctctactaaaaggccacttagcgaggtttttcctctactaactctctgagttgcttcgctgacgacgattcagcggggggtggtgacgttttcttggactgtgatccgaggaggagacggccatggcgaagtacacgagggaacagcggcaacgcgcggtcgagttgtatgtgaaatacgagtgctgcgcggcggatgtgatccgcgagctggggtatcccagccgggaggcgttgcgcatgtggcaccgggactggctcgacgaacaggggacgggcgtgtcctcgcagcgtggtgaacggtatgcgcgctacacggaggagcagaagcgtgcggccgtggaccattatctgacgcatggtcggcgtgcgagccgcacgatgcgtcagatggggtatccgagcaaagaggtgcttgcctcgtggatcgacgagctcgcgccgggcgaacgccggattcgccgtggcccggttcccggggaattgaaacgggatgcggtcctgaaggtcgcgtccggcgaattgagttcgcgcgaggccgcggaggcggtgggtgtggattcgtcggtcgtgcgaaactggaagcgtcaactgctcggagacgcgaaaggactcatggtggcgaagagggaaccggaacgcggggattcctcgcagcaggacgatccggacgcgctgcgcggcgagatcgccacgttgcgcgccgacctcgagcgtctgcgcgccgaacagcgggccatggagatccggttggcgatcatgaagggtgcggcggaactggtgggaaaagagccgggcgcagacccggacaacctgacaagccgagagaagacgaccctgatcaaggacatcagtgagacgttgggcgtgaacgcggagagcctgctgaaggaggtcggcatcgcgcgcagcacgtactactaccagttgaaggccatgcgccggccggacaagaacgcgaacctcctgtccctggtgcgcgaggcgttcgggagcagcaggaggcgttacgggtacaagcgcatccacctcgagctcaaaagcgcgggcatcatcgtgtcggccaagcgcatcatgcgcctgatgaccagccacggcatggtccccgtgctcaagagcgcgaagcgctacagttcgtacaagggcgagatcggaggcgcgcccgcgaatctcgtgaaccgcgacttccacgccaccgcgccgaaccggctgtgggtcacggacatcaccgagttctcgatcccggcgggcaaggtgtacctgtcgccggtcatcgactgccacgacggcatgcccgtcgcctggacgatcggcacgagccccaacgccgccctggccaacggcatgcttcgcgacgcgtgcgccacgctcaagcccggcgagacgccgatcatccactcggattaagccgggtttgttgttaagccggggaacggttcggggtcttggtggctggccgtgtcccatgtggtttcccggcttaacgttccgggttatttgagggtgtgtagttgtcggagtcgttgctcgctgagccatgtctccttggaggggtcggggccggggttggccgcatcgacggctttgcgcatcatgtcgagggtcgcgaacgcgtagaacgcgctggttgtgctcatgctttcgtggccgagcagttgcatgatgagcggtagcggcacgccctgttggtagaggtccatggcgcgggtccggcggatcaggtggcagtggacgcgttcgggcatggacgggcacgtcccgcggcgtgctctggccgccgcggttttgaggatctcgtcgatccggtccacggagagcggctggatggcgccgttcctcgtcgagtggaacaacggcccgtcgccgtcgcgcatggacggtccgggatggaattcctcgaggtaggcggccaggtgggttcgtgtcctttctcccaggggcacgacccggctcttgccgcgtttgccggtgagcgtgaccctggccggcttatccatacccacgtccgcgatggtcagtgcggcgagttcgccgatcctggcggcggtgtcgtacatgaggatcaggagcatgcggttcctgcgcgatttggcgtcgccggtgccccatgcggtcagcaacgctttggtgtgctcctccccgaggtggtcgacgggtttgcgcgcgggtggtttgacacgtatgccggccgcgtcgttgcccagcgcggtcaatgccgggtgttcgaggcccgcgtggtcgaggaacacgcgcatcgtcgtcatcctcagcatgatggtgcggtccgagtacccgcgctcggtccgcatccattcgacccaccggcccaggcgcgcccggtcgaaatgcccgaaaccgatgtggctgcgctgcgtgccttccgtggtttcgagccatcggacgtaggattccaggccgatgcggtacgcctcgacggtcttcggcgagctgccccgcaccttgggcagccagtggtgcagccagtcgcgcgcgactcgccagaagtccggttcaccggagctggcggccgttttccttgccttgctcatggttcctccgtttccgggaccacgcgttcggcgtcggcgacgaggtccgcgtatccgtccatgaaatcgaggctggcgtgcacgtagtagagggtgctgtcgatgccggcgtgtcccatgtaggccgccagatagggcagcatcgccatcacgtccacgccgtcgcgagtccaccgctcgatgttcgcgaacgcgaaccggtgccggaaatcatagggcctgggccgtttgccggcttgtggccactcgagcccggcccgcgtccagacgcggcggaacaccacgccgggcatgcccggggagaccggattgccggtggaggtgacgaagaacgcgggacggtcgtctccgaagcgttcgcgggaccgttggtcgcattccagcagttcggcggcgacctcgtcgcccacgggcagcctgcggctgcgaccggccttggaatcgaccacgtcgatggaacgggccttgtggtcgacgtgcccgacggcgagtctcctgacctctcgggtgcgcagcccgcagcaggccatgagcatgaagaacgcgcgagactgccacgcccacggcgacggagactccaacgttcccgcggcccgcaggaacagggcggcctcgcggtccgtcagcaggtacggcgtcggacgcggggatccggccttccactggtcggagagcacgtacgcgtcgggatcgtgggccagtcgcatccacctgccgaagtccctgatgtacgagaaccacgagcggcaacccccgggattcgcgtcgatcctatgggcgatccatcgctccacgacgccccgctccagacgcacggccccgtgttcgaggcaatgccggtcgaacgagcgcaggacctggacgcgggtggcgccatgcctgcccatggacgccttgaaacggatgtactcctccaattcgccggcgagcgggccgacgaatccgtgttccgtgggtctcatgacgatccgccttccggcacgggcagcacgcacgcgagcattcccccgcggtgcgtggccatgtagacgcgtgtggaatcggggtcggcgtggccaagcaccgcgctgatcgtcggcaacggcgtggccgcctccagcatcctcgtcgccgcgttgcgccgcaacagcctggaaccgccccggcgtccgagcccggcgtgccgcatgacacggctgatcgcctcgtacaccgatgaatgaccccgaagcgcgacatggggcgccttgtaccgcacgaacacacggtcgtcgtcggtggcgggcctttcgtccaacagccaggacgccagcctcgcggccagcggtcccgtcatcggcacggtcaacggattgcccgtctttcgctgcaccagacctatgctcatggaatcccaatccacgtcggcgatcctcagaccgatcacatcgcatgccctcagcccgcacgtcagcgacagcagggtgatcgccgcgtccctcgacggcaccgaccgcgaggcgcacgcctccagcaagcggcggtgctcgtcgtcgggcaacgttcccgcgatcgcgtgggtcctgcgtatgccggccaggccgatcgcgtccgccaggtcatcccgcccgagccatctgaacaacgggcgcaggtccgacgcggcgtgccgcatcgacgactccgaccagcgtgaacgcagcccggccaggaaccccagcacatgcgagccatccgaaccgtccaacgacacgaccccatgagattccagccacgtgaggaacaagcccgccatccgacggtaatgccccaccgtcgccgaagccagtcccgaaccggcgagatacgcctcccaacgctccatgaccacggccaaacccggaaccaccggctccgcaagcctgctcctgcgccacttgcccaggtccaccgaaccggaccgcagatacgagtcgcacaaacgcgccagcctgccgtaatcgaaccaccgctgcctgctgaaaccgcccgtccgctcactgaaggtcgacgcggcgaaccccgcgcccaacccacgcgtgtacaccgcatccgggcctccggcgtaccgttccaacgccctgatggacttgcggtactggcctatggtggattccatataaccggccccgtaaagcgcgcggaccacctcgcccgcgacatggccaaccgtcgtctcacccatggcaaactccttcgttcgaatcaaatgggacaagacgaacataacccggaacgttaagccgggaaaccacatgggacacggccagccaccaagaccccgaaccgttccccggcttaacaacaaacccggcttaatcggagttaaaccgacatcggtttaacagtgacaggggttgccattaccggtggccggaatggatccgcatctgcaccgagcacgggctgacccggtcgatgagcgcgaagggctgttcgccggacaatgcggccgcggaggggttcttcggccgtctcaagcaggagttcttccacaagaggagcttccggggcgtgacgatcgacgagttcaccgcgatgctcgacgagtacatggtctggtaccgcgacaagcgcatcaagaccgaatacggcatgagcatcatggacaaacgcatccagctcgggctcgtcgcctgaaaccatccggtacactgaccaacgaccatacagacaacgaagtccaacaaaacgtcaccacccccgggtattcccttgacctatccgtgttttcgctctgcaaagtagttctgagcggcggatcgatactcacacagatgtgtacggtgtgctgtcagcgtctttgtagtttcgccggtcagttgcctggtaatccaggataaatcagtcatggttcctcacttccatgtgaggcagtacacttgggtactgcctctattgagtgcattgataaaggtcagccccgcaagcgctaccaacatttgcggggcatttaagttttgatacaaccgagaggaaaccggggctgaaaccccggcgcgatagcgtgttatccgacgttcagcgtcagcacttccacgccatcaatcaggacaatcaccctagggtaatcgtctatgattagcagagtatggtattcgccgcagcaatcgcagcgccatacggtgccgagaccatatatcatggttaatatcctctcggttgtaggatgacccgcacgtttgtgtgggccaagttccgcaagggaacacgtaagccgcaagcgttcacagcacttgcggctttcgctttatgtcccgaacggaacaaccgaggggtcaaacgacccagtgcctagactatggggtgaacccagtgagtttaggccgactgcatacgatgcctacagtcgggcgaagagttgaattgattagggcacacacctagctttcgctagtgttttctttcggcctctcagcctctaacagtttgcgagggttactgaccttgagcgcgtcacataacttgatagccatgccaagactcatattttcgataggtcttgaaccagtctcagtcgcggcgattcgcgtgtgcggcacacctgacttgtcagctagttgacgctgggttaacccgcgcttctgccttaactccctaagactcattacccacctcgcttatgctcagtgggcccgattatacctatcgttgaaacatctgtagagtgaggggcataaatcgaaaggcgtcaatgatgaacggaacattcgagcagttaagagcagccgtgtatggccaagcagtcggtgatgccttgggcgtaccttatgaattcatgccgagagataccttccgatgcgaaggtatgacgggatacggtacgcataaccagccgattggcacatggtcggacgataccagcatgatgctcgccacattggactcgctgatcgccaatgaatggcaagtcaatactgaagatatgcgagagcgatatctggcatggctgagtaatggcgaatacgcgattgacggacgagtctttgattgcgggcgaacggtctccatcgcgttgcagcagcgtgtgggcttaagcggtgaacgagacaatggcaacggctcactgatgcggatcatgccgttggcgttcgcggatgcttccgcggatgacgtacgtgccgcatctgcaatcacgcacgcccatgcaatctcgatggatgcctgttcgagcatggtggatgtgttgcgcgacggactcatcaaaggcatatggccgcaagagctggatgatgaaccgctacgcggtatgccgcgtgatgaagttggttcgagcggcttcgtcaaagacacgtatgaggcggcgctctggtgcctcgcgaataccgatgattatgcgagttgtgtgctcgccgccgtcaacttgggtgacgatacagacacgaccgccgccgtcgccggatacctggccggcatcaaatatggattcgatgccattcccgctcagtggctggcggtattgcgcggacgtgagtttattgaggatgtgcttggacggacggagtcggcgtggcattaaggcgctcgcggcgagtagcaacctactgtttctgtatgcgatgaagatggccagtacgccaccatcaacagtgaggactccctgcctactgttctccacgatcacgcccaagcactggacactcccatgtctcgttccgctgaacattgccgagaactcccttcttctggatgcgcatcatcgaatcccacttgctcgacgcccagactgctttggacggggatacgccgctagtgggggacagagattgagacgcatccgggttcgaatagtgtgagggatttggctttgccaacggttgttggacacattccatacggtggtgcctgtgttgttcgcaaaagtatgtctatctaatcgttaatcgaggatgacgatatggtgagtttttctgccgctataatgtaggattattaacaggttacggctgaagaactgattacagtattagaacatttttttctgatatatgtggttggcgtagatgtggcatatacgaggggcatcctatggcggatgatgaaactcatatcggtcgaaataacgaggaacgcaaggaagacgaaaaccgtcgcattatgggaaaggcgctggaaggtgctgcggcggaaaccgtgcaacgctttggttctgccgtcaaggaacatttagcggcctatgcgggtgatagagagaatgctgccgatggtaattccaaactgtctaagaccttgaagtccattgctgaaacgccgacaagtaatgaattcaaaaagcagaacatagctcagcaagcgggttttagtgccgaggttgagtcggtagccaggaagaacgccgataacattattgctggcaacgatacgcgattcaaacgatatgatgacgtgaagcattcagatggacggcagacatcgaacgaccccatcgtggatattgtcgaagtggatggattgggcaaaacgatcatcggctccgaggctcaaatgaagttcgtcggcagtagcccgaaagagctgcttaatgcgttgaaaagcaaggaatatgcgaaatatcgtaatgaaggcgtcatcatgaatattccggatgattattacgatgtactgatgggtgatgggcctgacggcatcaacggacagatacgaaaacttcagggcgagctggatggagatcggcttgccggcaagaattctccagagtctattcagcagcaaatcgatgatctgaaacagattaagaaaagcctgcggaaaagtggacttaccaagcgagaagcgttgtatgcgcgagaacatcccagacgcatggtggcgaaagatgtagccaaagttgccaataaagccggtctgcagcaggcaaggaatggtgcgctgattggtggtggtgtttctctgattcgaaatatggttgccatgcattaatggctctattgagccagcggaggcagcgagaaacgtcggcgtcgatgcaggcttggctgcggcgttcggctatgtcaccgctttttccggcgctgccattaagggtgccatgcaaaacgcgtcgagcgagtatctgcgtagtctatcgagaacgaacgttgcagctacgatggtctccactgtaacggatgtttccaaggtggttgcactgtattgccgcggcgagattactggagctgtttgtatagagcgcctcggccagcagggaatggggcagctcggaggagtgatgggcgttgccgtggcgatggccgcaatacctgcagatggtgcttttatggctgcgatggttggtatggctggaagcaccttgggatatgctgcagctgttgccatatatgaggaattatccactgctctgcatgactatgagctggcgaaagaggagcgtattcgtgtggaacgcgaatgtgcggaagcggtggagctcatccgccaatataggcgtgatatgtctagggatgtcgagaattatctggcgactcatgatgaattgtttaatagagcattcgatgcaatggatcaagcgttgatttccaatgatattgatggatatttggccggaaacgccgagattcaagaatccttgggatacttgccaaggtttcggactcagcaggagtttgatgatttgatggcgtcagacgacaatttcgttttataaggaggagccagttaatgaagtacatcaaaacacgtgatgcattacaagcattttattatctgattgctgtcgatggatcagtccgtgacgacgaacgcgcactattcgatcatataggtgacaatttggatgcaaagcacttccatgattatcgcaaagagattatcgattcgtgcgatgagcgtataaaccagtgccacgattccgatgatcgctacgacgtaattgttgagggtgttgatgcagtcttgtcgcatcgaacggataaaagagctgcaggaattgcaccaaggctgcttctgtggaatatgttgtcagttgccttcgccgatggggaatatgatgcagtagaaagcagactcatcagacatattgcccggacgatgattgccgatcgttccatataccccgaaatggaacatcttatgcgcgcggcgtatgacgtgcgaggcgagctcgactggatcagcaattccgaactgccatatagtgaagttcgccccatggtggatcagctggaagagcgcgtgaatgttctccaaaacgctgccgtgttgctgattgaagacgagacagccgcgccagccccggaagtcatggttccagagaaggacgtgtttgatcagaccaaggatgccgttgactcggtggtcgctccggttgtggatcaggttcagcagggtgctcagggagccgcggatgcggtgaagcatacgtttgacaataatgttgctcctgttctcaaccaagttggcgatgcgctgaagccggtgaatgatgcagtgctgaaaccggtaggcaacgcagccaatgaggttgcgaaacgtgcgggtgacgcagccaatgaggctgcaaaacgtgcgggcgatgcggccaatgaggctgcaaaacgtgcgggcgatgcggccaatgctgtacaaggcttcttcggtggcctctttggacgcaaataagagaaacccaggaaggaattcactatgccattttttgttgttccactattcatcggaatggccgctgctgccggtaccgcaggcgtgggtatggctgccaaaggtagtcttgatcagcacacggcgaatcagcttaacgacaattccggagcacgcattcgatgggcagctaataacctcgaaaagcttcgtgggcaatgttcggattccctgaatgccttgggcaaagagaaagtcatcattttggatgggagcgttcagcgcttccttgatgcttttcaacagttgaaaaatgttgatttcaccgcgtccgaagggcttgatgaactcaataaactgcgcatagacaaagcggcttttgatgaacttaaaaccatgggaaacatagcttcgtctttgctggaaggcggtgtggccggggcagccagcggtgcattggctgcgtttggcgcatatagtgccgcgtcggcacttgccacggcttccacaggaactgcgatcagtgcattaagtggtgtggctgcttccaacgccacgttggcgttcttcgggggagggtccttggctgcaggtggcttgggcatggccggtggcgccgctgtacttggaggtttagtcgcaggtcctgcattgctggtcatgggcgttatcatcggtgccaagggtggcaaaaaccttgaggaagcgaagacccagtctgctgaggcaagcaaatattgtgagcagatgatggccggtgcggaccagtgcgttgccattcgtcggcgtagttatatgttccacgctttgcttgcccgtcttgatgctaaattcctgccttcaattcttgaaatggaaaatatcataaagaccgagggaacggattattcgcaattccgtcaggaaagtaagaagactattgccgcagctgcgtccactgcagcatcaatcaaggccgtgctagatactcctctgctggccgaggatgggtcacttactttggagtcggagaagctgatgaagaacagtggcatttgatgggatgaggattccggagctggactgatggttctgtgtcttcttccgttgattttgggatatggcgagaatccgttgcccgagatgacgagtcttgcggaagctcatggcattcgactatttagtctgccgactgtcggacgagaagtggatgctttcagttttatgttcgatggtgtgccgtatatcgcggtagataccagcaagaccgcagaacgtgtccgttttgatatcgcacatggaatgggcatctgatgatgcgtgaaatggtatccgaggatgtagctgccgcagtaacgcgcgatatcgaaggtgaagctcattcgttcgccgcgaatcttttgatgccgaagcgccgtgttctgggcatggtgccgactcacgcttcagtgtcgcagattttggctgcgaaacattatttcaaggtttccgcaatggctatggctcgccgggcctatgagctgggccgattgtctgaatgggaatatcggcaggtttgctcagaactgacggttcaaggatacaagagtggcgagccacgtgatctgcgcccagaacagtcgaaggtattccgattcgtggctgataccaataggcagaagggcatatcggtttctacggtgagtgaggagaccgggcttgtgcccaaagaattgcatggattgtcgtttggaaatatttgggcggttacgggtgggagtagcctgagtcagagagccatcttgggtcgaaatgaatctgtttgagctgacatcgcaatctgggttgtgcaatgactgagtaaccccttgttcttttgagaggtcgcttcgctggtttccgttggtttcgttaatcgcatttttcgttgcaatgacgccgttctggtgacgttcgcgagattcgttgattgctgctgatttcgctgttctctgcggtcattgtgtcccggttgtgtccacagcggcgcgggtgttccccagtcaaatgaactggaatgactgaggaacagcgttggacaccaatcaacttgtccgattctctcctatgaactcttggagctgagcatgttggtttacttaccatccctatggtcactttcgtcgagcgggattagagtaatgtgcgagaaatctattacatcgccgaagaatacttgtgattcgtatttccggaccttggcagtggctgtgacaattttcttagccaccacgccattgactccatccatcggcagcaacctgtattctccggttttctcggaaatcgttttgcatccagagacgtttgcgtaccactgatagtatccaaggaagactttccgccttcccacataggcattcaaacggctgactccatgaatgcaagaagggaaactcaccttgcgtatcgacatgcctggattaagagtgaaggatagtccgtcccacttgtggaagatataagcattcttatgttccagtagagccagagcgataatgtcgttctggatgtcgaagtctctgatttctttgaactccgggaacaagatctctgacgaggaacgccgctgaagatcactgtacagctgggcaatttcttgcagctgcgcaaaatcaggaagattattagtcggcaagttgtcaatagacaggaaggcttcaccgtcaggcgagtgaaggttgaactccgatccctgcgagagctcctgacaaacggttatggcgtctttgaccttatcaaccggcttgcccactatatttttgatggtgaaattcatcttgaccgtcgtggtcgcatcaccatcaaaaataagttggacccgaaggcactcgctttcatcctcaccagtccattgagcaccgccttcaatcccgtgagtgcgctcaacctgtttaagcgacacggaagcagaaggcgaggccaagataagctctaaatcattcccttcattctgcgggagaatgaacgcccggcaggactgtatctgcgcatcgggcagcgtgtccttcagaaacgggatattgccagtatccgcaagacgaacagggaaatcagcaagtgaggtgccatattttttgaacgactcaagctgctcacgttgctcttggttctgtggcacaaactgcacggggaaggttatcttcgcgaatgacgtcgcttccttgtacttggcgatcacatcaacggtgattgacgacccgtccggcctcttttccaaaaaagagaaaacgaggttcggtctcgtaatgaaatatgaatgctcgtcgaacttactggcgatgttcacggtataggcatagttgggatcacgattttccagcatgtcacaaatcgagtgaagtttcgacagcagcgctttatcatcatgcagatcgtccacacgagcggcttcgataaatgtatggaccaatcgctccacttcgcgtataccgttaccgaggaaatagtcatagacctcgggcatatcggtagcccaagcttggatgttgggtagcccgacccaatcacaattatatggcagttccttcgttatttccttgaaccatttcagattctgcggagttggatccaagggcaagaccagataccagttcgccaccttatagccggtttcccggatatagtcgttcagcgacttcagcgacttcttaatctgactcttctggctggttttaagagtatgggcaaacttcttcacctgataaacgtcataggtgccatcaccgttcttcacctgaagatctatcccattgtcaccggatgaagggcgaacacggtttgcctcaggacgctgcttgcaaataaatacggcaagcagcgtctccatatcctcgccggacagattcccccatggaataggatcaaccacgaaaacctcgcttcttgccaagtcggcaactacccattatcatcagctctagcttggttgattcgtctttggcgcgccgcttgtgccgcaagtaacccgctttgtcacgtatctaacgagccggaacccttagaacatatgttctaacatgtggccttgacgcaagcctacggcggcggcaatcgctgacttcggacggttgatgacaaacagacgtacctcgacttggctaaacactagtattagctgagtccagactctagacggattggagattcgcaagtgagcaagagcccggtagctcatcccaccaagtatgacccccggcccacgccccgttgccggagactgaccgagccggatcgtgagtcggctcatgctcccgccagcgagggcgtgaaccgacgaaccattcctctaggcgaatggtcgggacagcatagccgaagtacgctgtcccagctgactccatccctcactcgtagctgatgaccagacggccgaccacgtcgccgcgctccagtcgttcgatcgcctccggcacctcgtcgaacgagacggtcgtggtgaccggcgtgagcttgccggtgcgcatcagctcgtagacgcctcggatgtcgtcgggcgtgccgccgttggatccgcgcagatcgcactggttgacgatgagcgacttggcatcgatggtggtttccaaccggcccatgccgacgagcaccaccacgccgcccagcctgatcacgtccaccgcgtcggcggtggtgtcgccgaatccggcgaagtcgacgatcacatcgaagaatcccttcggatagtccgtgatggactggcgcgcgtccaccgcgcccagttccttggccagcggccagatatcctccttgatctccgccacatgcacctcggcgcccagcagatgggccacgcgggcgccgatctggcccaacccgcccaatccgatgatgccgaccctgtcgccggccttcacgccgccacggcgcaccacggccgcgtacgaggtcatgcccgcatcggtggccgcggcgccgttgacgaaatccacctcgtcgggaatgcgcaccagcgcctgcgtgcccaccacgatcttcgggccgaatccgccgtcgaaggaggacccggggcagccggccggcgtggtcgggcatatcgccacgcggtcgcccacctgaaaatcgtccacgccctcgccgacttggctgatcacgccggcatcctcgtggccgagcgtgaccggcacctgcgccagcatcgtcatccagcccggatcggtgagaatgcccacatcggtgtggcagatgccggccgccttcacgtcgacgacgacctgccccggtccggcggtcggctcgggcagctcggcgagctgcaatggttcattggtgccggtgaatctccatgacttcatcatgactccttaacttcaaggcgcatcgtcgcgccattcggccgagcccctcgtcccgggcacggactgcgccgttgggaatacggcgacaccctctatcgtagggcagccgggcgaacgacccacgcggcccgttgtctacttagaagtgcaacatcctttttaaagggtgttgcacttctaagtagacaacgggatgtttgggtcgcactatctgcccaaaagcatgatgtgttcagctccgctcacgaatgaaatcgaagatcacgtcgaagacctgctggctccagaaatcgtactcatgttcggcgccgtcgactagcaccagctgcgcgtccacgccgtgctcgaccagttggtcgcgcatcttgacggattgatgataggggaccacggtgtcggcggtaccgtgcaacaggagcatcggcggatactgctggtcatcccgcacctgcaggtagggactcatatcagccgcacgctgacggacctcggcattgatgccggtctcatgggtcgcacccaccacggccgcgaacgggccgaaataatacagccggaatggattggtctcatcgtcgaatgcgtcgacagcttcaagcatgtcagtgggcgggaagcagctgaccacgtacttcaccgcatcgctttcatcggcattggtgccatcctcatacctcggatcgtcggcggtcaaccccaccagcagcgacgtgttgccgccggacgacgtgccccagataccgagacggtcggggtccacgtgccattgacgtgcgtttgccctgagatagcggatggctgctttgacgtcctcgagatatgcggggaacatgtcgtgggggtcgctcgaggcatcgcgatgattcaccgtagccaccacaaagccttcgcgggccaaagccgagagctgcgggatctcgtagtcgcgatgcggcgtggtccaggcgctgccttgcacgaataccacggtggggtagcggcggtcatcgtcatcgccggtggattgtggtgagatgatatccatcaccaggttatcggccccggtcttgtacgccacgttgcgggtcagcgtggccaatccggcaagcgtgggattgtgcgggatatggatgacattgtttgcgccggcgttggcatcactgactttggatgaatcggtagtgttcatggaatccccctagctctgttgctatagaggtcatcatacaagaaataggcatgatcacggcacaacgatgtctcgatcacagcgaagacatgaagacgcgaagacgcgcccggcagcgcgcgctgcctgcctgcgagttgccttcaagtgcacttcaagcgataaggtgacataagccgcggcaatggagattgctgcccggcaacgaggcggacagtgcccgttcgccgattcacgataacagaaatgagacactatgaagactcaggaaatcggacaatccggcatgattgcgtcacgagtggcgctgggtgtgatgcgcatggacgcgctggatgccgccgatgcggcacgtaccgtggccgtggcccatgattctggcatcgactatttcgacacggcggacatctatggattccatgatcatgccgcgcacgccagttcgaagcgtttcggccaagcgtggaaggacgcaggactcgaccgcagcaccatcttcatccaaaccaagttcggcatcgactacagtttcggcgaaaacgatggcggcgccaacggatatgacttcagcgccaagcatctgattgacgcactcgatcacgagcttgaggctttgcagacggattacgtcgacgccgtgctgctgcaccgtattgacacgctgtttgagttgaacgaggtcgccgaagcattcgacgcgttggaatcaagcggtaaagtgcgtcatttcggagtcagcaatatgggcccgtggcagatcgaactattgcaaagcggccttcgtcagaaattggaaatcaaccaactgcagttcggcctgatgcatacacagatgctcgacgctgaaatccaattcaatatggcgagcgatcccgcagccgatcgcaccggcggcatcctgccttattcacggctgaagcatatgaccattcaggcatggtgcccattccaatccggcacggaatacggtccgttcgtcggcaacgagcatttccccgagctgaacgccgaattgacccgtcttgccggcaaatacggttccacgcccaacggcattgccgtcgcttggattctgcgtcatcccgccggtatccagccgttgctcggctcaatgacaccggagcgcatccgccagatggcggccggtgccgatatcgaactcgaacgccgtgactggtggtcgctgtatcaggcagccggcaatccgttgatgtgattgcggaaccactcgacaacccgtgtttcactcaccggcatcatatggcacgtaggaaatcccggatatcggcgatttcctcatcacagatggcatgggccatgccggaatactcgcgataggtcagatgtccggcccgttcaaggacctgatgggccgtttgctggtcgggcagcggaatcgtgcggtcctgcgcgccatacgccaggaagaatcgggtaggggagtcaagcgccgcctgttcctcgcccatgaacgaaggactgagcaggatcgcggcatcgaacaacgtcggatgcaccttgaccagacgatacgacagataaccgccttgggagaaaccgatcaatatcttcctgcgatgggcgaatgccgaggcatccagcagtgaagccaccgcatccccgaccgccgcgcattcgcgttggcgctcgtccacgccgcagccgtcgggataccagtaattgccgcccatatagggcctcgcgtaggtggcgcggaacgagatatagctgggtacggcggcaattgcggccggggccgcatcggctcgcgtcggcgcatatacggcgtcgagaatccgcatcatctcgctttcgtcgttgccgtaaccgtggaacatcaggaaaatggggtcattgccgccggcatcgatctggcttgtcatctgcattcgcatcgtcatcacctcaccagcgagcttacatgcattagacttgtagcgattgacccaccgagcacgcaaggagcaagttatggagccgaggcgcgggcctctcaccgcaggcgagaaagtgcagttcaccgaccgcaagggcaagaagatcaccgatcagcttgtggccggcggctccacgcagaccgagcatggcctgattctgcatgacgatgtgattggcaagaccgaaggcaccgtaatcctcaccgtgcatgccaagcgcgaggcacaggtcaatcaggtctaccccgagaaagacaagaacaagccgtggaaatcgtcgcgcgccatcggcggctgggagtatgcggtgatgcgcccgcgactggccgattatgtgctttcgatgccgcgcggcgcgcagatcatgtatccgaaggacatcgcccaagttattcagctcggcgacatccgctccggcatgcgcgtgcttgagtccggtgccggctcgggcgcgatgagcgtgaacctgctggacgccgtgggcgagcgcggccacctgaccacgatcgagctgcgccccgaattcgccaaggtcgcccaagccaatgccacgctgtactatggcgaggcccccagctggtgggatctcaaaaccggcgacttcgattccgttgccgccgaactgcccgaacactggttcgaccgcatcatgctcgacatgctcgacccgtggaacaggctcgagcaggcataccgcgtgattgcccccggcggcgtgttggtcagttacgtaactaccaccacgcagatgagccgcatggccgaagccctgcgcgcggccggctgctggaccgagccgcagatccaggaatcgttcgaacgcacatggaaggcccagggcctcgccgtacgccccgaccaccagatgatcggtcataccggtttccttgttatctcgcgcgccatggcctccgggttcgaggcgctcagaaagcgcgatcgcgtgaccaaggacacacagaccgacatcgactcgctcaccgacgaacagcgtgaagcgcagatcgaggaactggaactgcgcgacatctccgaccacaaactacgtaaggtgttgcgcgacctcgaccgtcaggtgggagaacttggcaatacgcacgaataaccgccaaacgatgagtttgtgaacgctcacacacctctatactggaagcaataccacaccgccacaccgccacaccgggcagacggttcgtgaagggagccacggatgggcatcaagctgagtaaagtcgccaaagcggcgaagaaatacgaccatattctcatcatcatgaggcatgccaaggctgagccgttcggcgacaagggtgactcggagcgcgagctcaccgacaaaggtctgaaacaggcgaaggccgtgggcaagggcatcgagtcgttgggactggtgcccgaccaaatctcctgctcgtccgttacccgcacgcgccagacgttggaccgcatgctcaagacctttggcgacaagccaatcgtcgactaccgcatcagcctgtatgacgggggagtgcaggcggtgttcgacgagctcgcccacgtcaaggccaagaatcgcgtgttcatgatcgtgggccacgagccgactgtgtcgatcagcgcccaatggctcgcctccgccgactccgacggcgaacgactcgacctgctgaatttgggactttcgcccgcatccatcgtgatcatgggatcgaacaaaccgttcgacgaatggcaggtgcacagcggcgaactgctcgcggtcatcaatgtgaaagacttcgactaaagcggatataaattccatctataacgacactctgcggccatttataagggccggaatccggatgttttgctaccctaagtcgggttacgaacgcatacattggaggattcatgtccactctgacttccgtctccggcttcccccgcatcgggcagaaccgcgaactgaagaagatcatcgaaggctactggaagggtgccaacgacctcgccgccgtcaaggccaccgccgccgaactgcgcgccaagcactggaagctgcagcaggccgccggcatcgacctcattcccagcaacgacttcagctactacgatcagatgctggacaccgccatccttctcaacgtgattccgcagcgttacgcacgtctctccttcgacaaccaggaggacacgctcttcgccatggcccgcggctaccagggcgacaagggcgacgtgaccgccctgccgatgaagaagtggttcaccaccaactaccactatctggtgcccgaagtcgagtcggccgcggagatcaagctcaactccaccaagccgttcgacgagttcaacgaggccaaggcgctgggcatcgacaccaagcccgtgttcatcggcccgtacacgttcctgaagctcgcccgtaccccggaagccaccgaactcgagctcgacaagggcctggtcaacgccgtggccgccgtctacgtcgaagtgctcgccaagttcaacgagctcggcgccgcatgggtccagctcgacgagccgtacctcgtgctcgacaaggagccgggcgacgttgaactcttcaagaccctgtacaccaagatcctgtccgccaagggcaatgtcaaggtgctgctcaacacctacttcggccacatcgccgacgtgtacgagaccgtcaacctgctcggcttcgacggcatcggcttggacctcaacgaaggtcgcgaggagaacctcgaagccgtcgccaagtatggcgtggcctccaacaccaccatcttcgccggcgtgatcaacggccgcaacatctggcgcaacaactacgccacctccctcggcctggtcgacgccctgaagcaggtcaccgccaacgtggccgtctccaccgcatcctccctgctgcacgtgccgttcagcaccgaaggcgagaccggcatcccggccgaagacctcaagcacttcgcgttcgccgtccagaagctcgacgagctcaaggaagtcgccgccctggccgacgccaccgaggacgagaagaaggcatccgccgccctcgccgccaaccaggctctgttcgacggcacccgcgtggccgccgacccggccgtcgccgagcgcatcggcaagctgtccgacgccgactacgtgcgtcagcctgcccgcgaggagcgtcaggccctgcagcgcgaggccctcggcctgccgctgctgccgaccaccaccatcggctccttcccccagaccaaggagattcgcgccgagcgtgccaagctgcgcaagggcgaggtcaccaaggaagcctacgacgagttcatcaaagcccagatcgacgccgtcatcaagaagcaggaggagatcggcctcgacgtgctggtccacggcgagttcgagcgtaacgacatggtcgaatatttcggccagaacctcaacggcttcctgttcaccaagaacgcttgggtccagtcctacggcacccgttgcgtcaagcccccgatcgtctggggcgacgtttcccgcgccaacccgattaccgtggaatggtccgcgtacgcccagtccaagaccgaccatgtgatgaagggcatgctcaccggcccggtgaccatcctcaactggtcctggccgcgcgaggacatcacccacgaggagcagaccaagcagctcgccctcgccatccgcgacgaagtgctcgatctcgaggccgccggtatcaaggtcatccagatcgatgaggccgccctgcgtgagaagctgccgctgcgcaagtccgactggcacgtcaagtacctcgactgggccgttccggccttccgtctggtgcactccgccgtcaagccgaccacccagattcacacccacatgtgctactccgagttcaacgacatcatccgcgacatcgacgcgatggatgccgacgtgatctccttcgaagcctcccgtggcgatctggtggtgctcgacgccattcatgacgcgcacttcgagaccgaggccggcccgggcgtctacgacattcactccccgcgtattccttccgagaaggagatcgaggatcgtatctacgagatccttgacaagatggacgtcaagaaggtgtggatcaaccctgactgcggtctgaagacccgtggtaacgccgagacctggccgagcctggagaacctggtcgccgccgccaaggccgtgcgcgccaagctcgacaagtagcggaaatcaccgagctccctctggatgagggagctcgggtttatgtaaggaaatcagcatgcattccccgatgttcacccttgaggtctttcccccgaagcgcaacgcgcctgttggcaccatctacgacaccctcgacggactcgaagggctgaaccccgacttcatctccgtgacctacggtcacggcacccattccgaccgcaccgccaccgcgcgcatcgcccacacgatcagcaaggaatacggcatccccgcagtcgcccacctgaccgcgctctactccgacaaggccaagatcgatgaggctctcgacatgttcgaggaagccggcgtgagcgctgtgctcgcgctgcgcggcgactacatcgacggcgagcagctggtcggcgagttcaaccacgccagcgacctcgtgtcatacatccgctccgtgaagccggacttcaaggtgtttggtgcttgctacccggaaggccactatcaggctgactcgctggaccaggacatcgaaaacctcaaaatcaaggtcgatgccggcgtcactcacctgatttcccagctcttctacgacaatgaggacttctaccgcttcctcgacaaggcgcgcgccgccggcatcaccgtgccgatcgaggcgggcatcatgccggtgcgtggcgccaagtccgtgcatcgcatggccgagcgcaacgcctcgcgcatcccggacaagctcaacaccctgctgaacaagtggggggacgacatccagtccctgcgtgccgccggcatcctctacgcttccgagcagatcgccgacctcgtggcccacgacgtggacggcgtccacctgtattcgatgaaccaccccgccaccacgcgccgtatctggcgcaatgcggaaccgttgttccgcggtacgcaaggttgacgcatatcgcggcgcggcgcatctcaatgcgtcgcgccgcacgttaatctgctggcgaaacccagagttcccccagcggccgatgggtatcatgaacgtgcaatccaaccaaagcgatggaagggagtccgttatgtgcactggtgtccgtttctccgatgatgagggcaacacctatttcggccgtaatctcgactggagtttctcatatggggagaccatcctggtcactccgcgcggctaccactatgacacggtgttcggtgcgggcggcaaggcgaagccgaacgcggtgatcggcgtgggtgtggtcatggccgataggccgatgtatttcgactgcgccaatgaacatggtctggccatcgccggcttgaatttccccggctacgcctcgttcgtccacgaaccggtcgaaggcacggaaaacgtcgccacgttcgaatttccgctgtgggtggcgcgtaatttcgactccgtcgacgaggtcgaggaggcgctcaggaacgtgacgctcgtctcccagatcgtgccgggacagcaggagtctctgctgcactggttcatcggcgacggcaagcgcagcatcgtcgtcgagcagatggccgatggcatgcacgtgcatcatgatgacgtcgatgtgctgaccaatcagccgacgttcgacttccatatggaaaacctgcgcaactacatgtgcgtcagcaacgagatggccgaaccgacttcatggggcaaggcctccttgaccgcctggggtgcgggtgtgggcatgcatggcatcccgggcgacgtgagttccccgtcgcgcttcgttcgtgtggcctacaccaacgcgcattacccgcagcagaacgatgaagccgccaatgtgtcgcgcctgttccacaccctcggctccgtgcagatggtggacggcatggcgaagatgggcgacggccagttcgaacgcacgctgttcaccagcggatattcgtccaagaccaacacctattacatgaacacctatgatgaccccgccatccgttcctacgccatggccgattacgatatggattcctcggagctcatcagcgtcgcccgatgactccttcccggctcatgccccattcggagggcatgagcgtatatagtggaatcttatggaatcgtcgatcttcaaacccagctccatggacctcatcagggcaggtctgcaagacctcgacaaggcccgcgccttgttcgaccagctcaaggcggacgacattcccgatgagcgatgcgccgaactgctgagcgcgctggcccacgcctgcgaccccgatatggcattgagcaatttcgtggatatcgtcaacgcgatgcaatccagccagcgcgatctggaacacgtcatccccgacaacgacgccctgaagcgtctggtcacggtgctcggcgtctccgacgcgatgggcaagttcatgcgcttcaagccgcagcttgtggaggcggcagcagtcgacaactgcaacagccatctgttcaatcacgcgcaacgccgtgcacgtctgctcaaggcggtcggcgcggacccggacgaaccggccatgcccgtcgcctccaaggatctggccgaagcggccacggccctgcgttccagctaccggaaccaactggccgccatcatcgcccaggatgccgtggcggacgacccgacctccatccaaccgaccatcagccgcgaactgtccgacctcgcggacgcggcgctcgaaggcgcgctggccatcgcccgccacgaaaccgagggcagcgagcacgtgcgcttcaccatcatcggcatgggcaaactcggcgcacaggaactgaactacgtctccgacgtggacctcatctacgtggtcgaaccggccgacaaggatgtggaccatcagacgctgattcgcgtgggcaccaagatgggcaccatgttacagcgcgtctgccagtccgccatcatgggcgtggccgagcagccgctgtggcagatcgacggcggcctgcgcccggaaggcaaggacggcgcgctggtgcgcgtgctctcctcgcacaagaactattacgagcagtgggccgagaattgggagttccaagcgctgctcaaggcccgcccggtggccggcgaccccgacctcggtcaggcctacatggacatgacccggccgttcgtgtggagcgcatccaagcgcaagaacttcgtctacgactgccagaaaatgcgcaagcgcgtggaggatttgattcccgcgcccctgaaggaccgcgagattaagctcggccgcggcggtctgcgcgatgtggaattcaccgtgcagatgctccagctcgtacacggccgcaccgacgaatcgctgcgcaccagcaacacgctcgactcgctgcagcgcctgtccgaaggcggctatgtctcgcgcaagcaggccgtgcgcatgtcccaggactaccgcttcgagcgcgtgatggaacatcgccagcagatctggtccctgaagcgcacgcacctgttcccggacctcggccgggcctcggtcggaggcctcgaaaagaagcgcgacatcgacgtggacgagctcaaccagaaccaggagctgcgccgactcgcccgcgcattcggcctgcacccggaagaactcgtcgacaagtacgacgacacccgccgcgaagtacgccacctgcacctcgacatctactatcgcccgatgctgccggtcaacgcccagatggagaacgaccagatcgtcctgagcgtcgaggcagcacaggaacgattcgaatccatcggtttcggcgacccggacgccgccatccgccacgtgcaggcgctcaccgccggcgtggggcgcgcggccaaaatcaaccgcatcattctgcccgccgtcttgcagtggctgggcgagggccagaacccggacatgggcctgctcaactggcgcaaactggaggagaacttcggcaccgaatccggctacctcggcttcctgcgcgactccacctccgccgcccagcgcctgtgccacatcctgtccaactcacgattcctgggcgacgcgctcaacaagtcggtcgaatcgatcagctggcttggcgacgacgacaatctgcaggcccgcacgcgcgaggccttggacgtgcagaccggctcggcgctggaacgtttcggctcgaacatcaacgagttcgccacctccatgcgcgccatgcgccgccacgaaatcgaacgcatcggcctgtcttggatgagcggtgtgatcagcgactccgacagtctcaaggccatgaccgacgtgtatgacgcgatcatcgatgcctccctgacctgggccgtgcgccaccagatcgccgagttcggcgtcgaaaccgcgccggccggcatcaccgtcatcgccatgggccgttacggcgggcgcgaagtgaacttcagctccgatgcggatgccattctcatctaccgtccggccgacgatgccgacgacggccaagccaacgccttcgccaagaaggtcgtggaagacctgcgcaacatcctgcaaggaccgacgacgctggaacccaagatcgaactcgacctggacctgcgcccggaaggcaagaacggcccgctcgtgcgctcctatgcctcctgcgaggaatactacgaatcctgggcttcgacctgggagcgccaggcgctgctgcgcgcccggtacgcggccggcgacgctgaactggcgcgggacttcctgatcaacatcgccgacccgctgcgctacccgaccacggaactgactgaagcagaattgcagaacatccgcaagctcaaggcccgcatggaagccgagcgtctgccgcgcggcgtgcgccgtgaacggcatctgaagctcggcaagggcggcttgtctgacgtggaatggaccgtgcaactcatgcagctccagcacgccggcgatatcaaagatctgcgcgtcaacggcacgctggaggcattggacgtgctggaagccaagaagctcatcagcgctatcgacgcgattcagctgcgcaaggcatggacgttgtgcaccgcggcccgcaacggcagctatctgtggagtgggcgcgccaaccaggccgatattctgcctgatgacatctattcgctgggcggcatcgccgtctacctcggctacggcgcccaccgcggccagcatttcgagaacgacctgctggccgtgatgcgcaaatgccgtgacgtatgccagcgcttgttctatgggaagaccgaaggcgaggcggctgcggcaaccaccgccacggcctccgccgcaacgcagcagccgcaaaccgcccctcgcccgcgtatgcacgtgatcgcaccgcgactggaacgaaatcgacgccgcgcgcagcgataaggcagcatattcgttggattttcaggtggacactcggtgaatgcggctgtccgaaaaatggcgtaagttagattaggtcacgcaagggtggccacctgaaaaccacgagcgaaaaggtgagccttgtctgaagaaacgccaatggtcggcaaaagcgtcgtaacgctggacggcctgtctacaaaccagattctcgacctgctgcataaggccgaatacatcgattcccaccgcaaagagattgcccatacctgcgatgggcgagtgctggccacgctgttctacgagccctccacccgtacgcgcctgagctttgagaccgcaatgctacgtctcggcggcaaggtcatcggattcgccggcgcgcagctggcctccgtgaccaagggcgaatccatcgccgacacgttgaagaccgtgtccaactacgtggacgtggtcgccatccgtcacccgaaggagggtgccgcgctggtggcctcccgcgccgcatccgtgccggtaatcaacgccggcgacggcggccacatgcaccccacgcagacgctggccgacctggccacgctgcagtcgcgcttcggccgcatcaccgacctgaccgtgggactgtgcggcgatttgaccttcggccgcaccgtgcactccctgatcgagaccctgtgccgcttcggcaacgtgcgcttcgtgctcatcagcccggacgagctcaagaccccgcagtacgtgatcgaccgcatcaacgccaccgacagctgctcctacgtggaagtgcgcgacctggcctccgtgatcggcgacctcgacgtgctgtacatgacccgcgtacagaaggaacgcttcttcaacgaagacgactacctgcgcctgcgcgacacctacattctcgacgaagagaagctgcagctcgccaagccgtccatggccgtgcttcacccgctgccgcgcgtcaacgaaatcgccgtggacgtggacgacgacccgcgtgccgcctacttcgaacaggtcaagaacggcatgctcgtgcgcatggccctcgaaagcaccgtggtgggcgacgaactgcccggatacgaaccgctcaaccccaaggaggttcaggcctgatggaagtcaccagcattcagaacggcatcattatcgaccatgtgccggccggaacctcgctgaaggttctcgaatacctgaaaatcgacccggccaaaaccaagcttgcgctcatcatgaacgccgactccaagcgttacggctccaaggacatcatcaaaatcgaagatgacaaggacatcgacctcgacgtgctcggcttcgtggcccgccaagccaccgtggacgtggtgcgcggcggcaagatcgtcgaaaagaagcagccgaacctgcccgagcacatcgtcggcgtgatttcctgcgtgaacccgcgctgcgtgaccaccgccgagcccggcatcaagcagatgttccacctcgtgcactccgagcggctcgaataccgctgcgactactgcgacgaggaagccaaactgtgagcatcaccctacgcaacatcaaggtctggaacaccggcgaggtcatcgacctcgtggtgcccgggaccgctgccgcctacttcgccgacacctccgccgtggctgacggcgccgacatcgacgccaccggcctgaccgtggcccccggtttcgaagacccacacgtccacttccgcgatcccggccagacctacaaggaatcgatggtctccggctgccgtgcgtccgcatccggcggatacacgaacgtgctcatcatgccgaacacgttgccggcactggatgggcagaccgtgtctggcccggaagcgaccggtgcaaaagaggttctggatgccggcttcgacaacgtcatcgacttcctgcagcagtacgatactgcgcatgacgttcaattgccggttcgttacgatctgtgcgtgtgcgcgtccaaggatcgcgccggtcatgaggcaagcgacgttgccgattggctcaagtacgtgcccggattcgaggacgacgccaagacgccggccatgctcacgcaccccatcaccgcaatcagcgacgacggttccgctgtgacgccggagatcctggaccaggtgctggagaacgtcaaggcctccgacctgtacctgatcgagcattgcgagcatcacgatacaggtgccgtgaacgaaggccccgtttcccgcgagcttggcgtgcccggcattccggaagacaccgagctcaagatcgtggcccgcgatatcgaagcggcccgccgcaccggtgtccacgtgcacttccagcatgtgagcactgccatctcgttcgaggcgattcgcagggccaaggccgaaggactgccgattacctgcgagaccgcgccgcactatctggcgttgagcgacgaggcgctgctcaagtacggcacgctcgccaagatgaatccgccactgcgctccgaagcggaccgcaaagccaccatcgcggccatcgccgacggcaccgtggatctgctggccaccgaccatgcgccgcacacgttggcagagaaggaactcggcttccttgaggcgcccaacggcatcatcggactggaatgcgcgtacggcgtgtgccacaaggtgctcgtcgacggcggcttcatttccgatgagcgtctgatcgagctcatgtccgttggacctgccgaactcatggggcatgtgccaaccgacgtagccgcgctggtcgaggactacgccgaacccgcgcccaccggggatgatccggatggcgtgattgcgggggagagcgacgctcagccgcagcgtgaaggcgtcaaccgactgctcgacttgagccgcgtggatgacgccgacaatgtcgacctcgtggtgctcaacgccgccgaggaatggaccgtggaccccgaacagttccactccaaggctcgtaacaccccgttcggcggctggcaggtcaccggacgccccctcgccacaatcatcggctcccagctgatgttcagccgtctgtagataacacaaggagcagcatggatcgcctgatcgaagcgattgacaacactcagaaccccagcgtcgtgggccttgaccccactgaggcgctggtgccgccgcaggtcgtggcgagctttgccgacgaggtgcgtgactcggtcgaatccccggaggaagtcgaatccgcgcagctggccgtcgcctacttcgaatacaaccgcacgatcattgacgccatcgccgacatcgtgcccgccgtcaaaccgcagatcgccatgtacgaggcgctcggccccgccggcgtggacatctacacgatgacctgcgaatacgcggcccagcagggcctctacgtgctcggcgacatcaagcgtggcgacatcggctccaccgcagccgcctacgcccaccacctgaacggcgtgggcgacttcgacccgtggcatgaggatgcggtgaccgtcaacccgtatctcggcaccgacggcatcaccccgttcgtcgaggccgccgccgaagccgacaaggacatcttcgtgctcgtgcgcacctccaacccgtcctccagcgaactgcagatgctcgacctggccgacggcacgaaggtctacgagcacgtggccgatcttgtggaaggatggggcgccgagaccatcggcagccacggctactcccgcgtgggcgcggtggtcggcgccacccaccccgaggaaggcaaggcgttgcgtgaacgtatgccgcacacgttcttcctcgtgccgggctacggtgcgcagggcggcacggccgcggacgtggcaggcatgttcgacaagcagggcagcggcgccatcgtcaactcgtcgcgcggcattatcggcgcatggaagaagagcggcaagtactccgaatccatgaccgccgacgaggcgctggaccttgtggcgagcagcgcgcgccaggcggcgctcgacatgcgcgataatctgcgggttgccgtatataggtaggtagattgtccggctgtgggctatacgtgagtgtgggctggaaaccggagccgagtgtgtttaactacctctcagtcaacctgcggttgaccgctcccctgatagggggagcttgatgtgctgaataggaatgaaatgacaactttcacccccacccatgatgtggttacggaagcgactgcggccggattcttcccgccgcgccacaacgtcgaaatcacgcaggttacggaactgaccgaccgcgtgatgcgactgacgttccgcgacccgttcatcgcctcccatgccaagcccgcccagttcgtcaacctgttcacgcacgacgacttcatgctcatgccgcgtccgttcggcgtcagcgaagtcgacggcgacgaagtcagcgtgatcttcgccgtcgtgggacacggcaccgaacagttggcaggactgcaggccggcgacaccgtcgacgtgctcggcccgctcggccgcggcttcaacctcaaggaagacgccaactacattcttgtcggcggcggactcggcgtgcccccgctaatctacgccgcgcaaaagctcgccgaacacgacgcctcctttgccaccgccatattcggttaccgcaacgaccacttcgccgaggaatacgtctcccggtacgcggactggtcgtggagcatcgacgacgccgaaggcaacgtggtcgacctgctcaacaaactggaacaaggcgacgacctgaaggcctacgatcgcaagccgatcattctgtcctgcggaccgctgcctatgatgaaggccgtggccgactgggccgccgaacgcggcatccccgcgcagctgagcatggaacagcgcatgggctgcggctatggcacctgcgtgctgtgcaccatcgacaccgtggacggccgcctcaaggtctgctccgacggacccgtgttcacccgcgaacagctcggatgggggaagtgacgatgagcgcaaacaaccagtccgcgcagggcggcgacaaccacatcaacctgtacgagccccacgtgtggaagcaccacaccaaggtggccggtctggaatggaagaatccggtcggcaccgcctccggcaccttccagtacgccgccgtccgctggttctacgacgtcagccagctcggcgccgtatgcaccaagggcgcctcgcccgtaccgtgggaaggcaatccctcgccgcgcaccgccgaatcgccggccgcgaacatcaacgccgtgggcctgcagaatcccggcatcgaccattacttggccgaggacctgcccaagctcaaggccgcgggcgcgttcgtcatctccaatgtcgccggacattgcgatgacgattacgcggcggtcgtggaaaagctcgccgactccgacgcggacatgctggaaatcaacgtcagctgcccgaacgtttccgccggcggcatgagcgtgggcaccgacccggtggccctcgccaatcttatggaccggctgcgcccgatgaccgacaagccgatgatcgtcaaactcacgccgaacgtcaccgacatcaccgtgccggcgcgcgcggccgtggaacatggcgccgacgcgttgagcatgatcaacacgctcaaaggcatgcgcattaacattcgcaccggcaagccgatcatcgccaacgtcaccggcggcgtatccggcccggccgtgctgccggtcggcctggcagccgtctatcgggtgcgcaccgcactgccggagattccgatcatcggcctcggcggcatcgacagcggcgagaaggcgctcgaatacctgtacgccggcgcgaacgccgtcgaagtgggtgcggccgcgctcttcgacccggtggccccgctgcgcgtcgcccgcgaactcgacgacctgttggacagccgtcccgaactcgctgctaaactggccgcaggacagacttggaggtaaggaacatcatggcagaaacactcgcacatcgcttcactgaattcctgttggaatccaacgcgctgaagttcggcgacttcacgctgaagtccggccgcaagagcccgtacttcatcaacgccggcgccttcgacgacggcaagaagatcgccgcgctcggcgcgttctacgccgaaaagattagccaggccatcgtgcacaacacgattccccgcaacatcgacaccgtgttcggtcccgcctacaagggcattccgctggccgtgtccaccgcgatcgcgctgaccgccggccacaacatgaccgtcggatacaccttcgaccgcaaggagaagaaggaccacggcgacggcggctggatggttggcaccccgctgaccgacggcatgaaggtgctgctcgtggacgacgtgatgaccgccggcaccgccgtgcgcgaagtcatccccaaactcaaggccgaggcgaacgtcgaggtcgtgggtctcgtgctctccgtggaccgcatggagaagaccaaggactccgacatgtccgccgtgaaggccgtggaagccgaattcggcttcccggtgctctccatcgccaacgtgcgcgagatcttcgacgccgccgccaagatgaagaaccccgacggcaccccgctgctcagccacgacatccagcagcgcgccgccgcctaccttgaggaatacggcgcctgatcgtcttcaatctaaaaaccaaaagcgggcttgcgagcccgctttttttattacgttccatgaacagcagcaccatattaaggcaaaagctttggtaaggagcgtgctatgaactggttagttgatatagggctgtttgcgctcgtggggatatgcagttacttcggcatcgagcatcatctggacagcaaagcgaacaagttgtcgcaaggtaatgaagaagaccgccgagatgctgatgcccaagtagaagcagcatgaaaatggcggaatgacgttggggtgacgccgctcatactcgggatatgacggatgaacagcctcttgaaacggagataaatgtctccagaaggccaaatcagctcccttgaaagcgagatagggttctaaactctgggaccgactcgcctgtgatgaaaacccgctcggcgtagaattaccgtaggttcgttgcattcgaacaaggaaggccgctatggggaacatcaccgacgatattcggcaacatttcgacactttcgccgaactgccgttcaccgaggcggatagcctcgctttgtcccagttggcctatgctcgcatgccggataacgtgccgcgctatcacgagaatgcagagaccgccgacggcatgatcgccacggttccgattcacgatttgctgcgtgccgaatgctatgacgacatgttcggcaaggtgtggtcgccttcgatgaatgtcgatctgttacgtgcgatgagcgagagcccacgttggaggaacctacgcgtgggcgcatacgtggacgaattcgatgccgaaaccaccaagcagttctcggcctgcgtgttcgaactgggtaacggcacgctctatgtggcttttcgcggtaccgacagctcaatcgtcgggtggaaagaggacttcatgatggcgttccgccgcccggtcgcctcgcaggaggccgccgcgcgttatctgaccgagctggctggccattgggccgggccgattatggtcggcggccattccaaaggcggcaatctggcggtgtatgcggcggccaatgtgcctagcgagattcaggaacgtatcacggtcgtatattcgcacgatgggcctggattcgatgaggcgttcttcgatgaggacgggtacgtacgcattgcgtcgaagattcataaatcggtaccgggctcgtcgatcatcggcatgctgtttgagactcgtgagcatgtggaagacggctatacggtggtcagcagcgacggtgccagcatcatgcagcatttcgcattgcactggcaagtcgatcatggccaattcgtacaggctgatggactgacaagtagcgcgcaatacctggcacgcacgatcaacggatggatggcaaaatacgacgacgagcatcgccgcaagttcatcgaaaacctgtttgccatcttcgaggctggcggatacgacacattcggcgacctcacttcgcatttgacacagtcactgccgattatgctcgccgcggcccgcaacattgatgtcgaagatcgcgacgtgatgattgaagtgctcaaaggcttcgccgcgacagccgccgcgtcggtaatcttggccaagtagtcggaggccatcaaactggttttgccagtcagtctcaatagcgcaaaagccggcccctgagatactcaggagccggcccttacttccatttccccagcggggttggcttaatcgcagtatatctcactgctgaccatgcctgttttacttactcctaatcaatgagcttgtagccgtggtcggagactacggacttgagcttgtcgagataggtttcggcggccttggagagcttggaacgctcgttcgtgatccagccgaccaacatcgtttcgtcggtgtcgagcggcacggtgacgatcttctcgttgttgaggtcgccgttgtcgatgccggtgcacaccgtgtagccgttgaggccgatgatgaagttcaggatcgtggcgcggtcggtcacgttgatctgcttgggggagtactccggccagaccgcttcctcatagaagtagaacgagccttcctcgccctgctcgtactggatgaacggataaggtttcaggtcctccatggtgatgaccttcttggcggccagcgggttgttgcgcgagatgaacacgtgcagcggcgcgcggaagagcgggtggaattcgaggtgcttctcgcgcaggagcttgccgatcacgtccttgttaaaatcggacaggtagatgatgccgatttcggactgcatgttggcgacctggttgatgatgtcgcgcgtgcgggtctcgcggatggtgaactcgtattcgtcggacttgatggagttgatcatctccacgaacgcctcgacggcgaacatgtagtgctgggtggagacctggcacagctgcttgcgcggtttggcatgcttatagcgctcttcgagcaggtcggcctggtcgagcacttggcgggcgtaggtcaggaattccgcgccgtccacggtcagggcgatgccctgcgaggagcgggtgaagatctcgatgcccagctcgttctccaattccttgaccgacgagctcagggccggctgggagacgtacagggcatgggaggcctcgttcatcgagccgcactcgacgattttgacgatgtatttcagctgcagcagtgtcataaagtctatttatatcgctagggatagtcgccacacggccggtcaccgtcgtcaaggacgggtccatagacttcaactgccgcgatgcaacgtttggcgacttacagacgtacgccgagttctgcgagcgattcgcgtgcctgcaacgcgttctcgaagaggatgccgtggatgccgacctcgttggcgccgacgatgttcttggcggtgtcgtcgaagaacacgcagcgctcggccgtgaggccgaaacgggtcagggccagctcgtagatgtcggcgttcggcttatgcatcttctccacgccggagaccacggtgccctgcaacagctgttcaaggcgcgggtacttctcgaaggccaggtggaaggtctcatgcgaccagttggtcagaccccatacgccgtagccgtgggccttcaaatccgccagcagctcgaccatgcccggaagcgtgcggggcagcgcgtccgcgtagtggccgatgtagaacttgaagatgtcggcgagttcctggccttgttcgcgtaccacatccgggtagatgtccgcgaaatcctcgccggtgtccatgcggtcctcgtagcggaagaagccgcaggggtcgtcgtcggcgcagatgcgttccacgatctcatcggggaatcggccttccaggcatgcgcgggtgttccagtccagcagcacgccgcagaagtcgaaaatcacgtcggtgatgggggagttggccatgatgctccttgtgttgttggggccgttgagtggggtctgcgatttagtatagggggtttcatacgttggctcccctctctgaggggagccaacgtacggaatcatgcgatgacgtcggcgatggcttcggggatggcgtgggccacgtcgccggccacaatcgggtggccgagcgtcatgaagcgctggcgatgctcgcggccgatcagttccggctcctgccagccttgttgctcggattcggaggcgatcgccgccgccaggccatgcaggtaggcggccgaggccacggtctcgcccgtggtggccacgtcatcctgctgggcgagcagggcgccggtcagaccggccagcacgtcgcccgcgccggcggtgcccagccaggccggtgcgctacccgacgcatagacgtggtcctcatccaccacgatggtcaccgcgcccttcaacaatacggtggcgccggtgagctcgtgggcacgcttcgcgctggccaacgggttcaaccgcacgtcgtcggcggtgtacggctcgtgcgaatcggcatgctccgcggtgctggcggcggtttcgaaccggttgagcagtttcgccatctcgccggcatgcggcgtgatcaccacctggccgggcacacgctccggcagcaggtcgagtgcgccggcatccaccacgattggcggcatgtcgtaggcgtccttgttctcatcctcgctgccgagcgcgtaatgcttgagcaatgcggcgatggtgtcccgctgcatatcgccgtcggtgccctcgacgctagcctcgggcacgccggaccccacgacccaggactgcacatgtcccttgccgatcacggcttccggcagtgcggcgagcaccatgttctgcgcgcgctccgggcccagataccggaccatgccggtgttcgcgcgggcggcggcgctggcggtgagcacggcggcaccggggtagcgctgcgagccggtcaccagaccaaccacgccccgggagtatttggaatcctcgaacctggggagacggaccgcgtcggacgcgaacgaattatccaccacctcgacgtccggatccttgtcgtcgatatcgaatccgaaatcgagcaactcgatacggccgcaggcgaacgtggcgggcggcagcaccgcgcacggcttcatcgcgccgaacgtgaccgtgaccgtggccggaatgtacgggccgggcagagaaccatcgttcacaccgacgccggatggcgtatccacggcaagtaccagcggaaaatcgcctgacgactcacggtttggcagggcgggctcatcgggagcctcgccgtcgagaccaagggcggaggcgagtgcggcggggatgccgcgtagcgagccttggatgccgatgccggtcatcgcgtcgatgatcagatgcgatttcctggccacggcgatggcggtctgcaatcgctcgccggcctcaccggcggaaaacccggacgcgcaaccgggaatatcagccgcgggatcaagcaccagcaccttgcctccggcgcgcacgaatgaggcgaatccggcctcatgcaacgaccggcccacggcgatggcggtgacgttcgcgccctcctgggccagcgcggcggccgcgaacagaccatcgccaccattgtctccggccccggccagcagcacgatcgacgtgtcctccagcgccagatcctcgtcgtccagcataccggccgccatgtgggccgcggcctgggcggccatgcgcatcagcggcacgcctttgtccagcaggggtcgctccatggcccggaccgtatcggagtcataggcgctgtgcagcagcagttcgcgacgatcggcgtcttcggtgtattccatggcaacccctttcttgtgtttgttacttgcggtccgtgtttacaggccgtacacctcgtgggcgaacttttcgaacacggggatcgagcgcttgaccttctccgtgtcgatgcagtaggccatgcggaagtatccgggcacgccgaagctgtcggacggcacaagaatcaggtcgtattccttggccttcatgcagaacgccacggcgtcgtcctccagcgccttggggaagatgtagaacgtgccgccggggcgtaccacgtcgaagccgatgccggtcagcgcatcgtagagcaggttcatgttcgtctcgtagacgttgagatcggcggtctggtcgatgaccttggccacgcccagctgaatcgagctcggcgggcagttgtggccggtgccgcgcgagatctggcccatcatgggcacgagcaggtcggcgtcggtggctgtgggattcaccgcgacatagccgatgcgttcgccaggcaggctcagcgacttcgaccacgagtagcaggtcagcgagttcgcgtagaagctggccgggtagggctgggtggcgccgtcgaacacgatttcgcggtacggttcgtcgctgatcaggaagatatcgtggccgtattcgacctgcttggcggtcaggatcgcggccagacgcttgagcgtgtccgctgaatacaccgcgccggacgggttgttcggggtgttgataagcacgacctgcacgttcgggttaagtgcagcctcgaatgcgtcgaagttgatttggaagttctcggtgtcggccggcacgatggtcagcttggcgccggcgcccttgacgtacggctggtattcggggaagtagggggcgaaggtgatgatctcatcgcccggcttggtcaccgcacgcatcgcgtgggacagcgcgcccgccgcgcccgtggtcgggaagatgtggttgccggtgtatgccatgccgaaacgttcgttgaggttttcggcgatcgcgtccttgacggatgggataccgagcgagggagagtagccgtggatggccaccggatcgccgttttcgtagaggtcgaccatggcgtcggtgaaggatttcggagccggcaccgagggattgccaaggctgtaatcgaacacgttctggtagccgatttcggcaccgcggctcgtggcgtactcgctcagctcgcgaatcacggacttgccgccaagcatggccttgtattcctcattgatcatggctgttctcctcgcatggttgtactggtatgcaccacgctactactatcgcggccggtttgcgccatttgccgcgccgtgcctaagctggctgttctatttgttctatttgttctattaactgtcgaaaccgcggaataacgccgatttccgctacagctccatgattatccacaaccgttcatagcgagcgctgtgggacggcgggcggaaaacggccgaatccgcgtgccgtcccacacctcgtgcaatccacgtttcgggaaagcaccaccgtaagaccggcgcgcatccgcatccacgacaggagccttaccggccgtaatcccgcactcgattattttttctgacagggaatcgaacccgaaacactaacccatgcacgccccaccgcaaacagcgaataaccaaatgtatgcattttcggcaccatgagcgaaggagttcgcaaacacaacagtgattggcatatacggcatcgaccggatgaacagcatcgcgtcctcataggtcaagacccactgggactcgtcgcccttgggtatagggacattgcctgtgtcatagtcgttaagcagcacaagactcggcaaatatcgttccaagatctcggcggtgccagcaatttccggttcggtggacctcgatagcaccttgacgacggcgtgaagtgcgtcaagccgcttgcgattgatggtataaccatcaacgagatgctgcttcagaactgagttggcccatcgccggaaatagatgccttccttggatttgacgcggtatccgaccgacaggatcatatccaggttgtaatgctcgacttggtatgtcttaccgtcagatgcagttgtcgcaaattttgcgacaactgaaaatccattgagctcttcccttaatgcattgccgacatgcttgccgattgttttgatatcgcggccaaacagcaaggccaattgctgtctgttaagccacaccgtgtcctcgtctaccttcacatcgaggtgcacggtgtggtccgcgctctcatacaaagcaatctgctgcttcagttcctcgccagtcatgagatcgcctttcttttttcgggcgtctgtaaatcatgtcgttgtcgtcgctaaattatgcatccagtttatcagggcagtcgaacgtttgttcgattactgtatctctcatatttgtatgactttcccgacgacgtattggctatgacggaggtaatgggcacggggataatgctgatgatgggcatttccatcatgcaaaaacctatgccccgtattgaaaaaagctattggaccaagccgttgggcttaggccatgataattgggccattgcgcggcttatccgttcgacggatgttccggatttgcgatggcgttgaattgcaattatcaaatgaaagagcaaattgtatgagcgaaaacaatgatgccaaacacgtgctgttggtgttgatcagtcactccgatttgggaggtgtgagacctactggcttttatgttgatgaggccgcacatccttggcaggtgttcagacgaatgggcttcactgtgggccttgcatccatcgctggtggcgtaccgccgcaggctggccgtcatcccggtgaccctgtgcaagagcaatttctgcatgatgcggatatatcacgccagctagtgaatacgcgcgccttggctcaagtaaacgcgaaccgatatgatagcggtgctattcgttggcggtcacggtgtgatgtgggatttccccaacaattctgtggtgaacgccgtcggccggaacatctgggagcgcggcggcattgtgccatgggcctgcggcattggtggatatgacgttgtcggatggcagttatctgattgccggcaagcaggtcaccggattcaccaacggcgaagagcaaaatctcgggtgttatccgtggctgcggcgggcgaatagaagggagattgagatagaggcaggggagatgccgggtgcatcgccggcatcacgcctccgtgaaatactcgttttcgtccgcaagccggccgcctttgatgaacaggaatcgctcgcacaactcctgcagctggagatgagcatggcgatgctgcggtcgcaagcccactgtctgagcacggcgatgagctggagcacgccgtccgggtcgaggtccacgaacggttcgtcgagaatcaggaactccggatcattgaccagcgcgatgaccaacgcaagacgctgtttcatgctgaacgagaaaccggcgggcctgcggtcacggtacggccaaagtcccacaagttcaagcaccgggcggattgggaggcgcgagcggtgggtcggacgattacagtgtgagccgaatacgttcatgaatcatcgaatcacaaggcgaggcggaccgcaagtattcgagagtcgccagttcggtcgatttcaatgacaatggtgtggacgattacgcggatatcgtggcgggtgcgcgcaaggacgccgaaaaccatccggcttacgattccggctactatcagggcggctatccgccggccgatcgcggggcgtgcaccgtacgtgattcacaacatggcgcagcggcagcgcgaaaacgactacttcgccttcaagaagcacatgacggtcaccgggcactaccgtttcgacgcttcgaaagtgctgtagagcgtactcagggcttggcggtgacggtcggagcggcgtcggcattgccggctttggctccgactgcatcagctgaatcggtgccggccgcactggcgttagcactatcgtcagcgttggcaccgccggctttggccttggcatcagccgcgctcccgccatcgatcaccagtcgcagataatcgcggtcggcggacttgcggcgcggcacgaaccgactgatgatggagtttttcttgccgcggttcttcacgtacaggaagccggacacggagaacacgaccgcgccgatgaagttgacgataagatcctccatcgtgtcgatcagaccgatgtcgaggtagccgccgaggcccaagtcttggccattgaccgtgacctgggtgatgtcgttgatgcgaatcgcatggttggtgtgcgtggggtcgagcatcaccgagctgatggaatgcacgatggcgtctttctgcatgtcgaatccgaacaactggtccatgccgaattcgaagaactcccagatcacgccgatggtcatggagaagcagaaggagacgatcgccagatacaggggcgaaagctcgaacttcacccggtcggaccggttgagcaggtcgaccagcgagaagccgatcgccgcggcgaggaagccgttcatcgtgtgcaacaccgtgtcccagaacgggaagatctcatagaacgaactgatctcgccaagaatctcggacgagaacacgaacaccagcacgatgacttccagcaccgaaggcagctcgatgcggaactgcacctggatgaacgccggcgccaacagcaacagcaacgtcaggatgcacaggaacacattttcgtagtcgccgttaaagaactggagtattgccatggcgagcaccagcatgcgcagcaccacatagaccgcgaatgagcttttgtgttcgcggatttccatgcctacggctcggctcatggtcttccagcgtacgcgccaggacggtttgcgttgtgcgtcgtgctgttgtgaccgtttccgggtcattcttgcctctttctcgcattgttctcgcgccagtctatccgaacctgcttacaggcaatcggcaagaacgggcgatagtctggccgcatgaaccgaatggaaaccgatgctgcctcgattgtggaccgcacgaatcatgcggcgatgctcgatagggccattgtgccggcggcacgccaccgcgtgtgctgattgcagtgctcgccgtgctgctgtaccgccgtatgggcatgattacaccgccgatcgtggctcatggcatgtatgacgtctccgccgccatgaccaatctgaccggaatcgccggctcctcatggtcactggtcgtagggctggcaatcatggccatgccggtggtttgggctatcgtgaggtgtgcgagataggctttgtaccggttggcagcaaatcaaaccagcgagacaacggaatgaacgaagcgaaaggaacggtatctgatgactccgattgaattgtcaacccgacgccgggttacgggactgacttcggatgagttcgccaggctgttcgtctctttgcaacgcgatgtggacggcgaagccgcgcattggagcgccacggacgtcgaatcctgggagctggtcggcccgccggtgaccgccgaacagcatcttatcgacacgttcgccgcggccaacgaattcgtggccacgcttgcggaccgtctgtaccacacgatcatgccagtcacggaagaatcggtcatcaccgcatacgctgatgacctcacattctgggcatcgcatccagaccttggcggagtgccgtgcgcattatggaacatcgccgcactgcaggcggccgaatgggcccgcaaggaaaccggcatcgcctgtgaactagacgtgcgcgaaccgctggtgtgacagctgagctcaaacatgggcgtaggtaacggcatggtttgaggactatggtgttgcgttaccggtcggaaaggatatgatggtggggcgtcatagcaaaaaagcgcgtggacagtcgaggagacatgcgcgaaagtcctccgtttggagtgaaattcgcggctatctgctgacggtgatcgcggtgatgctggtcgtgttgctgggacgcaccttcgtgttcaacgtctatgtgattccatcccgtagcatggaagacacgttgcaaatcggcgaccgcgtatttgcctcgcgattgactccgagactctttgcactgcaccgtggcgacatcatcgtgttcaaagatcccgcagactggatggagggggagcagcttcccaccaatctgatgtcgataatcgacagcaatcgttacctaatcaaacgtgtcatcggtctgcccggcgataccgtcacctgcaagggatccggggagcccatcacggtcaacggcaaacccattgatgaaagcgcttatcttaagtccggcgtgaatccaagcgacagtcctttttccgtaaccgttactgacggcaacgtgttcgtgcttggtgataatcgctccaattccagagattctcgataccatcttgacgacggcaacaatgggctagtgccatacgacgatatccaaggtgtggcgttgttccgcttctggccatttacgagaatcggcttgctcaattgagtttggcgtgaatacgcaagttgacatgtgtcgcacggcccggtgcatcctgcagtcggaccgtttccggaaccctcccccgaaatctgacgaccccctgtctcacagctatcgcacagctccgatacgggaaacgtgcgggtgattccataacgactacgtacttcaggaagtgacgtgtatcgcattatggtcatgtgttcagtgccgcagataggcgaagtttattcatgagccgaatagggccggtgaagcgggctctcactgcgttcataatacggcatatcgtgaacggcgttatcatcacagtcaggccgaattaaaggaggctcggtcatggtcgccgcatccacggcattcagcccgtcaagcacgatgacggccagtttggtggaatcgactggcctgcccagtgccgctattcctgtgcacgaggatggtaacaacggcaacggcgacagtagtgccgatggcagcggcgacgacggcggcatggtcagatcgctgagcctgtggaactacttcaccatgggattcggcgcaatcatcggcaccgtatgggtgctgctggtcggtgactggatgatcgtcggcggtggcccggtcgaggcgatgatcgccttcgtgctgggcgccgtgtttctgctgccgatcggctcgacgtccggcgcggttaccatggtcgggtcgtttctgcccggagtgctggtgatgacgccgctcttctacaccggtttcgacacgattccgcagagtgccgaagaggcaagcgaaggccttgactggaagaagttcggtatggtcatctcagcttcgctgctggccgccggcctaatcatcattggcctgcaggtgctgccgttctccccggccgcgctcaaacccacatcatgggcaatcgtggcggtgtggatttgctgggtctggcattgcgttggatcagtgcacgttcacggcgcgaatagcggtgcgccggtaggtcgcgagccgttcagtcgcgcgcgacccaaagcgtatcgaggtcgtcggcctcggtcgcctttttgcgcttgcgtacccactgttgcaggaaatacgccccatagcaggccacgatgaacacgagctcggccacgagcgcgaaccgttgctccacgtcgaaaatcaccaatacgaacgatgcggtgcacaggatgaacgccgcccaagacacgtacggatagccgggcgtgcggtatttgagttcgctggtggaatggccggactccagccaacggcgacggaacacgatctggcagtaggcgatggcgatccacaccaccacggcggacaggccggaaagcgccaccagcaccaggtacacagtcgaggcggcgatcacggaagacaggagcgccagcaggccaccggccatcgcggcgcacaaggcgagcatcggcacgccgcgacggttcgttttggcgaaccagcgcggaatcatgccttcgttgcccatcgaccacaccatgcgcgtggaggcgtacaggccggaattcgaggcggagagcacggccgtgagcaccacgaagttcatgatgtctcccgcataggggatgcctatgccgttgaacacgagcacgaacgggctttcgcccacgccggccttgcgccacgggatcagcgcgcacatcacggtgattgagccgatgaagaagagcaccagacgccacagggtggtgtggatggctttcggcacggcggtttgcgggtccctcgtctcaccggcggtcacgccgatgagttcggtgccggagaacgcgaagttgacggtcagaatcgtggcgaacaccggcatgaagccgttggggaagacgccgtccttgatgagattgccgaacatcggggcatgttggtagccggcgaccgggatgacgccgaagatggcgagcgatccgatgacgatgaacgcgcagatggcgaacaccttgatcgaggcgaaccagaattccgcttcggcgaagagccgcaccgacaaggcgttcagggtgaagatgagaatgatgcacgccgcgctccacacccatgtggggctgtccgggaaccagcgttgcatgagcaggccggcggcggtgaattcggagccgagcgccaccgtccaggtgagccaatactggattgcgatcacgaagccggtgccagggccgatgaacttctcggcatacacatggaaggagccggtcaccggcatggccacggacagttcgccgagcgtgagcatgaccaggtagacgatcagcgcgccgatgctgtatgccaggatcgtgccgatggggcccgcctgctggatggtgtatccggagctcaggaacaggccggtgccgatcacgccgcctaatgagatcatctgcaggtggcgggattccatgccgcgcttcaggttggtatgtagggcgtgctcgtctttgccatcatgtgacgactcggactggctggtttgcgctggttgattcatctgttccgaatggcttcgacggccatccgtctgaatctgcggttcctgttgcgaggacggcgactgtgccgccgtgtcggtgtcgggctgactcatgtttctctctttgccatgcgtgcgttccataggcgtcgtcgtgacggcccggaatagtatacccgcaccgaggatatagctgcgctgcatgatgctgagtcaaaatcagcttcaaggggctgatttggcgtttgccggaggtctacttccgtttcaaggggctggtcaactggcggaacgcagatagaaatggcattgttctatcgctattccgccgtttttaaccagtggctactttggcatcagccccttgaaacggaagtagatgttccgcaaagtcaaaatcagccccttgaaacggagataggcactcgcagcggctacttcaccttctggatacgcagcacgaacacggcagcgcacacggccatgacgatggagatggcgaacgccggcgtgtaggtgccggtcgtggtcttgaccacggaggtgatggtgggaccgactgcttggccgagcgtggtggccaggttgaggatgccgaggcccttaccggcctcttccttgttcggcagcacgtcgacgttgagcgcttggtcgatggctgagtacacgccgtagccgaagccggcgatgcccgcatacaggtacatgcccgtgacgctcggcatgatccacggcatcgcggtgccaatcgcgaacagcagcgaggcgatgatgactggtaccttgtgcgtgtgcatcttgtcggagatcgggccggagatcagcgaagcggtcagggaaacgaccatggtgatgatggacatggtggcgatggtgccggcagcctcggtcttggtctggtgcacgtaatcctcgacgatgtagagttggtacacggagatcatctggtagctgagcaacatgcacactcggcagccgaacgccttgtagaagtcacgcgaggtggagaacttcgggaagtggaaggagacagcgagatccttgagcgtcatcttggtgcgttccatgtcctttgaggattcctcgcgaggtcagatgtcaagcgccacgaatccggaagcccatgatcacggcgccgatgatgaagccggcttgcgcattgttgatcatgcgagagccgatcatggtgccgatgggctggccggtgaccatgccgccgccgtagaaggagtcggtgccgcacagcttaggcatcgcgattatgtgcctcgtgctcatcatccgtatctgtctattgcctctcttcttctcccaaatgcgcgcgacgcagcgtatgcaggtgctccaaccgcaaatccaacgtatccaacgcaagtacgccgcgcgtaaggatccgcgttccaaagaagccatgcaacgtgaaattatggctttgcagcagcggcataacgccaatccgctcggttcatacctgcttcgctgattcaggcgccgattctgtgctcgctgttctacacgctgcaatccctgcccgcaagcgccgccgggaatgcggaaccgttgagcggcatcgaccgcgtcatggcgggcgacatcgaatcatcgtccatattcggcgtgcgcatcgccgactcgttcggcacggtcgtctcgccgcagtcgcacgtcgtcatcggcgtggccgtggcgttgatgtgtctgatgttgttcgcgatgcagtggctgctcatccatcgcaatacgccgaaggacgccatggattcaccgcagttccgcacgcagaagctgaccgcgtttgtgttcccggccatctacgtggtgtcgggcggcaccttgccgttcggcgtgctgctgtactggctgaccaataacctgtggaacttcggccagacgctctgccaactgcgatggtttccggcgcccggatccgaggcggggagcgcaaggccgaacgcgaccatgagcgggagaaccggcatcgcgccgcctccggattgccgtctttggaagaagagcgcgcggcggccgcgcgtgaggaggcccacgtgcgccgcgagcgtgaaaagtcggtcgccagccgcaatcgcagacagcgcaagaacgtgcagctcgccaagcgttgatggcacatgggagaggttacgggggatgcgctgagaccctcgtccccggaacggttcgaagtgctaaactgcttgcactacgctgcgatgcctgagcgcaaacggatccaagaccttacgatgacaggatgaacgatgatggccacgaaccgcacgttactggaacaggcccgagaattgcaggcgctggcccagaccggactgatgtactgcaaggaccccttcgaccgggagcgctacgagcgtatccgcgcgatggcggtcgacatgctctccacgcaggttgatgcgccggccggacaggtgagtcgactgctcagcgccggatatccgacgccgaaactcgacactcgtgcggccatcttcgatgaagaaggcaggatcctcatgacgcatgagaacagcggggaatggtcactgcccggaggctgggtcgacgagaaccagtccattcggtccaacgccgtcaaggaggtcaaggaggagactgagctcgatgtgaggggcgagcgactcatcgcggtgcaggactgcgccaatcacaacgcgctgacctatccgtacggggtgctcaagttcttcgtattgtgcagccgcgccggcggttggttctcggccaacatcgaaacgacggaaatccgctacttcgaggaagaccggttgccgcggctttcggaaacaagaaacaccgcggaacaaatcgctatgtgttttgcggcccaccgcgatcccgactggatgacgctatttgagtgaaccccgtgaaggcatccgcacatgcgcgttgcgcggtgccgcctggtcatcgtgccgacggcgagcatcggttccgaacactgacgccgaaccgtcgaagccgttcctgtggaaaatccgtgtccaggccatgcagaaccaggtggccatcgtcatgtgcaaccgggtcggcaaggaaggcgatgtgacgttcgccggccaatcggtggtggtggacccgtacggcaacgtcgtcagcaaggccgacgaccaagaacagttgattatcgccgacatcgatctcacacagaccgcagcagcgcgcaaacagcggccattcctggaactgcgacgacccgaatggtacgactgaaggggcgaatgggcaataagcaatgtcacgattcgccgcacccatcagccgcattcgtgccggcctacagatacatgaccatacgcagattgcagccagctggtgcaaggcgggaatgtgaagtcattgtgcgtttgcttcgcgaagccgcgcaatgccggattcaaagcagctgctcatcattgctatggatgcgggactgaatggtcacttctcttggaccgccggtctcactgggagctagcgcgtcaccgtcgttgttccagaagcgcaatgcgccttgtcgggtctcatcgttgacggatagcaagagatctccctcaaatagtgtgcgtgctgtgcgatgctccgaacgagcatcttgatgttctgcacgaagcatgaggttcctgccccaacgatccggcatgcagtcttgaaagatgcgatgcatcgcattatgctcggccgggaacgttccgggggagaggggcatctctggacagagggatactgcgtttgaagagcgcatataggccgtatcgtatgtgaaatgtgccgattcgatgccgcgcctgatactggtgaataatttcccgacggtgacgtctgtgccgttgaactgcagggtgacgattgcttccatgatgtgttgcgcctcctgctgtactatcgaatacgttttggagtgtcttcgtcggcgcgtaatttgccgatatctgtgttaagagggtccgtcgcttgctgtacgccgtccagcagtccaagcagacgagcaatgcggaggaagttctcaaagctgccattacccgtacgcagcattttggtgaccgttggcatggataatccagcccgctcggccagcaaggctacgggaatgcgctgttgtctgcgcgccaaatcgaggttggcggatatctgacgcatcgcccgactgaccgggattggtgtgcgtgtcggcatattggcacctcctatcccaaatttaaacataaatttgtatggactagccttatgcggaggttacgccaatatacgacaagaacgaaccaacgtcagcccggaatcttttcgacgatggtgttcaaggtgtcgaaagtctcatcgatttggtccactacctgcttgccctggttgaccatttcggtgatctgttccgtgcggggttgcggcagcgcatgaatcgacgtcttgacgcgcttcaagaccgcaccggcgtcggacaggtcctgcttgatggaagcgattttgggaatggaaagcgtgccgtcggagaagttcatgccggacagcagctcttcgatattgaagtccaccaacgtgccctgcgcggcactgtcgattttgggcagggcgttggtcgcggcgtcggcggccgcatccagcatgccgcgcaccgccttcacgtccgaaccgtaatacagcacgtattcggcggcctgccatagcatgccctgggtttcgtctcgcgccgcgacgatgtgactgccagcgctgtccatctgctcaagcgcctgcttgaagtcgccctgcccgacggattgctgtgcttcagccgcatattcgcccgcctgctgcgcctcgccgatcacccgttgtaccgactgccagaacagccagccggaaacgcccgacgccagcagagccgcgaccagtatcgtgagaattacggtgccgatatgtttgcgcttagccataggaccaatgtaccttttgtcccatctagcgccattgtgttctggcctttagtccatcaaagtgtccaacagacttgtcttctctgaagaagcgcatggaaatcagttatagtcgattctctcctgtagctggcgaaaaacagatatagttgaattggactaacgggttttatgtagggatgccgaggaggacaaccatgaatcaggggagggctcgactggaacgaattcggtgatggagggctttgcgaaatccccggtcaatcgatttgctgactggttgggatggggattcgtcttcctcggagcgggtataggagcgtttctgggtgtcgtcgcgtacgttcaacactggattagctgacggcttcgaatagttctccgaccgcttctcggatttgccgggtggcatgaggttttcgaccgctcacgtagtggcggcgacctcacgctaatcagtaatacacactttgatctagcagaccctacggctaaggctaggaggccgacgatgggaaaccgcgtatggaaaggtgaaccttccgccggtggccgggccggaacggtcatcgctttgggcatcgcggcgttggtagtggcgggagtatggttcggatggactcgatactagggctatagtccggtttcgaatctgtcgcagacgttctcgatctcattttccgaggatgcgcgggcaatcgtcagcaaggacgaggaaagctttcatggggacggataccggtacgtgaaggtcgccgctgacccagaacaagtcgacggcaccattctggacggcagggattactccagtggccaactgccccaggagaacatccgcataatcaaggaagcggatgcgaccctgcgattgaacctgggaacacagctcgatgcgctctacgaccggcctcataaggagataaccaacgagggcggcacgctgatcatcatccatgatgccgattcctcggaatggcatttcttcgaatgcctcgtctgaaagctgagcactcccgaaacatatgcgattgtcctgaagaagagcccagaccaaccaagccccgattatccagataaaaagaaacccccagtgcatcacggctgagtcgaagaccgtccggagaggccctttgggggaattcttgatatatcataatgagccatgagccgacagtcaaattcaacaactgatttcctctcacggactccaaggaaaggaagtccgcgggagaaggcgctgcgcgcgtgcattaccgatgaacggcttgccacctacaattatgaggctcaaagacgttcatgcccagcgctagagctgtacctgtgggatcacgacatggccagcgcctgtatgggcgacatcgccatcctcgaggtcgctctgcgcaaccgcatggaccggcaactctccctcctcgctctggagcagaatggcactgaagactggtatatggcagggctacaattcgatgaccgaacccagtaccagattcgtgaagcgtggaaccatctcaccccgcaccagcgaaaaaatcatacgcatggccatctcatagcgtcattgacattcggattttggcgcaatctcttggaagacggcggaacaatccacacgaagtggccagaccagcgccgtgcagattatgagaacgatttatggcgcaaaggactcgataagacattctccaatgggcgccagtatgcccgtgcagtggaagaacgctggacgagaaagtacgcgctggatatcgtaaaaacagtgcatgccctgcgtaatcgggtcgctcaccatgagccgcttgtcaacggcatacctctgccgggtgagaatcgacggattgcattggagaatgcgacgcaggcgtgcttcgctctggcgatgatcctggaccgagacctacacgcatggttgatggataacagcaagatgaaacttgtgctcgaacacgagctgaagcctaatgaataggtagtgagtatcgttttcgccaatcatctcttcagtgggaatggcaatgagctgcagcgacaccaacagattccttaggatccgacaccggcacgtccggcctggtatgcgggttatggcaatgctcgatcgccaccgcgggcgaacccgtgccccacatgacatggaagtccttggatacggccgagatcatcacatcgcatccagggcgaacggatcattgtccaatacgggcgatacggatcgaccgcgccgcagccccggtcatgtcatcatgtcccatgccgctcatcgtggccacggtcgcagccggacaaaacctgctatcatgcgattacttgacacgatgttgcgcttttggccatgcgcaggttgaatgggattgcgccacgaaaggatatgccatgaacgatctgctgattatcgacatgctgcccacgtacgggctgctgttctacctgctgatctcggtattcgtcttcgtgggatgccgtggtctgcgccggaggacctcggatcgtggcctgctgcgttttgccgtaggcgcgttcttggttgtttccgcgctcggcgccgtgttcgctgcgctggtgtatatcatggcagcgcctttggcgcagccggatatggtcgacttctaccgcatgtaccggccaggagctctgatcttcctgctgggattgttcatcatacaatttgtcttcggcgtcgctgccgtgtatcggggaaagtaacctggtatatcctgcgataaacgcattggcagacacttgctgcctatctgtaaacacaccctagataaggcttgcggccgttggccgagcacagtagtagtgtggtctgctgtgtcaacaggaggagtgtgaccaatgcggctgattgagacatggctggcggaccaggaacgcgcgtttgacttgttcgcgaaattcccggcggaggagacgggattcgagaacccagcggccggcatgaatcgtgaacggttcgccgcatatgtgcgagggttgcgtgatgagtcgcttggcgtcggcctgccggacggctgggtgccagccaccaaatacattctcgtcaacgatgagggcgactatgtgggcatcttcaacctgcgtcaccggctcaccgacttcctgcgcaacggtccgggccacatcggctacggtgtcgcccgcgaataccgcggtcacggctacgcgaccgccgggctcaagctcacgcttgccaaggcccgcgagctcggcatcaaggaggcttacctgagtgtccacaaaaccaatccggcaagtcttgcggtgcagcagcattgcggcgcacgtatcgaccatgaggacaagacggaatactacacacgcatcgccacctgcacggagagcgatggcctctatgcgcgaggcgattgacggcgcctcttgcgtgtaaatggccgattatcaatcggttttaatcgatttcgcctcggtcgataaagtcgccgtcgaggaaccaataatcgtgcggatttccgcgtaacgccatgaacggcgtgagttccacgccctgtgtctcagctctgctcagcagataggctcggataatccacggatactccagcacgcccgacttgagggtgatgatttgctccactctgctgccgctgacgccaaaatccctgccgccgttcggcggtcagacccagccggctcatgttctcctgaaattcgcggatagtcgccgcgcgttgctcactgttcaaagacatggcttcatggtagcgccggacgcgtgtgggaggtcgggctgctcactggaatacgccgtcagagtagttgatcatttcgagttccgggcccatgtcttcggtttgagtcaggccggtctcatggaagccgatgtgacggtagaaaccttgggcgttggtgttgaatccggcgacccacaaggcgagccgatcgttgccgatggcgcgttggcccgcctcaaccaaagcacggccaacaccatgacgatggcaagattccaacacatatagcgaagccagttccgcagcctcggaccgtttgattggcgaacgcggcgtttgcagaagctcagcaaaaccaatcacgtggttgttctccaaagcgaccaatacgacctgattggggtctttggcgtggctgcgcgtcagtttgagcgcgaattcgggagtgatcgcatccacgatttcctgcggaatatgcccctgattgagttcgcgccacgtgcacgactgaacttgggccttttcctcaaaccatggcggctcaatcgaaacaatacgaatcgtcatgccgcccatagtaggccggttcgtgagtacagtgtcacttgttgtcatgtgattgcttggcatcaggttgtattgaccgtaatggaggccactggatcagcgccggaaactcatggaattcgggctattatgatgggagtaagaaaagcacagcacaattgaacataaagacgatctggagcattgcatgagcgtcaatacggcatttgaaaccagtgatttgcccaaagcggagtttatgtttcctgggcctgaacgcgatcgcttggtgaagctcattctggacggcgtaaaaaccgccaccgctgcgctgatgattgaatatgaggaagaggtcgaaccgctgccgtgcgttggcgcgcattcggtgttggtggattccgatgaacgacccgtagccgtactcgtcaccactgcggttgacgtgattccgctcggaaaagtcactgaccggtacgccatcgatgagggtgaaggcgacgtcacggcggcccaatggcggagcgcacacgaatctttctggaattcggcggaataccgcgatgaattcgccaacccaaactttccgttgaacgacaactcgctcatagtattcgagcatttcgaagtcgagcaacggttggagtcgaataacgcattaggttaggcgatagcaaaacttttcttcaggcaactctccgagctccgcaacatctgaaggagtgcccatgtccactagagcgacagaagcggaaagcgtattgaaggagcatatgggatatcttccggtatcggaaatggagcgtcgaggagtttcccgcacggagatttcgcgattcgtgcgtgaagccaagcttgagaaagcggcaaagggcttatatgtttcaccgaatgcggagtccgatccgctgttcgaattgcagtatcgatatccgaaagccattttttcgcatgaaactgcgttgttcttgcttggagagggggagcgagccccctgacaccgacgattaccttaccgcaatcatcaggtacggctcgtctcaagaatgaagacataacagtgagaaaggtggccgacaatcgctttgcaattggcctggcgtcggctatcaccatgttcgggcatacggttcgcgtttatgatttggaacgaaccatttgcgatttgttccgctcccgcagcacagtggatccgcaagatttgcaatccgccttccagaattacatgagatccgcgcacattgacttggtcaaactcatgaactacgctcacgaatttcggctcgtgaacgtgatgcgtccttacctcgaagcggtgatgccagcatgaatgagagtgaaatcagacccgtgggacgcttatagaaagcggtacggctatgccgcgtgactattcttttagcgatgcaatacgggcgttgtcggctttatgcgaggcgatggccacggcataatcggcagcgaagcatacgcgtattcatgcaacggcaagtcgtacatcatatgtgcatcataaggaagaagtatttacccacgcagccattcgacgattgtcaggatgcattgctcagcgaaacaatccacggcatcgacggtgatgccggcatggttcaccggcgaattcatcttgtaggcagattcagcatcttgtaggtagctggccttggcgcgaggtcattgcaatggcggtattccgatcatcgccattggaatcatctgcctacaagagcacgaaacaccctacaagatgagacgggccagttgggtcagtcccattcatcctgccggttcgcaggccgcaattgtcagtcacaactggtgtacctccctcatccatgcgaatgatacgaatcgcctttcatcccaatgatttcgctctcgtggccgatacccgcgtgccgtcatgttccgtaccttggaatcagaagtcgagagatatggtccgaaaccgaatggagcggaccgaagcagggagcattgaagatgggatttctcaagaacttttccgaaccgtttgcgttcgcgctggcattgtggccgtttgtgtccatgctgctgacggtgccggtgctggcgttgctgtatcatcgcgacaatcgcatccgactgtcgtcggccatagtggcgtatggcacggtgctgtacctgctcggcctgctgtgcttcacactgtatccgatgccggccgatgcggcagcctattgcgccgcgcaccatctgacgccacagctcaatccattgcagttcatcggtgacatccgtaccgatggtctcaccgccgtactgcaaatcgcgtttaatatcgtgttcttcctgccgttgggcttcatcatgggccgtatctggcgttggccgctgccggttaccgcagtactgtcattcgccacgtcgctgtttctggagacgatgcagctgaccggcctcatgggcgtgttcccgtgcgcctaccgtctgttcgacgtggacgatctcctgtggaacacgaccggcgcgctgatcggattcgcgctggccatgctttcgctgcgcctgattccggcgcgggtcgccgatatgacgccgaccaccacacctggcttcatgaggcggctgatcacgttcatcatcgacatgacgctgatcgggttcgccgtgatgccgacgcatctgttcgtcatgatcgtccgctcaaacctgccctcgggctccaacggctcatggcagtcgatggaaccgttcgactggaccggctcgatcctcttcctggcggcgctcatcctcttcgagggcgtggtgccatggttgcgcggcggctgcacgctcggcggcagcttcacgcacatgacgatagagacccggccgcgcgaagggtggcttcgcgtggcgttctatgtggcgcgcatggcgacgctgatcgccgtggtgtggtggcatagtggcggattcaatctgctggtgttcatcggcctcggcatcttctggctggtcaagcgtcagatgccgtacgacctgatataaaccggcgctccgctgcttggcgttacaggaaaacctccgaccactggtcgggattcggaatgctgcgcagcgggccggccaacgatacggccaatcccgctacggaacagaccacggctacggccatcaccgccgtgaaaccgagatctggctgttgcaacagccagccgaccatcgccgggcatgctgcgcccagtatgccgaccgtggtttcaaatacggcagaagcccgcccctgcatgttgtcgggtgtcttgccgtagagaaagcccagcaggccagcgttcaacgcggggaacggcaggccggccagaatctggcagatcagaatggccgcgtagctgtgcaggaatagcagtggcatctggctgaccacgaacaacgtcagcgcgcccgcaatcagtttccctgtgggaaccatatcgactagcttgttggccaacagcgagccgaccaaagtactcacgcccattgccgtgccgagcagtccgatcatgaccgcgttggcgccacgggcggccaacatgatctgcgcgccggtgatactggctacgcaggcgatgttcacaattgcaccgagtatgatcgcggataggaaattccttttggtcagggcccatcgccagccttcgaccaagtgcgtgggaaatggcacaacagaagtgccgtgggcccaaacggcgaccacggcttagcgcgacgagtcaacgcgcattagctgtctgcgaacgacaccaacaccttgtgcataacaatgcccctttgcaaaaaaacaaactccaattattgtaccagttcgagcatagaaccaggcgcgtcactgggcacaacataatcggccatcaatggtttctcggcttcgaggggctgatttcgtccggtggggacatctacttggctttcgaggggctgctcaaacgccaaaccgcgagtataaacggctttgcggcaacgccattacgccattgtggagccttgtctactcgggcatcagccccttgaaacggagatagatctccggcaagtgccaaatcagcccctcgaaatcgagttaggcgttgttttcgcgtttgcgctgccgttcgagtgcgtaataagccgcgtagcagcaggcgacgaacgggatcatgcaatacagggtcgaacgctgcgtatcatcgagcaccacgagcaccagcgcgccgatgcacatcacgatggccagccacggcagcaccgggaaaccgggcgcacgatagccgagctcatcggcgctgtgcccatcccgcgcccattcgcgccggaaacggatatggcacacgcatacggagaaccacaccaccagcgtcgccaaacctgacacggcgaccaacaccagatacacggtcgaggcggcgatcacggaagacagcaacgccagcagtgagcccgccatgctgaacagcacggcccacaccggcacaccacggaaattcgtcctagcaaaacgttcgggaatcagccgctccttggccagcgaccacaccatgcgcgaacacacgtacaggccggagttcgcggcggaaagcacggccgtcaacaccacgaagttcatgatgtcgccggcgaacggcataccgattgactggaacaccagcacgaacgggctcgtatccacgccggcctgatgccaggggatcaaggccgccatcaccagaatcgagccgatgaagaaaatcgccaggcgcagcaccgtggtgtgcacggccttgggaatcgcacgcgagggatccttggtttcgccggccgccacgcccaccacttcggtgccggagaacgcgaacaccacggtcagcaaagtcgagaaaatcggcgcgatgccgctcgggaaccagccgccggccacgaagttgcccagcaacggcgcggaatcatgaccggcaatcggtatggcgccgaagatcgccagcaggccgatcacaatgaacgcgatgatggcgaacaccttgattgacgcgaaccagaattccgcctcgccgtacagccgcacggacatgatgttgagcgcgaacaccaccacaatgaacacggccgaccacacccaggacggcgaatgcgggaaccatcgctgcatcaacagccctgcggccgtgaattcggaggcgagcgccaccacccagttcagccaatacaggatggcgatggtgaacgcggtgccggggccgatgaaccgcttcgcatacatgtggaagctgccggcgtacggcatggccacggacagctcgcccaacgacaccatcacgcagtagacgagcagggagccggccgcgtaagcgaggatcgcgcccaacggtcccgcctgatgaatcgcgtagccggagctgacgaacaggccggtgccgatcacgccgcccagggagatcatcgtcaggtgacgcgactccatcttccgttcaaggccggtatcgtccttgggtgtgccggctgccgccatgctcgggtctcctttggtcgggtgaacagttgtgtctcgtgtcggttgtgcgggcggcgctcgatgccgcctaccatatgatagcggtaacacgaacagcgagtggaacacgaggagtttggaatgatggaactgtatatcggatcgcatctgtcgacggccggcggatggaatgcgctgctggaacgttcccatgaggagggcggtaccgcgttcgcgttcttcccgcgttccccgtacggcaagcgttcgaaggcgctcgacccggccggcgcggcggcgttcggtgcgcgtctgaaggctgagggctatgggccgttggtcgtccatgcgccgtacgtctacaatctagccggcaaggatgaggccaagcgcacattcgcgatcgaggcgttggccgaggacatcgagctgctgaccgccatccgcgaggccggccaggaggtgtatatcaatattcatcccggcgcgcatgtgggccaaggcaccgagaccggctgccggctgatcagcgagggactgaatcaggtgttcgagcgtacgaccggcgtcatggtgcttctggagaccatggccggcaaaggcacggaatgcgggcgcaacttcgaggagctcgccacgatcatgaacggcgtggagaacaaggcgaacgtcggcgtcacgttcgacacctgccatgtgttggatgccggctacgatttggtgcacgactacgacggtgtgatgcgccagttggatgaggcgatcggcttggccgaggtcaaggcgattcacgtgaacgattcgcagtttggcctcggctcgcataaggatcgtcacgccaacatcgggcagggtcagctcggcatcccgttcttcacgcgactggtcaacgacccgatcatggccaagctcccgatgatcctcgaaaccaaggagcagacgcccgccacgcatcgcgacgagatcgagttgttgcgcggattggtgcaaaagtagtcgtagtcgaccaatgtcgagcagaagagacctgtttttggctgagggccatacgaggttagctatcagcggggcgttgattgatccgtcttcatatacagctgcatagccggttccagctgcaagagctcaaaacagacgcatgggttcggtggaatccaatggctgaataagacgtttgccgtcgctgttcagtggcgcgacttcgtgaaattgcagacgccgggaaagcatggtacccgcttcccgcatggaatctaacagtgcggctccgtcaacggagcggtccagccatgaggcaaccatgttccgaggagccagcaggggcatgcgatcatgcaccttgacgaactcgtccgcggcagggcaggtgatgatggttgcggtcagctgccatggcgatgcgggagacggcctccaccatgagtacaggccggccaaagacaatagttcatcatgtggcgcgtgaaaatagaacggcctgcgacctttccattcgtagtagccggaagcggggatgatggctcgcatggattttgtggattcggtgaacgccggcttgacatgcgcagactccacacgcgcattatatgtggggtagctcagcactttgctggcgctccatcgcggcaccagcgaccaataggcaccggtcagatgacggcggccatccttgccctgtgccaccacgccaatgttctgcgtgggtgcgatgttgcaggaaggctgtggcagagtgtcaacgcgcacgtcatcctcgtctaccgcgaactgtgaggccacggcatcccaatccaagtcgagcgcgaatctcctgcacatgcgctcagtttatgccatcaatggaatcaatcccaggccgtatgaccgatattcatggcgattttcctttttgttggccgctctggttccgtagcgatacgaaccaacgaggaatagcccagaatgtaggacgggttcggcaatcgggacaggacgtgacctagagtggcgcatgaccgaacaccaacaaagggaggaccatgtcggttttggacgaactggtggcgggagcgctggaggatcagcgcgcccgtgagctcaccgtatcgcttgaggacgtgaagaaggccgcgctggcggccccggctccgattgacgcgacacgatggcttaagcgcgccgacggcatccccgtgatcgccgagatcaagcgcgcgtccccgtccaagggccacctgtccgacatcccggacccggccgcgctggcccgcgagtacgagaggggcggcgcaagcgccatctccgtgctcaccgaaggccgcagattcctcggcggccttgacgatttcgacaaggtccgcgccgccgtgcacattccggtgctgcgcaaggacttcatcgtcaccgactaccagatcttcgaggcccgcgcccacggcgccgatctggtgctgctcatcgtcgccgcattggacgacgcccagctcaagcatctgctcgacctggcgcacgagctcggcatgaccgtgctggtggagacgcacactcgcgaggagatcgaacgcgcacgccaggccggagccaaggtgatcggcatcaacgcgcgtaacctgaagaacctcaaggtggacgtgaacaaatacaacgaactcgcggccgatctgcccgataacgtcatcaaggtggcggaatccggcgtattcggcgcggtcgaggtcgaagactacgcccgtgcgggagcggacgcggtactggtcggcgagggcgtggccaccgccgatgatcatgaacttgcagtggaacgactagtaaaggcaggagcacaagtgaaagcatccgaaacgaccccgctcagcgaacatcagggaccgtattggggccagttcggtggccgctatgtgcccgaggccctgatcaccgccctcgacgagcttgagcgcgtctacaatgaggccaaggccgaccccgaattccacaaggaattcatgacgctccagcagcgttacgtgggccgcccgagcccgctgaccgaagccccgcgcttcgccgcactggtcaaggagaagaccggtctcgacgcccgtatcttcctcaagcgcgaggacttgaaccacaccggtgcgcacaagatcaacaacgcgctcggacaggccctgctcgtcaagcgcatgggcaagacccgcgtgatcgccgagaccggcgccggccagcacggcgtggccaccgccaccgtgtgcgccatgctcggcctcaagtgccgcatctacatgggccagatcgacgcccgccgtcaggccctcaacgtggcccgcatgcgtatgctcggcgccgaagtggtcgaggtgacccttggcgacaagatcctgaaggacgccatcaacgaagccctgcgcgactgggtcaccaacgtcaaggacacgcactacctgctcggcaccgtcgcgggcccgcacccgttcccggccatggtgcgcgacttccagaagatcatcggcgaggaggccaagcagcagctccaggactggtacggcatcgaccatccggacgcgatctgcgcctgcgtgggcggcggctccaacgccatcggcgtgatgaacgccttcctggacgacgagcgcgtgaacctctacggctacgaagccggcggcaacggccccgaatccggcaagcacgccatccgcttcgcccccggcaccggccagctcggcatgttccagggcgccaagagctacctgctggaaaccgacgaaggccagacgctcgacacctactcgatttccgcaggcctcgactacgcttccgtgggccccgagcacgcatggctcaaggacattggccgcgtgaactacagctgggccaccgacgaggaggccatgaacgccttccgcgacctgagccagaccgagggcatcatccccgccatcgaaagctcgcacgccgtggccggcgcgtacaaggccgccgccgatctgaaggccaagggctatgacaaggccgtgatgatcgtgaacatctccggccgaggcgacaaggacatggccaccgccggcaagtggttcggttatctgaccgacgaccaggccgccgcgctcgatgtggccggcgcccacggcaatactgtcgcctgaacaagaagaggagatttttgattatgaccaatgaagcaaccacgccgtccggccagccgctgggcatcagccacaagcccagcaagtcgggcgctatgttcaccaagttcaaggccgagaacaagcccgccttcatcggctacctgccctacggcttccctaacccggacgtctcgcttgacgccttcaggacgatggtcgagcacggcgtcgacgccgtggaaatcggcctgccgtactccgacccggtcatggacggcccggtcatccaggctgccgcctccatcgccctgaacaacggcgagaccatcaagcgcgtgttcgaggccgtcgaaaccgtggccaacgccggcggcgtgccgctcatcatgagctactggaacctcgtgtaccactacggcgtcgagcgcttcgcccacgacttcgagaacgccggtggcgccggtctcatcaccccggaccttatcccggacgaggcgggggagtggatcgaagcctccgaccgccacggactcgaccgcatcttcctggtctccccggactcgtccaccgagcgcctcgaaaccgtggcccgcaacgcacgtggcttcgtgtacgcggccgcccgcatgggcgtcaccggcgaacgcgccaccatcgacgcctcgcccgaactcctcgtggaacgtacccgtcaggccggtgccgagaacgtgtgcgtgggcatcggcgtgtccaccgccgaacagggcgccaaggtcggctcctacgcggacggcgtcatcgtcggctccgcgctcgtgcacaccctgctcgcggacgacaacaagaccgcacgcgacccgaaggaaggcttgaagctgctcgccgccaagagcgaggaactggccgaaggcatccacaacgcccggtaaacacccggtgcgcctcacgcgggttgtgccgtgacacggtagggtagtcacagagcgtcaagcacaacccgcgcgtggacacacaccatgagcaccagcaagtagaggcacgatgaatctggcttatattccctcgccgaccttctccaagttcgagatcggcccgttcactatccacatgtacgcgatctgcatcctgatcggcatctgcgtggccgtatggatcctcgccacacgttggaagcggtacggcggcaccttcgaccagattctcgataccacgctcgtcaccgtgccctgcgcactggtgggcgcgcgcctttaccactgcatcaccacgccggccgactacttcccgcccaccggcaacttggtcaacatcctcaaggtgtgggaaggcggcatggccatcttcggcggcatctccgtcggcaccttggtggcgttcctgtggtgccgtcacaagcactatccgttcgcgatcttcgccgatgccatcgcccccgcgctgcccgtggcccaggccatcggccgactcggcaactggttcaaccaagagctctacggctggcccaccacgttgccgtggggcctgaagctcaacgacgcggacgccatcggcaaatccgaaatctgctattctggcgcgcaatgcccggactacaggaccacgctgttccacccgacgttcctgtacgagatgatctggaacctcattggcgccgcgctcatcatctacctcggccacaagcttgccgaccggctcaaggccggccagcagttcgccatgtacctgatgtggtacggcctgggccgcacctggatcgagaacgtgcgcatcaactattccacggtgatcctgggcctgaggaccaacgtgtggaccgcgatcatcgtcttcgtgctcggctgcatcctgttcgtcgtgctctaccagtacgggccggaccccaaggcgcaggcgcgcgggcttgcggcggtcaccgccgacgagctcgaacgccagagcatcgaagaggaacaacttcgccagaaaaagcaaaccaatcgcactaagtgacaccacgataaacagcgccgaaacagcgcgaaacacggggctccaagtcccattgcacagataaggtaggaaaccatgagcaatatcgcaatcgcacccagcatcctgtccgctgacttctgcaacctcgaacgtgatctcaaggccatcgccaacgccgacttggtccacgtcgatgtcatggatcatcatttcgtgccgaacctgaccctgggcgagccgatcgtcggccgcatctgtcaggtcaccgatctgccggtcgacgtgcacctcatgatcgaggacccggatcgttgggctcccgaatacgccaagctcggcgccgcctccgtctccttccacatgggtgccacccacgcccctgtgcgtctggcccgccagctgcgcgagatgggctgcaaggcctgcttcgccgtgcgtccggccgaaccggtcgagccgatcttcgatatcctcgacgagttcgacatggtcctcatcatgaccgttgagcccggcttcggcggccagaagttcctcgacaaccagatgtccaaagtccgccgcctgcgcgatgagatcacccgccgtggcttgaagacccgcatccaggtcgatggcggtgtgagccccaagaccgcgcacatcgtggccgaggccggtgccgacgtgctcgttgccggttccgccgtgtacggcgccgagaatcctgcccaagccatcgacgacatccgcaccaaggccgaggccgcgttcaaggcctgagctccaagcctgaaccgcaatccacctttcattcataaccacaagaaaagaatctgaatcacatgaagacgtttgaatccctgttcgccgaactgtccgaaaaggcccagacccgccccgaaggctccctgaccgtcgacgagctcgacaagggcacccacttcatcggcaagaagatcatcgaagaggccggcgagacctggatggccgccgaatacgagggtgcggaccgcaccgccgaggaaatgagccagctgctctaccacgtccaggtcatgatgatcaagcacggcctgacgcttgaggacgtctacaagcacctgtgagaggaacgcaaatgctgagaatcgcagtgcccaacaagggcatgctatccgaacccgcgtggaacatgctggccgaggccggctaccgtctgcgcaccaaccctcgccagctggtcgtgcaagatcccgacaatggcatcgagctgttctacctgcgtccgctcgatatcgccgtatacgtgggccgcggcgccatcgacgtcggcatcaccggccaggatctgctcaagaactccggtaccgccgcgctcgagcacatgccgctcggctttggtacttcgaccttccgtttcgccgcaccgaacgaatccccgatcaccaccctggaggatattcagggcaagcgcgtggccaccacattcgataagcttgtacacgactatctggtcgagcacggcatccaggccgagaccatccatctggacggtgcggtcgaatcctccgtgcagctgggcgtggccgacctcatcgcagacgtggtctccaccggtaccaccctgcgcaacgccggcctgcgcgtgtttgccgaaccgctcatgcactccgaagcttgcctgattcgttcgccgcgtctgaacgagcaggacccacgtctggccgtgctgacccgccgtctgcaaggcgtgctcactgcgcatcagtatgtgctgatggactatgacattccgatcagcaaggtcgccgccgccgtggccgtgacccctggctttgaaagcccgacgatctccccgctgcacgacaaacagtggaacgccgtgcgagtcatggttcccaaggccaaggtcaaccagctgatggatgatttgtacgaagtcggcgcacgcggcatcatcgttaccgctctgcaagcctcccgcatgtagactgttagtcgatatgaccaaccagaaagtcaacgccagatacagtccggaagcacgtgacatctatttcactgtgcccaatttgatcagcgcgctgcgaatcatctcgattcctttcatcagcgtgctgatctccaagcacgagatgattgcggcgctagccctgatcgccatttcctcggcttcagacggacttgacggcatcatcgcgcgcagattcaaccaagtgagcaagatcggtcagattcttgatccgatcgccgaccgactgctcattttctgctcgattctggctctcagcgtcgccggcatcatcccatggtggatgctgattatcgtgggactgagggatctgtggatggcgattcaggtgctatggcttgcccagtacggttatggtccgctgcccgtgcatttcgtgggcaaggccggtaccgcgctgctgatgatttccatcgtcggtctgattttcgccgatttgtgcaccagtacgtttttccacttgctctacatcgccgcgctggccgccggcatctggggcatcgccatgtattggctcgccggatatatctataccaagcagggcgtcggattgctacgcaaggaactggggagaagtatggcgcttgaggccacggccccggtctcattccccgtacccaaggagaatgagccggtacgacgccgcgccgtgttctcccactcagtccgaggcgcggaatcacatcatgcgctttccccggatgacgccgccgccatccgcaccagacgtcgccgtaaaaccaacgacgattcgcttcagctcatcgatgatcttgtcaatcgtccgatggatccgatgttctccgactcacgactggtccatgagcatcgttcgaccttctccatctggtttaatcgcatcgtcgtattcatcatctgcgtcggcgttggctttgcctgcagcctattcgtgcaacagttgcaatccgatccgcgtaagcaggtacggcagactttggccacgcaattggagaatcgcaactcgcaaatagacgaactcaccacggacgtcaataatttgcgctcccaagttgacgaacagtccaagaaaatatccggcagcgtgaaaagcgatacgcttatccaagacgaaatggtcaatggtgccacggtggtcgaaggcgaaggaatcaccatgacgctggccgatccaatcgcggcaagccagtcggatcaatcctcctcgacgagagtcggcacctccacgaacatccgagtcatcaccgatctggatctgcagcaactggtctccctgatgttccaaaacggagccgaagccattgccatcaacggtaataggctcggcgcgcaaacctcgatacgcaaggccggcgggcatattctcatcggcatgaccgcgatacaaagcccctataccattgaagccataggcgataagagcgccttggccgaagcgatggggaagaagaaacttgcaagtctttacgattccttcaaggaagccggtatctacccgcaggtaagcaaatccaattcgattacacttgaggcagcagtcactggcgaagtgaagtacgcggaaaggaatgaataatggcagccgttctgggactgatcatcggcgtcgtcatcggcgtgttcgtcaagccggacattccgatcatcgtgcagccttatctgccgattatggtggtcgctgctcttgacgccctgctgggtgccgcgcgagcctatttcgagcgcagcttctccgaccgcgtgttcgtgatctccttcctcgccaacgtggtgacggcaacactgctcgtgttcctcggcaaccagctcggcgtcggttcgcagctgcagacagccgtcatcgtcgtactcggcatccgcatcttctccaacgtgtccgcgatcagacgcttcatcttccgaggctgacaagggtactgacgtatggcacgtaaagcacaatcagacaacatgctggagaaaatgcgcgaccagcatgtacaagacaaggtcaacgaccggatggaaaccgggtcgtttcccacggtgcgtaagaagccccggaaggatctcaaccgtgccagcaacaaatcacggttactatcctcgattctcatcgctctgatgtgcgcgttgttgggtttcgcctacatgagccagatcaataacactaaatccacgtacgaaacgatggacgagagtgaactggtaaggctgctgaacgagtcgaatacgcaaatctccaatctcgagcagcgtaaaacccagttgaacagccagctcaactcgctgaaatcggcggctaacgagcaggagcaggcgcgtaagatcgccaagcaaaacgaggagaccagcggcttgatctccggcagactcccggcaaagggtcaaggcgtgaccatccgaatcggacgaggcttgacgactaaagtggacgcctcaatcatgttcaaccttatcgaggaacttcgcaatgccggtgccgaggtaatcgccatcaataacgtgcgcgtcatcacctccacctacattcaggacgccgaggaaggtttgattgtggatggcaccaccatcaagcccacatacacggtgaaggccattggcaatccgcaggaactgtccaacgcagtcgatatcgccggcggtgtgggcgctcagctccaggtgaaatacgggtccaacgtcaatgtacagccttctgacagcatcattatcgacgaagtacgcgaagctacgcaaaaccagtatgcaaagacggtagaataggggattatgaccaacccgattcctagcgcaggcgaaaccaccattatcggcctgcccgcgattaatgtactgcccattaccaccaccggcgatcgaccgctgactcaagaggatctggacaccatcaccagattgtccgagggaacggcattgctgatttccgccaggggagcggtctcaggttctcgttacttgcttgacgaggatgaaatcaccgtcggccgtgatccgcgagctgatattctgctcgacgactccaccgtatcccgtcagcatgccgtgttccgcagggtcaacggtcagttctttgtggttgacgcaggaagtctgaacggcacctacgtgaaccgtcagcgtgttgatcaggcgccgctgaagaacggcgacgaaatcatgatcggtaaattccgtctcgtgttcttcacgaaatccgccattatttcccaatagtccacacccagcacggggttagactgattgcagaaattgcaatcatgtgattacaccagtgtgagtcacatgcgagacacgcatgagttaggggagtgccatgggacagaccgggctgcatcttcatgtttcgcttgaggaccgtcagaatctgaacgctgacgcgattcaggggagttgttctccaacgtcgatactgaggagatcaagcgcggctaccgtggcactgtggcctccaaggtggccggcatcacgtaccgacagctcgattattgggcacgcaagcagattgttgagccgtccatcacgccgtctcatggctccggttcacgacgactatactcgtttaaggatgtggtgattctcgctgtatccaagaagttgcttgatgccggtgtgaatctgcagaacgtgacggcggccatcggattcttgactcaacgcagcaccgatcagctggccaatgtgaccatcatgtgcgatggtcaaaacgtacatgaatgcacaaccagcgaacagatgctcgaactgttgcaaagcggtaaggcagtgttcgccgtgtcggtgggttcgttgtggcaccagattgagacggccttggaacaggaagaatatgttgatcttgaggccaagccgctgacgattgccacgggccgtccgattgatgaactgaccgccatgaggatgcgcaagaagctcgaggcacagcgcttgcgacgcgcaaccgcctgatacatgtatggttgttggcgacttgccggctttggtcggcaggtcgctttgttgtatgtgttgcttttattgcctgccatcttatgttttttatatgttgcggtgattattatgactgattggaggatcgggtgaacgggattgttgtcggattgttgccgggcgttctgtggatggtcgccgtcatctttgctgtgtccatcatcactataacggtcagccgaggccatctgttcacgccgagacgccggcgaccgccggtcgatccggtcgactggtcgatggtgaaaacgcatttcatgtcgtttgcggcggcgctgattccgtttcccgtgttgacgttcaccgcagatctgatggatgctcgcatgctcgcgttctacgaccacgcgcaattgcccggagcaatcatcatattcgtgctggtgctgctggaactcatcgccatgtatctgcaggcacgcaacgcctcagaaaccgaaatggataggcgtttaggtgttgcttctcaccggaataaagatgatattgaataaccgataatgtacgttatgtcagattaggttttcggaagaaaccgggaagtggccaaaatcagcggaaaacggcgggataacgccgttcttcgtgcgcgcgtcatggaaggacggcactcccgtttacggctatatccggctattttcggctggaataggcacacgataggcacacgttcggtacacgcaccacgccgaccggaccgggccgatacgcataccgggggttgtcatcacacgacgaacccggaaggcgacgacatggcggacacaggcggacacgcgacaagacgagacaagggagccggcgcgatcacgaaactcggcaacggcagataccgggcgttcgtcgaactctcccccaacccggccgacggctccagacgacgcaccagcgccaccggccacacccggaccgaagccctgaacaacgcccgcgccaaagcccgccgcatcgaggaggacatcaccctggtggacgaaccgcccaccgtgaacgaatggatgcgacgctggatcgacgagatcgtgacccccagacgcgcacccaacacgacccggtcataccggttccgcatcgaacacgacattacccccgtcatcggcgccgtacgcatggacaggctcaaacccgcccacatacgcctcgtcgaacgccactgcctcgaaggaaaccccgcgaaaggcatccagggcaaatcccccgccacggccgccctgacccacaccgtcctgtccgaggcatgcaaggccgccgtcgccgaaggcatcatccgcagcaaccccgtggacgcggtcgagaagaaccgggtgccgcccgccccaatcgccaccctcacccccggacaggccgccatgctcatccacgccgaaaccgacccgcgatggagcatcatctggcggctcctgttcatcaccgcactgcgcgaaggcgaagccctgggcgtcacgcgcaacgagatcgtccgctccgacggactaccctgcctgctcgtcgaatggcagctcaaggaattcgacggcatcacggacatgcccgccggcttcgaggcccgccggctcgacggccgcacatggctcaccagacccaagaccagatccggacgccggctcatccccctgcccgccgacctcgccgccgacctcgccgcctatacggccgaccatcccgacatcgacccggacaccccattgttccgctccggccgaggcaaccccatccgcaaggaaacactccagaacgcatggcgaaaagcgttggaacgggtgggactgccccgcgtgcgcgtccactccgcacgccacacggcggccaccgccatggcgcgcatcggcgtctccgacctcgcccgccgtgccatcatcggccacgccgacatcggcaccacggacgccatctacacgcacgtggacgccgacatgctcgccggcgccatcgacggcgtggaacgcctcatcgaaggatagtcagtcgatcaccgcgagatcgacgagcccgtcgcccgtggacacggccgcgcccccagtggtcgattacgacaatcactccgcgtaatacgcggccggattgttctgcaggtcaatacgccgccatgctttgaccagttcgacggtaggcgcgtaccgttcgatggccgaccggctaccgtcgtaccgtccggccatatcattgtcaaaagagataacagtgtctgccatgatatgacgcgcttcctttgccgtaatggcctcgcgatgccaattaccgtcaaaaacgtcgtcggcaacccaagcgtcacgttccgccatcgagtcaaacacgtagagattgcccggccatgacccgtcattccatgtcgtgccgataccgtaggtccaagaaaaagtgtaataatagcgagttttaaacatgatgcacactcctcgtatcgtcccgatatcatcgacacgggcatgcatgcgtccccggcgatgtcagaacagcaccggggacgtcggcctcgccatccggcgggcgatgagccgcacgtaatccgaatccatctccgccgccacgcaacgcatgttttcgacccggcacgcctccaacgtggcgccgctgccggcgaacggctccaacacgagcccgtccggcggcgtgaccagacgcaccagccagcgcatcagctccaacggtttcaccgtcggatggcggatcccgtccaccgtcggcctctcccccggtcccgccttcggacaataccggaacacgggatagaagcgggatgcgccgcccatatcgtcatattcggcacccgtatgggtcatgccccagccgtcaccgggtttcgtgcttgcgcgtgatttgccttttcgactgacggtgacgccggactgccggtcaagctctccggccatggtccggtcgaacagcatgttcggcgcgaaccgggcgtccgccttatagtcggtgcgattcgcattatccgcgccgtatacatggttgtcccgcggtccggaaccgaaccgtccatgccggttcttgttcttcgcctcggtctcatccgccgggttgcggaatgggacgcggcatgcgtcgatatgcaacgcgcccgtcccgtgtccgagcagattgtgggcgagtgtcccgtccaacggcttgcgtgcgaggcagatgggttcgtgcgcgggcttcagctggctgtaccagccggaccattgttcgccctgttcggtggcgggcgcatcccattcggatttcgccttgccgccgttcgcggtgctggaacctccgaagccgttggtgtccgaatatcctgcgccagcatgacctttaccggccacatgggtgcgttccgcacccaattccctgtccacgagcagtctcgcatccgaaccgtgtggcatgccgcttgcgtacacccagtcgatctggtcgcggatttcgaagcccgcgtcctcgatcgcgcaggcgagccgatgatatgtgcggctcgcgccgaacgcggccacatgcccgcccggcttcaggacgcgcagaatgtccttccacaggatcacgtcgaatgcgatgcccgtcgaatcgaagcccaggttcatgaaaccgatctcgtacggcgggtcggtgacgacggaagccacgctgttgtccggcagcatggcgatgaggtcgcggcaatcccccggcatcagacggatgcggccgtcatcccatcgcataagactcatggcttcacgtatgcgttcccgccatgcaggcgcgcgccgggcatgagcgcgcggggacgcgcatccacgtaggcgagccgacggctgtcgcccggataggtgcgcacgttgccgcccccatcccgggtctcataatagacgaccgtcaccggccggccgttcaggctcgcatcatcccagccgaccaccctgaccggcatgctccccggcccgtagccgcccgacaggagaagcctggcgagcagcctctcctccatatcgcgtctcgaaacaaccatgggaaccggtatgcgtcacccgacaccatgcaaatccggagggcccatgcaattcttgttccatatgcaattccgaacccgtttcttaatgtccggatcacgtcgcaagccgttgttccggcatgggaacagggcgcgggcttcgatggtcgtatgtcatggcctgccgctgatgtcgagcgtcgccatcgtatcggcgtcctcgccgtccgtgatatatactccgatgatgtattttcttccggccatcacgtcccccagccgaccgggatgtccgcgcttttcgccgtctccaacaggagccggaacagctggatggtatcttccttgccttccatggggtcgaaccggatgccgtcattctccgccatggcggtctccaacatggaagccacctgactgtccgcgccgacgaacgcgaacccggaaccggcttccacccactcccggcggcccacgtcccaccgcaggttcagataccggccgaatccacgatgcatgtccgcgccgatccacacggaacggcagcagtccaggaactcggatgacgtgacatccacgctcaaccccgattcgaccgaaccggacacgaacgggatgcgagccgccagcatggcggccaacggtcttaaccatttcgcatcaccgccggacgcgatacgctccccatccacgatggattcggcgatatgtccgaacgcctccacgatggccgtggaatcgtcggcgccggagggaatgtccccttcgccggtcatgcgggacacgccgtccgggtcgaactcccaatcgtattcgactggattgttacaggtctttgttacaggtttcgtcattggtttccacgatgatgcggtgaacctccccgaccttacggtcggggcttccgtgccttccgcagagttcaatcgggcaatggtgaattcgtaggctgtggtgaggccgtcgtagaaagtgtatttttccaacagttccttgtccggggtttcggagtctttgacggccttgtcccattgttgttccaaccatgctatgaggtcggatttaagttctgactgattcatgtgggggttccttgttgtggatgcttttatgtgtggacgcaaccaatgtccatgagttctgtgaggttcaaatggttcaatccttgtttcctttctgccttactgcggaacgttttctaacggcacgagttcggcgccggcctgtttggcgtgccgctggcagacgccgccgaagctttccccgtcgccctccggccatcgacggattgccacaatgggtttgccgcacgggtacatccaaccgtccgaatcggtcacggtatgggcgcagccaatgtccatgagttctgtgaggttcaacatgattcatcctttccaaagttgaatgctctgccatagtttgaatcgctcggctattgccttcggagattgcccaaacgcattctcatcgtcctctctacctttccccgcaatcccaacggtcgtagcatgcggggcattcgtattgcgcgtattcgggattccacttggcgtgctcacggcataccagacgccagcaggcctcacatatctcgccgcagtccgtgcagttgacgcgcccgcaacaggggcatttcctcgcatgctcctcacataacggtatgccgcaaccgccgcagtggtcagccacgtcatccgactcgtacgggccgtggattgaatcttcgcaggtttcgttcgcgttcatgatggttccttttcattccttgcctaacaggtcaagtccggcgcacaccgtctcccatacggtcttgccgtcgaatgcgatgagcatgccggatatgcagtattcgctggcgtgcggcgcgggctgtccgcagtccacgccttccttgcccagcctgtccaataggtcgcggacggattgcagcgtcttctcgatgttcaacatggttcactccttgtccagtcggcgcacgctggccagcatgcgcgacgcggcctgacggcgcgtctcatacggggtgccgagttcctcgcccagcagccacccctcgaacacggacaccgggtcatgtcggccggagtatttgttgttgcaggattcgcacacatgcatgtagtgttcggccatgtcttccacatccttcgcctcctgttcgtcgccaagcgtgttccggcaccattcggcggtcctgtcgaacttgtctttcaaccgcatgagacggtcggtgcgcggcatgggcgaagccagcaggcgtgccagttcgtccaatgcccgttcctcgcccatgtcggctgtatcgaggacggtgttatcctcgacaagctcgtactgcgtgcggacgatgctgatggtgtcgctgtcgggaaggttgacggtgacctcgtatcccgcttgagggtcgaatgcggtgatgcgtccgaactggtggtcgttgtacacatgccagtccggcagtatgcgggtgacgatgctgaggatgtcgcgtgttttcattccgtcagttccagttcttcggcgcgacgacgatccagccgcgatgcctgtcggcctcacgcctctcctattcgtccgttagccattgctcatgcgtttccgcttcctgcctgtcatcgaactgcttgccatccgaagtggtgtatgcgatgcttgtttcgacactcatgattcctccaactggtatccgatgtggcgcagcgcgtccgtgatggtttcgcccggttcgccttcaagcggtcgcccgccatacttgtcgtatatccgccattcgccgggttcggactggtaggcgtatacggtgcccgccggcttcccgtccggcgccgtcagttcgatcggcttcgattcgccccgctccgaccgccatcgtgcgatgccgtgcttgcgttccatgagcgttaggctcgcgccgtccagtccggcttccagcaggctcatatattggctgtcatcgttttcgcggatatgccagtcatcgccgtagtcgtcctccatgccgatcaggagcaggggcaggccggtgcgaccgcgcccctcgtcgcgcacgatttcgaacggacggtccaactcgttgaacgcggtctgccagacgatccaacccttgtcgctgacgcgcggcgaatccgggccatacccgtcgtcctgccggtcaccataatggaatctgtcgagcaattggtgttcgattttttcgccaagcggcttcatggtcaggttcctttctttcgaaaagcgtggttgtcgcatcctcaagaaatgcggtgaacagatcgtagggttcggcctgattgggattcagataccagtccataggtttatagcccagtttcatgcacgggagtttcgtgccgatataccgggtgacccggatatgccggaatacccatcgtatgatgtcgattccgagcccatattgttccgcatattccttatacgacttcacaatcgaccctttcctccgcttcactggtgcgccttcacgtattcgggtccgtggtagtgcgatcggcatgcgtatcgttcggtgaccggggtttcgagaatccggtccacatccaacgtcacggtctcccgatccgttcgggcgaggtattcacgcagccagtcgccagcgttgaaactgtccgcacaccatgccggatcgtccgtcagctcttggatgcgccggacgccgttcgggtcgtcgaggagcccggggttccagcctgcatgctcgcagaccacgtcgatcagcgggtcaagccggctgatggcgcgtgttctgccgggcgtgacgatcaccgtgctcctcatcgttcagtccttcttctcttcgagatccttgaacatgtcccatccaccgcgtccgatatcggcgtctttgctgccgattacgacgatgccgccgcctttcttgagccgccgcgtgcagactgggtccgtgttctccttgccgtaaatgtcgaagctcttgagcgggatcgcccgcaaaccgtattcgtaatcgtcgttgatgcggtacacgggcaggtcgccgtaccggtcgcggatggcttcgagcttctcgatgagttcggtgatggtcaacgtgtccatggtcggatgcctttcttacgtccgcatcccacgcatgcgtccccggctcacaggcccttcgccttgaggatcccgtccgcctctctggtgaagtcatgccggcggcgcagccgtcccgcctcgtagcgcgcatcacgcgccgtcgggtcgatgtcgcgcgcgaatccggccatcacatccgggtcgatgcggtgcgcgtatcggagcgcgatatacgggtcggccgtccggacgagagcgtgttcgccgcccggatgcttctcgcacgcgatcagccatgtgcccggatcgtcgcaccagccgatgaggcgttccaactggccgggcgtgcactcctggctggcgatcagctggtaggcgacgtccggcgaccatgacgggttcgactcctccatgagccggacgagcatgccgatctgttcgggacgcagtctcgcgctcgcggccagatccgtcatgacgccgtccccgtgctcgaacagggcgagcagctggggtccgtccagggtggctatgaaatcgtcgaatcgtttcatgccctgggtatgcgtccccctaatcagggaaacggggtcagcggctacgccagtatccactgaccggatatccgcttcggatatgagggctcacccagacgccgcccccgccgaaggatgccgtattcgcctttggcttcggcatccttccgtgcagtggctggatgttctcgtttgccttcgaaaccgccttacgcatggattccctcagcgaatcgggcaaaccggccgatgcctcatccagatggtcgagaacggctcccgccatggtccgggcgatatgcgccacacgctccccgtccaaaccggcctcctccgcgaaggcctcccagtcggatggggtgagcagttccgcgaattcgactccgttgatgggcatcgccatctcctgatccacatgaggccatattctggtgaccgtcatgtcgtacatcggcgcgaaacggaacccgttttcggcaagaacaatcgaatagttcttgccatgggagtccgaatcgcccgatgagacgttgaaggcaagccggcgaacccactcgtatccggtttcatcgcttgcatcgaaatgatgcaggaaacggacgcagcttgcggcgtcgatttcatacttggattcgggatccatgcccatggcctgcgctagatcctcgcaatggattcgtctcacgttgtttccatccacgatgcggtcgaaacgtcgggtgatgaaggcctccgtcccattcgcggtgagaacgccatgctcggataccggcaatccgcaaagagtcccgagcgtcagggtggcatcctccaccctgtgactgccggggcaatccctcatttcaggtttgatgatatgggtggaggggatggacgcgttgggccagagccagacaccggcacgtcgggcgagcgtgaacttgggctggcctccggcgatggagaaacggcatttcggcgtatcccgctcatagaactcatcctcatcatcccgtgcgaaccagttgtatccgttcgcacgcacatatcctatctgattgccgatttcctcctcgtcgaggggtttcgcctcgatgggatgatgcgggagttcgggcttgtccgagaatacgagtccgcctactgtatccgcatccgcaagaagtttgaacatgtccgtcgaatccagatggagtcgcagcgccatcctacgacgggcgttctcatcgtcgggaagcaggttttcgagaaaggccgacgccgtttttccggaagctttcccggttctgggcagactgaggcttatcggcgcgccttccttggaatcatagtggaatgaaacacgtccgccggaggttcgtatgaattcccccacatggtttccgtcggcccagacatgcagtcgttctcctcgcatcatgcctccagatattcgggcggaaccctatagggtttgacgccgagtgtggcgaacacacgcagggccgcttccaacggtacgatcccgcgttccgccatatcggtcacgatgctttcggagacgccgcttctgtccgcgatttctgacggggttcggccgatttccgtgattcgtgcggaaataatctcgcccgccttttccaatgagggcatgtcgcgaatgccgtcatgcgatggttcttcgctgatggagatctcatcggttttcgacggcaaggcgtcgaattcgctgtaatccatttctcttccgctcctttccggaaaaagcatgcgtcccgaaaaccagaggattgcgaatcaggctgctcgaaccatcataacgtcgaatgccttattccggcacgcgccagatgacggcggcgtgaagaccggctgcctggccgggttcccgtcgaaaggcatcaggacgcctcccccgtgagccgcgcgtacccgtcgaacaggaccttcaggcgcgtatcgtcatcgtccttcagccatttccccgcgccgaacgccacgtccgcgatcttgtccaattcccggtgggcggcgcgtaggtcggtcggcatgtagtcgggatcgtacaggtctgccagggactggccgggatggttggctcgagccaccagcacgttcctgccggcctcgatcaatgcggcgcgggtttcatcgtcgagggcgggcaggggcaggttgttccaaaccaccgtgttgctgaaacggcagcgtgattccagtcgccctccaatcgtctgctgccatgtcatgaacatgcgtgattcgatgacggcgaatgcgaggccatcccggtcgggactggtgtacaccatgtcgccggcgatgatgtccggcgtgtaccagtcgcaggtcatgtattcccgatcctcgctgaacaccttcgggatcgcaagatagttcatggacggctgatggtcgtcacggaacagccaaggtgtcgcacgatgcctgtaggcatcgcccttcattggagcattgcgacggtattcggcgcatgcgtcgacacgcttcttcaggaacgaggatttcctcagttcccccggctccgcgtccctgagccataggcaccagcggtccgtgccgttgatgagctcgcgtcccatgcgaaacggccggacgaagcgtgcggcgatgggatcggccatggccttggcatattcctcacggtcggcgagcagcaggttgcctccatccaggggcatggaaccggaatcggtgacatcgagaagaggcgagaccggtcccgtcttctggcttcgtttgcctacgtacaggtcggggccgtctatgagatacccgttgatgttgtccacggtgcgggcggtcggttccccattgatgtccgcgtattcgaacagtacgggcgcgggcttcgctttcctgtccaggccgatgatgacgacgtggacgtgcgcgttgtccgtggactgcgcgtcccatgcgaacgtgcggtgcgcgaaacggatatgccagccgtccgcatgcaacggtttgaacaggggttccacgggctgcccctgggtgatcgaattggtggtgacgaatgcgaacgccgcatccggtttagacaggtaggaggcggccttccggtaccatccggtcgcgtagtcgagatatccgtcatactggcggccccacacggtcttcagatcatcggtctgaccggcggtcttggtgacgtgtccgatgaacggcgggttgcccatcacatagtcgcagtggtcgccgggtaatagttcgttccagtcgaggcgcagggcgttgccttgttgaatatgggccgtatcggtgaacgggagccggggcaggccgctgatggtcgactcggtgtcgtccaatgcttgctgttccgcgatccagagcgcggtgcgggcgaccgcgcaggcgaacccgttgatttcaatgccgtggaagtggctgatgctgactttgacggggttgatgtcgtcgccgaggtcgagggcgagttgtccgtccttgtccaaatcggcgaggatccggttctcgatgcgacgcagttccagataggtttcggtcaggaagttgccggaaccgcaggcggggtcgaggaaccggaggccggctatcttgtcgtggagtttgttgagcgcgttggtgcgggaaccgcctgcgaccggcctggcctccgccccctcgagttcggctttcaaaccgtcgaggaacaacgggtcgatgagcctgtggatgttcttgacggacgtgtagtgcatgcctcccttgcgccgttcgtcatggctgagggtttcctccatgagggaaccgaagatgacggggctgatgccgctccagtcgaagccttcgctgatttccagcagggcatcacgcagctccccggtcaacgggggcacgtcgatccggtcggcgaacaggccgccgtccacgtaggggaacgctttcaacggttccggcaggtaacgacgccgcttctcgattggtgtgtccaacgcttcgaacaggtcgtacaggtcttcgcccagacgttcgggcgtggatgccgccacatagtcgcggagcgcgtccggccgaaacaggttcgcgtcctccgcatacaggcagaacacgaggcgtacggtcagcatcgccagcgcatcatgctccgccggatcatcgggatgttcgaagcattccgccaaagagtcatggagtctggcgacccgtcggccggctttgacggacagtttctcctgttggacgacacgggagtgctcgtgggcgaacaggcggccgatttcgttgatgtgctccggcaggccggcaagcgtgaactccgattgcggggtgcgggccaacgggtcggcttccagatcgtagaggcggaatgttccgaaattgcaggtgatgagcacggacgggtgttccgatggcggcaggctgtcggaataccgtttcgcctgttccaccggggtgaccatggttccctgacgtggttccggcctgtccaaatccacgccgaggctcttctgttcgacgagcacacgggcttggatcatgagcgcgtcgatgaacccgtccaatgcggtgcgccgttcgaaccagagcgtctgcctgtcgctcgtgttcgggatgagcagcaccttgtccaacaggtcacgccagtactgttgggtctcggatttctcgtcgcctcgtcccgcccatgattcggcgaacttggccgccctgctcttcagatcatccatgattcccaatggtatccggttttccgcatgccggtcggatatcgaccacatcatgcggcgtgatcgtccataggcaggcttggatccaccggtccggcagccgtttcggatccgcgatcgcgttcgccctgtactggagccgtttcttttcggccggatcgtcccaatgctcgtccagccaccggtcgtattcggcgggagtccacctgtcggcatccagcggggcgcacggccaccggttgatgacgcaatggtattggtcgaaatccgtgcaaagcacccggttctcatcgacccgcagatgcaggagctccaacccgtcgtactggtggcggaagcccggataccgtcggtcgggacgcgtatgcgccctgcctttcgaatcgacccagcgcgcccacgcccacaagggggccgcgtccgggtccggacgcggcatgccggcatgctccatttcgcccatcatccactcataggcggggctgatgccgtcccaccagtccgcgtcgccgtcggcaatcgaccgttcgcgggccgccttccatgagggcgtgtacgagccggaacggtcgaacgcggccctgacatccggccaccgttggaacgaatacagatcgatcagaaaaaacctcctttagtcagcattcccatttgacgcggcgacggtacaggcggggatcgtcccaatcgtcgtccatgaggccggtatccgcctcgcgcacggcgagacggcaacgatcgcgaaccgtatggcggcccacgtaatccggataccggtcatcctcgtagtcatgccagctgtgccagcgccggccggatgggatgtgcgccttccggctctgcgaatacgcatatgcggtcacgtcgccttcaagggtcggcggttcggtcgggtgcatccagttgtgtcgcaggtacgcgtacccgtgctccagcgcctcgcgttcgagcacacggtacggcttgtccttgaacgttcgggacattcgttttttccttccattaggtttgttcgcctagtggaagtcgtgagagagcagcatcgcttttcctttccgatggccaactatacaaagaacaaacgaatagtctttgctgttattgcgtatccaatgtattgatattgtacgtcaagttgacgtacaatacacggtatgacaagcactattacggaaccggcacgcagctcacgcctcaacatgcgcctcacgccagaacagcgccaaaccatagatatagcggcctctctcaaaggctcctccataacacaatgggccatcgaccatctcgtcaccgacgcgcgccgggatatcgaagaggagaccgtcacccgtctgccctccaaggcattcgacgaatttctcaaggcgcttgacagacccatgccgaaggccgcgaaggatctcatcgaaatggaacccgactggatatgagattcaccacaccacggcgcatagagtcctccgacatgctcgatggctttgactgcggcattacgcccattgatgaatggctgtccacgagatcccgttctgccgaaaaacagggaacggccgtcgcgtacgtcacctacgccgaatcaggggaactcgccggattctactctctcagcgcacacgcgatggaacgctccaatatcgccggcggatggctacagaggaacgttcccgagcgagtgcccatgatactgctcggcatgctcggcgtggacagacgtttccaaggcgaaggcctcggcaggaaactgttgcacgatgcggtcatacgttccttgaacatcagctccgaactcggggcgagggccctcatagtggatcccgtggattcagccgcagctagattctacgagaacaacggcttccagcacattccggaatcagaacgaatgttcctcaaactcgcgggcaagcatctcgtctagcattcttggcttcctccatccagcagatcgcacagcacccacagggcgaatcgggcgccgttcagcgcatcctcgggaaggccgcacggatatgaggcctcgacccccgcatgcacgttcccgtccgcatccacgccatccagcacggtgacggccagggtcaggcatcgcaatccgcgttcgggcgtcgcgtccccgcggacgagcagccagactggcggcatcgccatcggcttgccgggatcgaacgaacgcgcctcgtcggcgacgatgcccggtccgaacggttcccgcagttccagcccgtacgtgatgttcccggcacgatattcgagcttgatgcgggccgtcgtgccggacggttcggatgtttcggattcgacggcgtacagccggtagcggatggaatcaagcattatccccatggtagtccgggtgcgcggttcctgttctcgtgggggccgccgcgtgccgtccgcgttgaactgggcgagctgcccgatcgcattgcccgtgttctgcaacgcgccattgagtagacgcacacgctcccccatatcgttggtctccaacgcgagacgcagctggccgatggccgcgttcacctgattgcggtacgtgtagttattgttctcggatggcgccgtcatgccatccgccttcctttcgtccttagaactgatatgcgtttcagcgaatcagctccagaagccctcggttctcgttcctgccgaaccggtgcagtcttgaatattccttgagcgcgtgttcgagccggccgggctcggcccagtatcgttccagccatgcgcggcttttcacctgcttcatgcccagttctcttttgcaatagtcggagggcttcagccgtgtggagccgttcgtgtatttgccgtacatgccctcgttgatgatgaccagcatttcgatttcgggatgggttcgcaggttcacgacctcggccgcatgttcgtaccctcgaggtatgcgcagtacatccgagtccgaatcaactattcggacgatgagcaatggatgttcgccgtatgacatgttgaggaaccggtcgagcatctgttttgattccttgcgcgtgaagtaccatgttccgcgcagctggttgggcacgataaaatcggccggtattgtcagttcccctcgttcgaggagggtcgtgagtatgtactgttcggccacgccctcgcagacgaacagcacatactggccttccgcgttaagcatgcacgtacctttccgcataatcctggagggcgcggacggccgcgtatgagggcgcggtaccgggcacccggttggcgaagaaggagacgctcttcttcaaatcggtgcggcccaggtatgcgcccagattccggagggcgaagccttttccatcgcggacggcgaaccatatcgaatccttgcgggtgaaatggtccagcagctccggatagtgggtggagaacaggagggtggccccgtgcgggttcgtgaccggggaggcgaacaggtccatgatggtgaatacgagctgcttgttgatgctgttctccagttcgtccacaatcagatagccgcccgcgcgcagtgtctccaatgctcggccgaccagtgcgccgcctctcagggtgccggatgagaccatgttgaccagcgagttcggggtgacctcccgctccttgccctcattgcggaatttcagatggattccgtccttgtcgtagtcgaggcgttcgatgctggcatcgaacagcgtcacgacggggcgggccgggctgacggtgagcgtcggggacaccggcagcagttcggtcgcgatgtcggtgtccttgacgaaggccccgcaaatactccggtcgggcggcagataccgtttcgcgtcggcggacagttcgccccggacgccgggcctgcccacgttgcgggatgagagcacggtccaccgttccggatccaacgtgccgttcatggcggaggcaagcattttcttgctgagcttgccatggtggatgctcagggtctcacggatgaacctcaacggcgtgcgaccctcgcctgtccgctcgagcaggctgtcgatgagatggaagcgaccgtcctgttcgaacagcgcgcgcaccccgatccggtcgtccatggtgtcgtacaaagggaacaggtcggggttcaacgatcccagcgacatgccgccggcgacggcgagggcgagttcggtgaccctcaacgcggtggtcttgccggaggcgttgatgccggcgacgccgatggccgtgttgatgctgatgttgcgtgcggcgccgtcgagcatgtgcgtgtatccgggttcccttacggcgtcgatggcgtacaggtccatcctgcattcatggttttcgtataggcgcaggccgctgatggcgtagctcaacaacctcatgctttctcccttgtaaacgttttttctgtatacataggctatcactgaatggagaccgtcgatacccggaaaccgtcagaacgcctcccccccctgactcccaggcagccgggcgggttctagtgatcgttgcaacacctgacctaccgcaaggagggtcaggtgaccagaagccaccgaaacgaagaccgtggcggggaacaccgttggacgttcaacggcgtcgaatatccgacgaggaagctgatgtgcgaggcgagacgcgccgagtacgtgcgcctgctggacgaggaaggcatgaacttcacccaggccgcgcacgcggtcggcgtctcgaaacgcaccggcaaggcgtggcgcaacggcaggacgcgcgccacgggaaggaacgagaaacccctggtggactggtatcgttccaccatggacaaacccaagaccctccatccgcgctacctgagccaggaggagcgcatccagatcgcggaccgtctgcgtctgggcgattcgatccgcgccatcgcccgcctgctgggccgcgaccccggcacggtcagccgcgaggtcgagcgcaacaggaatcccgagtccggcggttacgagccttaccgcgcccagcagaaggccgcggaccggctcaaacgccccaaaccgcgcaaggcggccgagggcacgcgactgtgggacgagatcgccgccgggttgcgcaggcattggagcccggagcagatagccaaccggctgaggctggacttcccggataatggggatatgcacgcgagcgtcgagacgatctaccaggccatctacctgcaggccaggggcgaactcaagcaggagctgaaacgcgccatgaggcaggggcgaaccgcccgcagaccccaaggcggccaaggccgcaaaccccgtttccgcgaacccatggccatgatctcggagcgacccccggagatcgaggaccgggcggtcccgggccactgggagggcgatctcatcaccggcagccgcaacaaaagcgccatcggcacgctcgtcgagcgcaccaccaggttcacgatcctgctgcacctgcccgacgggcacgacgccgaacacgtccagcaggccatcatcgacaagatgcagcacctgcccaaactcctgcgcaacagcctgacctgggaccagggagcggaactcgccctgcacaaacggatcggcgcctcgctggacatggccgtctacttctgcgacccgcactccccgtggcagcgcggcaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaaaccaagcgagaagatcatcgaactgctcgacgccgcgtgataacctcaacaaccgacaacgtgaccatggaaggccgctcaaacctcaggtgttgcaaccaccactagaatctgccccgggcatgccgccccgcgacgggtcgggcatgaactgctccggattatccccgaccgccgtcagcagagcaggcggatgccggtcgcatccaggagaacatcgcctgtcagggcgttcagcgtgttcgcgagacgtttcgccgtgttctcgcccggcgtcggctccgacgggatgatgaggcccccatccggggtctccgcgatgaagcaggcgcatcctttggccatctccatgggtttcatgccgtcggcgatcgggttcggctcccacttgtcgccatccgtgagatgacgtgcgcaggattccagatccgagaggagcgcgtccgcgttcatgtacgtgtcgtacaggcgtcgccaatgggcgcgaacctgttccatgatctgcgggtcgtcgcaggacagatggcctatcccgttctccgcgtcgttgatggcggcggcgagcccgcggcgggcgaccgccagcatcatcctcgcctcggtgttctgttcgagcgtgaaatcatggttcggcatcattcgccccagctttccctgttcgtccggatttcgctacgtctgacggcggcgcgcgtgcgcagccggttggggcgcggatcgtgagcgccggccttgttggagcggcggatgagctgcatcgcctcgatgtacatgggattcgccgtcctattcggccgtgccatgatcggcctccaatgcgatgtcgtgcaggatgcgggagaggcgcagcgcggtctcccggtcgaggatgaggcttgccgaccggtaggtggtcccatggtccgggtcggtgtcctgccgggctatcgcgatgccgaccgtatccggccaacgcccgtccgtccaccggcggcgggtgacctccgcccggtcgacgaccgtcgtatccgagccgcacgggatggtcagcatgaccccgtgtgttcgagcccgccggccgcgatctccaccttcgattccctgacgttcgcatccgtcatcatccgttcctttcctcgttggccttcgaccccgcgggcatgcgtcccggtatgccgagccgacggcattcaaggcattgcccgtccgtccagcccgtcgggtcgagcatgatgttcgcgcaggatacgcattcgggaagccggtgcgccgggcagtagtgcaggtcgcggtcgagtccgggatggtcgtcggcgtacaggatctgccagccggcgtccatgcgcgcatcgttcagcagctcatcctcgtccgcccgccattcgctgtcgtcataccggttttcgcagccgggcgcgtcacaggcgagcatgagcaggggcgtcgcgtacccgtcgaaccgttgggcgagcatggtcatcttggcgtcacccgtttcgggcgacggttcacgtccggcaacgggtcgatgccggccgcctggcgcagcaggttcccgatccggcggcatggcttctggtagagatgccgccggtcgccgcaggggccccacatgcggcgcaacggcccgccggcggggaacacgaggttcccggcaagacggtcgccgtagaacactgggaccgtgggctcgccgtaaagcccggcgaacgcgggcccatacgaccatccgtcgcccagttccccggccagcgcgttcaatcggagccgcatgcagcccgtgacgtccgtggcatcgttttttccggctcgccgtccggagtcggcgacgccttccgcctgcgcccgttccagttgggcgaccgtgcagtgcacgcattccgggtgcatgcccgcccagacgccgaccatgaacgccatatgcccggtctcgccggtcaggcttcccatgaggggacgcgcctcccatgaggggagcggccgccagccgtcgcgccaacagtccgactcgaagccgatgtcatgggtcctggcggccttcgacggccatacgtggatgaggtcggtctcgacgtgcagcgcgtatctgaagcgtatcgccatcagtcccgcctctccttttcgtgttcgagttcgttgacgcagcaggcacacggtccgtccatcagattggggacgtcgtcgccgcagcggcggcaacagccggcctccggcacgcgggccatgcggtcgaacaggtagtcgcccatgtcgttgatgtcgatgcggccggccttgccgtgcaggtatccggccagcatgcccttcagttcgcggcgggccacctgcctcgtttcgagatctttcaacgccatgtcacccctctttcaaccggatttcgtattccggggtttcggccatcctgtcgtcgaacaggaagtcgcccatatgctccacgtcgatcgggcagccgccgccgtacgggtattcggctatcgcgttcttgatctcgcgcctgttgatgacgcgctcgtcgctgtcatgccttgccaagggtgtttcctttcccgtattcgccgatgcgggccagcagtccgccgaacatgcgtgatatgtcgcgcgccgccataccgttgtcccaggtcgtgaaccggtgcagctcccactggtcggccgcggctttcgcgctttcgtcaagaggattcgtcatcgaccggcttccttcagtagtttgattgtgtgcgcggcttcgctgagcttgtatcggatcgtgctggtcggtagagtgcatgctccaaccagctcctcggcatgcccgtcgaacccctgcttgaattccaacaccccacggccctcgtcatccgggtcgttgaatacgccggtgatgccgtacatgttgaagcgtggcatccggctacggttgacgcacaggcggagcattccctcatggaccaacaaggcgggagcctgatacgaacggtattcggggagcgcgccggctgtcagatacacgatttcacgccggtgttccacgaacagggcgcatgccgcaggaatgacgctgccgcgggaagccagtgcgcgcgcctcgttgaggcggtgttccatggcggtcaggttgcgggtgatgtcgtcctcctgccgtttgattcgagatgtgggatgattctcgtattgggttcgcagcaggtccagccgttcggcgagtttgtcgtattcggcggtcagtctggtcagaagttccccggcgtggatctcggcgagcatgaaacgggctcggcttccgaatgtctccttgaaccggcggtaatagtcttcgtcgcgggccgtgaagccgcgtcgtcctgcggtcttccgttcgatgtccacgaacgtgccgagctcatccgcaccgagttcgcgtactcgcacgcctgacgttctcgcccggttcacgctccaccgggtgcgcggcttataggaggcgagcagcgtcttctcatccttgatcccgtcgaaggttctgatccaattccaacggttgacgacttttccgtatccggtgtcgaatccctgatgcctccagccgcatgaccggtaggcgtcgaggatcatcgtgtcgggggccccgatcgggttcccggccgcgtcatgcctttggtattcgatgttcggccagcatgtgacggacacggcatggcggcggcgtgcggcgagccggattccacgggtcatgtgttcgaggagtttcggatcatcgagcgcgcataacggtccgagccagatgctgccttccgggccaagccggcctcgtgtccacgcgatcaggcagccggccgatagaacgccgttgcgggtcacgccgatcagatccgtggcgtccacgtccggttcggcgagatgagccatgtgcccggtctgctggaatccgccctgcggatgtccggcagacagcagatccagttggttgaaggtgatgggtgtgatgtcgtagatcaattcagtccttccattatgagaccggttccggcatgaagagcgtatgtgaagcggatcatcatcgatatccccctaccctcccgtgtttgggttcgtctaggatcaggggcacggcgctctcatccaacgggttcgtcatcgcggcctccctcgttcgcgatcgtctggagaatgcccgccaggcagccgatttcgccggggctcaaccggattcggcggatcgtgccgccgctgtcggtggacagcacccacgtgcggacgccgtgtcggccgtcgcccggcagccagatgaggctcacatgcccgcaggaggcgcccgtgatcatgccggcgcggcgttcgacttcgatttccggcttcatcgcacgcctcccaggatcaggggcaccgcggcccaccggcggaacatgcggcccggcgcggccgtgcagtacgcatgatcgggatgcagtacggtcacgcccttcgcggccatcgcctccaatgtgacgggcctgtcgtcgatgagcacgtccggtgtgagcagcgtcttgtcgccgttatagtagccgtcgaactggaagccgttgcggtgcagccagcgttggctttcgccgcgccggtcgtccgcgcggctggtcgccatgatgacgttccagcccgcatcgtgcagctggttcaaggcttcggcggctccctcatagggttcttcgcgtgagtagagaccgtcggcgacggcgcgcgtatgccaccagcggaacgatttcgcgtcgccgctgaacggccatccgccggtcagcgtgaaatcgtaggccgtcggctccgggcacgggcattcgtcctcgccatgtccgcattcgcggatgtagtcgcgcagaccgttcgtatagtcggcgatcgtgttgtcgatgtccaccatgattgtcctggtcaaggctgtcacctcttttcaagctgttccgccagttcgtcaagccaggcatcgacggcttcgctctcatacccgtaggagccgcagggcaggttcagatgcctgatctcgtcggcggcaaggcctcccggctccccggggtgggccagggtgaacgaggcgaggcgctgcaccaggtcgacgggtaccggcatgtaggatgcgggagccgatacgagcgggaacatcgggtatgccatgctcatagtccgttcttcgtcaggtatttgttgttgatgattttgaagcaccgattggctcccagttcgttcgccaatccttcggacaactgctggtcttcgcgcagatgccagacgatgccctcgtccagacggtctttggtgacgttgccacgcaacccgtctactttggcgatcatgtcgtccacgctccccgtcaatgcccactcgttttcgtcgagttcgggaacggcaagattcggcattcccgtcggccactggtcgcggtcgatcttgtgatggtctttccagacggcgaagacgaacggacgttgggccggcagtttcaaacggtttgattggataccggggccacatagctcgaactggacggccatgccgggccatagcatcttgtccaactggaatcttttggcgagccgcatgttcgaggacatggagtcaagctcccagttgcgtgagtacacgtggacttgtcctcgttcgtccatgctgagcgtggtgctggcgccatcgaccttcacggtcggcacggctttcaacgtcttgatttcatcccagtggtcggtgagcgtctgcaaacgtggcgcgtccgacttggagcagggcgcgtcgaaccggccaatctgagcaccgcccatcggcaggggctcctcgtatttgagcacattcgccttatcggtgatgtccgtgccgacagggggcgtataccggaatccgagttcatccaaacgcatgatgagaccctgcgaatacactccgcgcagtttcacggtgcgcagcacatggccggtgatttccatggaaccgacgatcatggtcttctgaccgcgagcctggaacgccttgtaacgcgggtcataggcgggcagaagactgtccgtctcgaaataggcgaccctgtcccccggcttcagatgcatgtccttgccgacgaccacacgccaccccaatatgcgggcgacttcgatgcgatcggccccctcgatgggctcgatgttggtgatttcctgtacgctgacgagtttcctgctgctcatgccgcgactcccatgctgtatcgttcgggcgagatggtgatgatcatctcgttttcgtcgtaggctccgtctttcatgcctgtgacctttgtcatattcaaaccgtgtccatgtcccgctccccgccggttcgcgtggtcagacggggcatggggcgcgcccctcggacacggtgtccgattcgatggtcaggaccggttcgccctcgtcgtcgacgagcgtggcgggccgtcccgtcgcgtccgccgcggcgcgcgtggcggcgagcatgccggcgaacgtgagcccgccgggcagtggggtcgtgtagtcgacgggcccgtaggcgccgtcccgggtcgcgtggatctcgtattccatgcccccgggtatgcgtccccatacacgcggtccgggtgtatgcattccggtccgcgtgtatgcatccgtatgcatccggggatgcatacatcttttctttccgtttcggcttggttccgacgttccggggatggtccggaggcgtgtatgcattgtatgcatcattcccttataggggattcgggaaaaaggaaggaaaccccatatattgatgcatacaatgcatacaagataaaggaattatattttttcctttatttataagggttttcgggctttttccgggctttttctgtatgcatccccggatgcatacagatgcatacacgcatacaaaacgggccggaaaactatacaatattgtaaaggtcggaggtgagactttacaatattgtaaagcctcacctccgggatgcggtcgccccgccggcacatcgggatgcctttttttcagttcgcgaccagatccgacgccatatccatcggctcgccgccttggccccgccgttccggcggggcgcgcgccgaacctcacggacaacggttccttgcccaaatcgggctggaaaacggctgatccggttctgaagagccgggcttgcgccgcaaaaaccggtcagggttttctcctgtccaggtcgagttcgagaagcgtgcgcacccggtcgagttcgccggcgacgtccgtcatccacgcggcggcccgtctgagaccgtccggcgtgaccgtcccgcccggcgtcggaccgcgccgggcccggagccggatgccgccggcgggcgtggggcaggcgtccacgcggggcggctcctccgggtcgccgtcaagccggaatcccgtgacccggtagcggacggtcccgtcgtcccggcggatccagtcgatccggtaacggcccgtatggcccaatgtcaggacgtcgttcatggccgccccgtccggggcgtgcggcgcacgacccattcgaccggccgtccgccgggcagcccctcggggcggatggtctcagtcgacataatcgtatcccgtccagtcgcgcagcagctcgcatacggtgacgtctttgacgagcagcacgtgatgatggtcctccgcgtcctcgagcgtgacgagcgcgcacccggtgcggtccggcttcgggtccatggggtcggcgacgtcctcccatgcgacgggcgtgctcccgtccgccatgttttcgtcgtacggggcgggagcccacgtgccgtccggcagacgttcgaacgtgtccgtggaatcccgccaggcgtccatgagccgtgttttgagatgaccggtgatgatggccctgaactgatgatcgttgtcgttcatgccccgtggcatgcgtccccggacgggcatgggacgcgtccgcggcgaagcgcctcaccgggcgtacgggatcgcgtgcaggccggccccgtccgccagcagcatgccccggtcgccgatcggcgtgccgtccggcatggtgctgaacgtgtcgcacagccacacgccctccacgttaccggccgacgggacgggcgtatggccggacacctgggtcaggcggccgtcgtagtccccgtggccgggacgcgcccacaacggtccgtcgtcgtccatgtacagggcggccaggcttccgggacggtccggcaggcggttcagacgggccgcgatccggtcggcggtcatgcccgtccaggcgtgcccgaaccggcggatcccccaccggcgggtgagtcccgcgtgcgtggcgacgatcgtgccgtccgtccatgcgatccgcgtcgggatgtccttcatgagctcttgacgtcctcccctcggctgaagccgggggattcctcccgtcctgacgatgggagaggttctggtctctaagagaccgccacggattcgcgtgtagcgtttccgttggtcttacgtccctgttcgaccggggtgccgtccgcgccccacaggttttccgacgtgacggcgagcgtgtccaatccccgttcgaggatgttccgggcggcgttcacgtcggcgttcgccgtgtacgagcatttcttgcagacgaagaccgcttggctctcgcggttcttcttgtccacatgcccgcatcggctgcatgtctggctcgtgtaggcggggttgacgagtatcatgcccacgccttcggccagtcgggtcttgtaggcgagcatggaggacagtcgtcccatgctcgcctgtctcaggctccggttgagtccgtgtttcgcggcctgcccgttgggcaggtatccgccctcatgcaacgggtcgggaacaggcttgttgcggcggctcatgttcgccaaccgtaggttctccaacacaatcaggtcgttctcgcgcacgagccgggtcgtgtacttctggtacacgtcgtccagtatgcgcttggatttcgcgtgcagtctcccgatttccagccgtgttctccgatacgcgcggctggtcttgccgctcttcgcgtactcccgttcactggagtatcccgcgttcccagccctgcgggcttgggccttctgccgtttcctgatttcacggtcgatggccttcaacctgtctttcggcaggtccatgaaccgtccgtcggagtcggcggcggcgtgcacgcatccacggtcgatgccgaccgccctgccggtcggctcatgcttgacgggcgttggggtgttgttgaacacgacggtgcggttcgtccaatccacttggatggccgtgtattcgcgtatcggctggctgactcgcacgtgcaggaggatgcggtagcgtaacggttcacccggcaatgacatgcctttgggattctgtccggtgatggttatgatgccgtggttgcggttgacctgccggtatacggcgttgcgtcccccgttgtgccagcagacgaaacgctgcccgtcacgcttgtatgatttgaaccggggcattcgtcccggcttcaaccgtttgcctagcagggtcttgcgtcgttgcacggcggtgaaccattcgacccgttcgattcgtgtcggtgactccaatatgagggacggcaccgccgccagccaagaacattcgcttcgggaccggctgacgctgcgagtgtcgggttcgcctccgatggggacgagggttttgtccttgccgtatttgcaacggttggaacgcaattggttgaaccggtatcgccaagcgtcgcacagccagtccatcgcctgaccgcccgaacgcgcgtacagtctttcggattcggggtcgtgccggtcggcgtagccggtgaacggcttggctccgtccaacgtcacgcgttccaacacgactttctgactcataaggctgattctaccacattcgcgtataatatgggaatagtaatgccgtgattcctccccacgcctaaaggcgggggcaccctcacggcaaaacggtggacgcggcgctgcgcgcctggtttgaagcccggcgcctgggcgcgtacgcgcgcgaacgaggcggatccgcgtcgcatgtaatacgggacgtcatggttgccgagcagcgggacgatctcccgtcgcccggattcggcccggtaccatgaggcgaaccgttccatgaaccgtatcatgcccgtgttcgacacatgccagtcgtcgcatatgtcgccgagcagcacgatccggtcggcatgctcccggtctgccatgttcgagatgaaaggcagcaggtcgcctttcgcatgcaggtcgccggcgaacagggtgcggttcacgccccgccccttccggcaggaccgccgtgctgtccgacgtggcgacggacacgaggccgggacgggtcaggagcacgccggtcctgaccatggcgtccgcgtccagccaccagatcgcgtaccggcggttcgcgtgtacgacccggacgggcgtctccggatcgtcggggtcgaggacgcgcaggacgcggaccggccgggtcgcgtccacgcagcgcatcacggtgtccgcgggcgtccagtcccaggtggcggcgcgccagccggccaatgcggccagggcgagcaggaggatgacgcccagcgcgttctggccggccatgaacgagacgacggcgagcaggagcacgcccagcatttgcaggatcatgggcgtcagggcgcgacgccattccgtgcgggtcggccggggcacggggctccacgggtcgcgcggccgcgtcttcgttttcgcgggtctcggtccgcccgtgggccggaccgagggcggacggtccggtttcacctcgtggaatgtttcggttcgttcgtcggggccggcgtgcggacggtcggcggccaggcgtcgttcgagctcgttgaccgcgctcaccgcgctcacctggccttcttgccgcgacggcggaggatgacgcccggttcgacgatgtggtagccgccgcattccgggcatttgcggatcgtcttgccttccggcaggcggccgagcgcgatccgggcgtccacgggggtcgcgtagcgggtgcgggagcatttgcggctgaacatggcgtcggccttcaacgggcggggctggtttttctcaaggttcctgcgtggcatggaatggttttcctttcgtttgccgggttgctgtgcgccggttcagacggcggcttcgatggcgaggcgcgacagttccgccgagtcgaacgcatgttcggcgatccccttgccgagggtgacggtcacgccgccggaccggcccggctggtatttcactccgtccggtatttctcccccgtgttcgcggatgagacgttcgaggaaacgttcgcccatggcgttcggggtcgggtagttgacggtgatgacggccggctgcccctcgcagtccagtccgtagtggctgaggaagtccgcgtaggcgagcggatcgtccaccttgtagtagccttccccgtcccttttcacgagcacggtggccgcgtcgaggccggcgaacaccgcgttctccttcggactgtccgcgtcatgcgtgcgaagatactggcgtttcgccccgtccagcgccttcgtgatcttcttctggaggatggccagtccggccatgtgggcgagcagcatgtcgggcgtcatctccgaccagtcgcatggttcggtttccgtcatgattcttcctttcctcccccgtccggcacgggggtcttgtccgtatccgcgtatgcgtccccgtccgtgacgcatacgcgcccgtatggccggaaatcggtggaattccggccatcgtgcgatgccagggctaacgccgacgaagcgcgaaccaggcggcggcgaaaaccgcgcaagacctggagcggacggccgcgggaccgtcctgcaaactagggcaaaccagcctgcaacggcgctcccaccggccgtccgcgcctctttcccgcttcccgcgtgtatcggatgatggggggcggggcgagcaggcccgccgccaggacgatgagcccgatcccgatccccatgggccggggtatgggcgtgatcgcgaggaacacgccccacatgatccaccacatgggcgtgatcgcgagcatgagggtcctgcatcgtctcaggacgcgcacgtccgggtcggcgcgccgcatgcgccgccggcgtcgcgtgccgccgctcacccgcaccggcctcaaggtcctcgtcctgtcgtccatgcgcgccgcctatgcgcccgtcaaggacgggccggtggagaacagggggatcgtcgcgtcgagccaggggctgagccacgcccattcggcgaacaggatcatggtccagaacaggatgaagaggatgatccgcaatgggacgggtcccgtctggagacgccaggcgagggtcagcggattccatgtcggttcgcgccggggcctgcccccatgccatatgagccatgcgaggccggcgagcaggagccaggcgccgcccgcggcggcggcgaggacgcggctgacgggcatgcgcacgcttatgcggcgtatgacgcgactggccgccatgcgcgccctgacggcgggtctcgaggtcccgtcggcgagttcggcggggatcccgtcccccacgtccgaccatgattcgaggcggcctcgtatgatgaggcgcgcggacaggctgtcggcctcgtcgagcgaccatttgcaggtggtgagcgtgatcgagcgggtgtccccctgaccgggctggtcggcgacgaccgcgacgtcgtcgggcgtggtcatccaggatgactgcaccttgtacacgtaccagtgccgggcggtctggatgacgatcgggtcgccgggccgcaacgtgtcggcggcccccaggtcgccgggcgtgcggtgtcccgcgtacgcgctgttgcctttcccgccgggcatgggcgtgtgcccgtagtggcctatcccctggttggcgagcacgtccgtgccggtgccttcctggatggcgcgtttccagtcgtggccgaaccggggtatccacatccagccgatgacggcgccgtggccgggttcggtttcggccggcgggtcgccgccccggggttcggcgatccgggtcgcgtcgcccgcatccacgtccttgacgccgtggcggacggcgagggtctgctgcgtgtggatgccgtcgaacgcgtccccccaccacacccagccgacgtggaacacgcacaggatggcgagcgtgaggctcagcccggacacgaattggaggatgcgccgtcccgtgcgggcgcgtgggcgcgtgtgccggccggtcaacgcccttccccgtccccatggcgtccgagggttcgtgtgaccgcgtcgaggatgacgaggtccgcatatccgggcgtgtcggggaaggggaacatggccttgtagacgaggtcgggccggacgacgaggttcctggcggcgagcccgtcgaggacgagtctgacgatctcgcggaacgcgggcatcgtgtcctcggggtcgagggggatcatgatcccgttcgccgcgtcgtattcgcgtgccagctgttcgcgcaatcgtaggatctgcgggtcgtggctgacgtagtcccagttcacggcgtgcgtgtatttgtccctgaccggatcgtcgcccatgggcggcctcccttcccttgtcccgtgtccggcgcggcccggcgggcgcgtcggatgctttcgcgtgagggtatgcgttccggtgcgtggggtctggccggggtgtcgtgtggcgtttttcgaccgggttgacgaggctgatgtccccgcgacgcgggtggacgatgatcttcgtgaactcgcgtaccgacttcggcgtgatgccggtgaaaatgatgaagcccaccttggccgaggttttcgattagccgtgttccggaccgtccggttctcccccgatgcgattcgtgcggcggttcactgcttgtgcgtcttccggcacagatcgagcatggggcgcaggtccgggctgccgccctcgcgttcgatccgcaccgtatgcgcggccaatggcagcagccgttccaggttcgaatccatggtcttacgattcaggacactgtcccaatcggtggtgatgcggcggaacgcattttggaattgctccaccacgacgaacctgtcgacatcggaaccatacacgatctccggtgtttccggcatgcgccccgaagcgagctcatagtcccccgcctgtccgtcaagcagtcgggcgaggacgatggcgttgtcttcgaacctgtccgccggcaggccgagcgcccgcatcccgttcgtcgcccactcatggtcgacggaggggaggcgccatgggcagccgcctccgttcagatggaactcgtacccgtatacgtccttcaggaccttcgcggcggtctcccgaggatggtccttttgcatccgatgccatgcgcgtaaggcttcgcacagcatcgcgtaacagccgttcagctcctcgtcacggacgcccatcgacggtccccctcccgtcggatccggcattcccgccggcaaccaacctgattatcgtatcggccgtttgcgcggattcgagcagcgtctcctcgcaatccgcgaactcctccagccgctcccagaacatgtccagttccggatccggggcgggttccggatcgtattcgagatcgatgccctgttcgtcggccgcccgcctcttgcatccctcgaaccattccgtctccgaggcccacaattcgtaggcgagccgtcgagcatccctggccgccttcgcgtaggcggccagggccttcgccagttcggcgcgcttgcgcctgcttggtttgaacagccggtcgaccctgtccgcgaaccggcgccacttcagctggtcttcgagggaatcgtcgtcgggaatgccggacatatccagggcgctcactttttctccgatcgtccggccgcgtcgatactccgtccgagacggcggatgtcatcccggatgtcgaccgacgccagcgagaaagcggcgaccggtccgccggatacggagaccacgtgcaacccggacgggagccacgggacgccgaactccagccgggcgcagacgaacgccgacaatgccgcggtcagggtaatgatgaacgcgatcgcgccgacagtcagcagacggctcgatttgatgaaacgtatgaaaccatgcatgattccttccttcccctcttaccagctgccggatgccccgccgccgccggatgagccgccgccgaacgaggaaccaccgtctgaagagcttcctccggaccagccgccagaagaggagccgagcgaagaccacccgtcatcggaggatgaaagcgacgatggatggccgcccgatctgatgaaatcacggcacacgagaatgcagcttccgagaaagaacacgatgagcatgacggcgatcgtgatgccaccggcctgttccttcttccgttgcgccgtcaggtatttcgtgggggaaccgtcctcgatactggtttcgatgccgtccaccaccttgttgacccccttgctccagtcgccgtccttgtaatcggagtgggccgtatcgatgatgtcggccgcatccgcatccggaatcacggattcgagcccgtatccgacctcgagacgatccttgcgatcttcgacggacagcaggtagaggagtcccgtgtccttgcccttctctcccggcttgtatttgtcgaacagttcggtcgccttgttctcgatgctgtccccgtccaatgatttcagggtgacgaccagcagctggggtttgtccttgcgtgactcccatgatttgttcaggccgtagatccgttgttccgtggccttgtcgagcacgtcgccgatgtccttgacgaagatgttgccggccggatcatccggcggcacatacgtgcccgacctgtcggaggccgcgacggaaccgcagcccgccaacaggagcagtccggcgatgatgccggtcatcgcatggcgtatcgtgcccctattcaagattcacctccggaacctcatcggagccggccggagcctcatactgctgcagcttctggaaaccgaacatgccggccaccagattcgcggggaacgacgtgacctggcggttgtacgcgttcacctggtcgatgtaccgtttgcgttccacgctgatacggttctccgaaccctccagctgggtcatcagtgtcttcacgttcttgttggattccagctgtggatagttctcgtggatcgcgttcaccaggatcgaggtctgttcgcccagcttccggtcggcggcgagcttgtcgttcgggtcggtcgcggcggcgtatgccttgcgtgcgtcggcgatggcgccgaacaccttctgctcctgtttcatgctgcctttgaccgcgttggtcaggttggggatgaggtcgtgccggcgttgcatcacgttctccacctgcgcccatttcgcgtcaacgtcgagtttggcggtgttcagcccgttgtatgtgccgccgagaatcatcgcgatgatgagcacgatggcgacgatgatgcccgccggcatccacttcttcagagtcttgttatccattttttcttcttcgtgtctgtttagaggtattcgtatctgatcggcgccagtactccgttgcgcgccaatgcctcgcacagcatgtcgtatgtgaggaaccgttcccgctcatggagaatgctcggcggctcgtcgtactggacgtgcgagcatccgctccagcagccgtgcagatgccagtccaacgcggtgaaccagcggccgcacgagcattgggctttgaacggacgctccggatccgtggcgcccgtatcccggtgcaggatgaacgtggagagctccctggacggaacggattcgcgtcggacatgcgcacttgacgtcttcgtcaccgttcgttccaactggtcttcctccatcaccagaatcgcgccgccgaacagttggcttccgataaacgagcagatcacgaacgcggcaaccagaacggcaaaaggggttcccgtcagggggacacaggcgccgaacgccagtgtccccactgcaatcagcatcagaaccgccccggcctgcgcgaaccgtatggcatgggctgtgttccgttcgatgagtccgatgacggaatccgggaaaaagatgttcctcatgatttcctccttcacgcgttcgtatggtcgaggatccaccgggcgacgcttcgggcggtctcctcgggcacgtccacctgcatggaaccgttgccggcctccatatagaagcggatgagcccgttgcccgtgagccggtcgacttccagcagattgtcggcatcctcggcacggcagtattcgcttgtatcgttcttcgcccgttcgcgcagatgttcgggcagatattggttggcgagaatatcgcggcgtagttcgtcgctgtcggtgaattccatcggctaccctttcgaatgtttcgcgcccggcttccataccggtgtccctggattcaccggggaaacaatcatcccttggttatcgcgcagttcgacgtttgccccgtcgatgtccagcgtgccttcgacgcgccgcccgttccgcttccatgaaacccggtaggatcctttgattcgggggaaaccggacaacgggtccatatatccgggttcggcgatcgcgagaccatcgagattccacacgtcgcccacatactcgtccatggtcttcggcttcgggcctcgggggctccagttctcggccggggacatgagcgcgagggcggcgaacggcagcagcaccgatgcgccgacgagcctgacctcgtccatcgtgagattaggaaagccgttccgtgccatcaccaggcaataggcatacgccatgagcggaatgtccgcgagaaaggcataccaaccgagagcattcaggaccctcaacagcaatggcatccgcgaatggtccaccgcctgagcgtattcgacaagctccatcagctgaacctccaatgcagttcgtgctggtttcgctggccgatgagccgtaccttgacttcgattatcctagtttccatgtcttgggttttcttctctacgagattgctaatgccggattttcttgtcaccagctgccggttgctccgctgccagtggatgtgcctccgccgaatgatgaagagctgtcgaaggatggtgatgggcccgtataaggctaggggtcatcgttgatggaatcattttcggaggaacgatcgtgctcctgtctgtccggtctcgatgcaagcgcgacggcttgggtgaggattatcgcgtcccgagcatcgaatccacgagagggtgcggcttctgcaatataggatgggtcaagcggtgctcggccggtgtccggctcggaatggtcccgctgcgcgttgtctagttcggaataatccgtttgttcactcttgtcatctgactgcaatccccatatcagcaagagcaccgagccgaccacaacaatcaccacgccgagaaccccggtccatgccggcattggtgcgggggttgtagccgacgttgatgcggatgaaatctcgggcatgtcttgcactgttgaagcgatattgtccaggactttgctgatgccggcgttccagtatgatttcttatagtccgcatgcccggagttgatgatgctctcgcacgtggattggttgaatgtctgtccaatccccgtgccgacggttagccggtccttatggtccttgatggacagcaggtatacgaggcctgtgttcttgcctttcatgccgggtttgtaccggtcgaacagttccttcgccttccgttcgatgggcacaccatccaaagtggagacggtgacgacgagcagctgcggcttgtcctcacgtgactcccacgacttattcaggtcgtaaacatgtttttcagtttcagcgctgagtacgttcgcctgatcctgcacgaagatattgccagcagaatcgttcttcggaacatacgtatcatcggttgcggccaatgccggcatggaaatgccggccatgatgaacagtgtggcgatggccgcgatgattccgttaaccagtttgcccatcaggtttcccctcgatatgcctcttgttccaaaacccgcagaaaatctcatatagccaccacctgtggtctctcgcgactcgtggattcccagattcccatccgagcccacggcatgccggtgtatttggatgaaaatatgtccagttctgcccatgcggaccattgctcccggtctggaaccagttggacggacaggataatcgggatacgggcgtcactctcccttaccgtctccatcaaagctgaatcgtcttcaagacccggattcacatggtcgataatcagaaaggaatccggctcttccaagatggacgtgggatcgttcaccggaatcacaccttgcacgggcttggtataacctcgatccacatacccgtcaaacatatagacccgttgccccatttcgttgagaccaggtatcagggtgtgtgtcagccaccaggtcttgccgcatcccgcgccacccgtcaccagtaggttcccatcggaaaccgggttccatgtcgcaacgccatcatcgaccaatccgattgtgaggcttttcaccatgcgcagctcacctccatccagataagcccgcgcccgtccacaatcgatttgaactcgtctatccgccagcggagcgcggccgaatcgaccttgaatgattcaagcccgccgtcgcgcaacgattcgaacaacgcgtcggcctcggcccgggttccgaacggttccggccatgcgacccatcggccgggataatcggctagccggcgggccagctcctcgtatcgcctatcgtccatcggtcttcttcttgtcatttggcttgtggtcgcggacgatgaggatcatccagccgaagcacgggagcatccggtattcgccgtaccgggtcagggcggccgccaggcgttccgcgccggggcgggtggtccattcctttgagtcctcgtcgtagtcctcggcgatccaacccttcttcagcagcccgtaatgcgccttcttccacgcccagctgacgatcgcgccgaacagattgcccgtcagatacaggagcaggattcccagtatgatcgcgaacggggtgagcacgccccaccagtacccgtccatcagaaccgccccaaccggtgcagggcttcgaccgaatggatgcgggcctgttcgccgcccgctcccccactggcgttcacggccgtctcgttttcggccggcgtggcgaacgccgcgggctcgtcccggcataccaggcgggcgaacgccctcgcctccccgtccgacagcacgacccggccctccgacccctcgcgcatgccggcgaccgtccacaggccggacttcggatcgcgccacgcgcgcccccattcgccgaggaaatgatatccctccggaacatgcagacccatacggacccctccttattcgaaacgacgattcccggtcggcgaagggtatgcgtcacgtcggatccgaccgtctccgtggcgcggccgtgcggatcgggacgatcccacgcggtcagcgcgcgaggccccgcatccggacggcggcgatgcgacggcgccgcatgtcccggcgcgccagatcacgccgttcctccggggtcatgccgccccagatcccgtactgttcgcccgtctccaacgcctggcggaggcattcggcccgcaccgggcaggacaggcacgcctgtttcgcgatctcgttgacatcctccccgcggctaaagccgggggattcccttcgcagatcggactccaagggaacttccggcctgggttgaggggttgacgcttcatcgggccgccaacgcggccctccacgtcctaggcggtgcccccgcccgtttgaatcaaagcacggcccaatatgttcttggccgcgttgacgtccgcgttcgcctcatacccgcattcgacgcaatggaagaccgcttggctatcacggttctccttgacgccattgatacgaactttctggctcatcgtggaccacctccttccgttaaggctctatgcgtcctggccttggaccccagcgctgaagcgcggggcatgaattttttcggtcatgcgtcccgcctcacggcggcgatggcggagcccaaggggccatgcccttcggcgggtcgccccggataccagacggcccaatcgcccccgcgcgcccgcagtccgtccatgaaccgctcgtaccgtggcacgccggacatgagcaggagcgtgcggcgcggaagcctagggttcgcgcccagccatgacgcgatgtccgagacgacgtggaccgcgttgcccgcccggtaacgccggggcggtgtgtagtcggctcccccgcacaggtcataacagtcgacatccacgtaacggccggcgaacagccccgcttgcacgcccacgtagccgcccaggtcgacgaccgtccaatcggcggggacgagcggcgcggccgccgcgtacaggtcggtgaggcacaggaacgtcgggtcgatctcgatgtcctcgaaacgtccgtaccagccgtcgatctgcgccatgtcgagccggccgccgagcgccgtgtattcgtccgcgtccacggctattccttccccgcgcaccagacgcaccagcccgggaccgcgctttcgcagtcctcattgagcaggacgccgcatcccgtacagtagtcgtacatgtcggagctccaggcctgcccgcatatcgcacccgcagccggggacgtcagggtccaatcggtcctcacctcggcctgcgggaggtcaaagccgccacggccgtaggcgtagtttttcgccgtctcgaccagcaggtcgaggtccgcgcccgtgcggggcgcgcccagcacgtcctccgtcacgtcactgccatcccagaccgtgacatccagcgtccggcctttgttgtccgtgtatatcatgggcttatccttttctcagtacgtccagcacgtcgtcggcgcaggaggtcatagtcgcgggtcaggtcggccaccatgcgcattgacgcgcaatgcgcggtcatacggtccgccatgctcattttcccgtctcccatctcaccgtgtactccatgcaagccgtgacatcgacgacgaccccgcactcgtcgcagtggaacctgtgggtctccccgtccagcatcccccagtcggccatgcgcccatcgatttcgttgccgcattccgggcaaatcaatgcgtcattcacaatcatcgtccgttcgccctctcgtatcgttccatggccttttcgcccagtccggtcagcccgtcgcatcggatggtgtcggggaaccggtagccgcgtatcaccagtcccatgcctttcaggcgcttgtagtccccgtcgggcaatgtgacatgcgcctgcgggtcgcgtgcgattccttcgagaagcctgtaatcgttcccgttcaatgcggaaggctcgtccccgatgggaccatgcagtttgtcggcgatgtcggccagcgacttcctgcgggcctgcagattatcgggcaacggcgtctcctcgccgccgcacagctccctccacttgtccgcgattgccttgacctcgccctcgtagtggcgggagagccgttcgatgacacgcagacggtattcgttgaacgcgacctcctgccgcgtgaacccgtcgtagaagccgccgtccggtaggatacaccgctcctccacgtattcaaggtcggggatggagatgcacgccacggcgtcctcacccactgggtcggacagtgccatgtccacgccgatggcggcaagttcggcctgtagtgtgcgtatgtccctcaatgactgttcgattctcagcatggcattcagtcctcgattcggtagtattcatcgtcggggtcgtagtccaacggggcgcattcgcagtcgcctgcgtagtggaagacgtggcggggcctgccgcacatgacgcaacggttcagcacatcgtccactatgtccctcgcgtccacgtctgccatgtagcggcgcgtccagttgggcttgggtgggttgtccccgtagatgagtacacactcgttccatacgctgatatggatgatgccgtcttcgagcgtggccctaatccagccgtgattcggcatggagccttccagcgagcttttgtcctcgttgaattcgataccgcattccgcccgcgatagcccctgttcgagtcgttcgattctcagcatcgggggactcctttccctttcgccccgtgccatgcgtcccggaaccgacggagcgtcactcccctctcagcacgtccagtacgtcgtcggcgcaggagggcctcacggccggcggccgcgggtcggtgcagcgctccgccagcgcgggcggcaataccgtgcgcccgaccggcaccggcctgccgtccccgtcgtgcaggacgtggagcgggcagaaggcgtggcattcgccgtcgtcgcccttgatcatcgcccagcgtcgcgagtcgtgcaccgccgtctcggccgcgtcctcgtccggataccacatggcgccgaacggctcgtcggcgaacacggcgccgcaatgcggatactcgcagatgggaagcaggaagggatggtcggccgtgacgagctccgaatggagcagggcgtcgagcgcgccccgctcgcagtcgggatcgggcaacggctctcccacatggccctcataaaaccccgccaacgcggccgtttccggcaccacaccttccgggtcgtaacggacaagccggccgtcaccgtcgtagagcagatgctccggacagatgcagaccggctcatcgtgccggccgtccagcaccagccaatcgtcctcccacgcctggtcgagggcccagtacgggtccgtccaccactcggcctcgtccccgtcgtattcgttcccgcagcccggaaaggcgcagacggggcggtggaaatgcctgatgtcgtatcgcatgatgttctccggctcccctctaatggcagttggggcaatacctaagatcgccctcgtatgcatcgtccaggaatgcgccgcactcactgcaacgttcttcttcgcaccaacacttgttcgacgcctgtccgcagaacgggcacctgtaccagatgtcctccgcgatggcctccgggtcggccggatcgtattcgtgcgtccaatccggctcgggcatggaagtatattcatacgggttatcgctccacgccctgacagacaccctgccgtccccagccaccgtgatgcgggcgaggccggtctgttcgccgtcgaactggtcgcgcaggccgcattccagcatgccgtcgtccagtcgcgtccagtcgccctcgtattcgagagccttttcgattccggccagcatgtcgaccttgtcgctcttgtcttcgccgcacgcgatgcactcggtcatcatcggctcctttccgttcattcgttccggtcgcatgcgtcccggccgcgacgcatgcgaccggacatggaatccctatccgacggcatcgattgggccatggtcgcccaagcccgcgaaccgcatcccgaacgcctgcacctggtcgaggacgagcgccgcgccagacgcaaggcggccgacgcggcctattaccaggcgaacaaggagcgcatcgatcggcgcaacagggcctggcgcgaggcgaacgaagaggagatgcgccggtatgacaaggcgtacgcggcctcgcaccgcgaggagcgccgcgaggccgcccgccgctggcaggccaggttcaaggccgagcacggcgtcagctactccgcctggcggcgcaggcgcctgagggagacggacccgcagacggccgccagcacgccgcagacggccgcgcccgcgaggaacacgggcgagaacgggcaggcggcggccgataacaacatcaggtcggtcagcgccgcgtcggcggaaccccacaggtccggccggcgcctgtgacgggcccggctcacagccaatcgcccccgatgacgttgccggacgtgtcaagcacgccgttttccacgagccagtcgcggatgtccgcgtcgagggcggcccgctccccttcggtcagccgcaggtcgaaacgcccatcctcgtcgccgagaagatagacgcgcagctccgcatggacggggccgcccaaccggccgcgcgccacccagcgccagtcgagacacgcgatggccagtccgtcgcggtcccccacgccgtacgccccgagcgcgccgcaccgacgcatccattcgtcctccatgccgccctcatccagatcggcctcccagccgtccggcgccgtcagctcgtacgtattccatctattcagtccgaaatccatatccggcccctttccttccgccgacaggcatgcgtcccagccgaaaaacggaaggccccgtcgcatccgttgtcggatgcgacggggccttccgtgtggaatggcgcctacttgcgcttgccgaggatggcgagcgcgatggcccccgcggcgagcaccaccacggccaccgcaacgaccgccactgcgacgccggtggaggcgagcccgtctttcggggattcggccttggctttggctccgttatggagatattgccccggcttagccggatcaggcttcggcttcgggcgcctcgtcatggccttgacgtccaggtcctccatggcgataaggatgttcttttgggcgagccttgtcgtggtcttctcgatccagtcgttccgacgtcggacgatacggccttgcagagcgttgaatcggcttagcgtctttcgcctgcgcttggaaacgaatttagcggtcctgccgctccgtgcctcgttgacatggtcctgccgggccatccggcgctgaagatacttcaaccgtttcaattcggccttcgacggcttcggcatgtcttcgaacgttccatcagacgaagcgagcgtatgtacacagccgcggtcgaggccgatcgcgccatcaccggtcctcggcaacggcaatggcatgttgacgaacacgaggctacgatgggtccaatcgacatggacgctcgtatacggccgtatctcctgaccgacacgcacatggacgatgatgcgccaatgcgccttttcgccgggtttgacccatcgcttcgggttcatgcctgtgatgacgaccacgtcgctcttccggccggtcttatggaatatggcgttgcctgatcgggaggcgttgcgccagcagacgaagcccaggccgcgatggcgcgacttgaagccggggatgcggcctccaatggtcttcctgcgtttgagtccggcgaaccattcggtattctcgatcctgtccgtgctggacagtatgggcgccggaatgcccgccatccacgagcattgaagacgcgcctccctgtccgagatcaactcaggtacgtcagggccgcccaaaggctccttgacccagtcgacgacttcacctgtcgcatcgtctttgacgggcacgttgcgcgtgcgttgctcgcgcctttggttgaatctggcgcgccatccgtcgcacagccacaccatgacgcgctcgggattacgcgtccagcatgggttgccgcagcggtccacgccgaggaagacgctcgcgccggtgtgcttgacgccattgatgcggaccttctggctcatcgtggaccacctccttccgttaaggctttatgcgtcccggccgcgaaccccagcgctgaagcgcggggcatgatttttttcggtcatctcgcacgcgtacgccccgtctccgaccgggtagaagatgtcgggatccagccgcgagcatgcggcgcgtcccctccagtcgggccctttcaagtcatgcccctcccggtcgccggcgtacggccggttcgatgaattcgagacggggcacggggccgcgcgtcctgtcacggaccatgcggatcgccgtggcgaccgtccgccatggcaggcctgtcctcgccgccagttcggtggcgctcatgcccgccctgtgcgcctcggccaggcgttccgattgctcatcgttcacgcgatctcctccaacaatgcgggcgcggccttggcgcgcgccgtccaatcgtgtatcaccgtgtcctcgggcacgccttcgacacgccggtaggagacggcgagcccgccgtcatgctccacggcgtccaggatcacgccgacgggaattccggccgcaatcaggatgtcgcatgcgatgcctttcagatcacggcgcgcgagatgccgtacggcctgctcgacccgctcctcgcggtacaggccgagcaggctcgtgggatcgggaccctccatcccgtcgtcacgctcccatgagccgtcgttgaggacgcgcgtggcgggcgcgcccgacacgacgaccacgcaacgcgacccgcagacgaacgcctccctcacgtccgcccggtagccgagacggttcaacgcgggcaggaggctcgcgtaggaggcggacagtcgtgacgggcgcatcatcggccgtcctcccccatgcggcgcatgtggaccgcgccccaatggaagaccagcagcaggccgcagccggcgaacagtacggacgagacggccatgagccatccatgggtctgccacatgagcatgccgcccgccacgcacagtatgacgagcaccagattcgccatgtgttcgaattcgctttccaaggccgtcccccgtcccgtatcgcacgtttccatgccccgcgtatgcgtccccggtcagcgcccgtccggccgtatgcgatcgccccgacgggcggccatgcacagggctgcggtgaagaagccaaggatgaagcccgcgaacaggcatatgacggcgatcatgatgatgtcctttcgttttctccggatgcgcgtgccgctatgcgacaaggcaggcccatgccctcggacatgggagggtgttgttccgcttgattttccttgcggagccgagcgacggccatgatgcttcttgcttccggtgattccgccggacaaaaggaaatccgtgaacaagatcgtggcctatcgctgtatcgtttttttgaggaccgtcgccccctcttctgcgacgatccacctgtttccgttgtctgctcggctgtttcggcggcttccgttccgctgaggttcactggtggaggagtttttcgagttggatttcggcgatggcggcgttcatgtatccgcgcgtgtggaagtgtttcgggttgaggcagccgattgtccatgtgatgcgtccggtgggattgtccacgtggcgtcgtgcctccatcggccgcccgcagttggggcagaaccagtcgtttttcaatggttgtcctttctgtcagaatctgagtgtgatgccgcctggcatagggctgcggtgaagaagccaaggatgaagcccgtaaacaggcagatgatggcaattggcatggtctttcctgtttcgtcagatggtttttgcgatgaggctgattgagacgatcagcacggcccagaggatcgcgatgccgaccgtccaacggttcaggttcctctccgcgaccccggaggtgcccgcgttggcggtcaggccgccgccgaacatgtcggacagacccccgcccttgcccttgtgcaggaggatcagcagggacagcaggacgctcaggacggcgacgatggttttcaagacgatgacgagaacggtcatggggttccttcgtaatagaagacgacgatgatgacgatcagggccgtcagatacgcgacggcccaacggcgataggtgctgcgatgctccgggtcgtccgtccatacgctcatgaggaggaacgcggacgaggcgatgagcatccatagcagcatggcaaggatcacgggatgtgttaccgtcacccgaacaccatgagcgtgagttcgccgaacccgagatccatgcccgcggccaatatcatgggcaggatgacgaacacgaatgaggtgatgctccaggccggccattcgcgggcggccggagtcgcggtcttgcgcagttcgtccacgatctgccggcaatatcggcctatcggctgaaacgggtctgatgccaacgatttcctttccatgcttcctcctatgcgtccggaaaacggaaaagcccctcccgcgcgggaggggcggaaccgttccggcatgaggaacggcggatgggccatgcgagcaaaggaattcttgtcccgcgaccggctcatgccaccgatcgcagactatctcccgttcgggaacccggcgtttcgcatgtggccgccgggcccatcgtgcttcgacgggattcgaacccgcatcaccccaaaaacggggcatcctgaccgattgaacgacgaagccatgttgcggatacgatgctggagaggcggttccgttcaggccactgaggtgcaggcctgcgccttgaccatcgttccactccgccccaatatggcagcgggcgggtggcggcgttgacatcgtattcgcaagttgggtgcggaagcgggcgctgcaacggttacgggtcccagttatgaagagaacctaccgtggcatcgttccctttccggcagacgttcgaaccggatcgggcggcgttgacgcccgtgtttccgccagtgctttcgccgggattcgaacccggaccggacagttccttggattgtcgcctctaccggttgggccacgaaagcatgcgcaggcaatccgcagggatatgcccgcgcagtccactgtggatccggccactcgtgccgaatcctgcactcatgcttgcggtggacgcgcatactgcaacacgaggcatgacagggatcacagggctgaacccccatgctccaccgagaccgttcccacatcctgtgggtcggctgacaagaaacgcggtcgcccgcgttccaggaaacctttcccgcactgggcggataggctttatcggattcgcaccaacccttccgacagagagctgttcgcatcatccacccataggatgatgggcgctgacgatattcacgtgtccgtcgaacaaacggaggcgtgaaccatcggacacgacccgcatggtcatgactgccccgccgggaactcccaacgggcatggaatcgtatcgagcggtgtacgggaatcgaacccgcatcatcagtttggaagactgaagcactgaccattgtgctaacaccgcaaacaggaatccgcacaccgtatcagaagcggattccttagcggacgccacgggattcgaacccggatctccacccacagggggtggcgtgctgccattacaccagcgccccgcacgggtcatgaactccgtgcgttcgcctagccgtgattcgtcagggttgagatcggctggaactccgttgcccgtatccgtggaatgctttttcattctgcagatacccctttcgtcgtgacggtcaactgagacgacgcgcatcgaacggcagcacggtaccgtgccaccgtgggtaggagccattcgccgggtcagcgtccggcccctcttaaccgtccaatggttctatttttttagggtgccggaaccatcaaagatatggcactcgtgcattgcgctggaatcgaaccaacgaccttcccgttatgagcagggtgctctaaccgactgagctagcaatgcaaagtgcccaaggccggagtcggaccggctgcgcccggtttaggaaaccggcgctctatccgttgagctacaagggcgttgcctcgtaatgcacgaaccgtacgaggcgcgacggcgtgagagagaagagaagagagaatccgctcattatggttgacggagttttcgtgcgtgccctcaacgagaatcggactcgtggccttccgctccggaggcggacgctctatccactgagctacaagggcgtggcgtcgtttcgcggcttgggtgacgcctgaccctgtatgtccggtacaacaaacatcgaatcgagtgtagagggaaaaccgattcgacgtgctgccgccaagctcctcctcctggattcgaaccaggaccaaaggttccaaagacccgtgtgctgccgttacaccaaggaggaatgcgcgcgaacgcatcggacacgtatgcccgactgcgttccgccatgccgatccaacccgttttttgccggccggattccaggccctatcccgtggcctatcactgcagatcggctagcggatggtgcgagagtcgaactcgccagggacttccgccccaacagtcttagcaggactgcgcctttgccgcacggcccaccatccatgccagtgtttgcgattcaggggcacaccggccaaacctcgataaacccctcatgggaacgattttcatgcgggggttcgcggagtagggaggattcgaacctccgggggcttgcacccctgctgctttcgggacagtcgcattcgaccgctctgccaccactccaccgatccacacgaaggaacaaactggtcgacgtattcgtgcggatctcgtgctcccggtgggattcgaacccacgaccataaggttagaactcttctgctctggtccgctgagctacgggagcaaggtggatgcctacttcggttcaggaaaagcgacaacccttttccaaaggagtaattcgttttttttggaatattgttgttacttaggcatccacgttttccgccttcttttcgcgcgtggtctgcggataccaccgtatttgcgatgttgcgcttacgcatggccttgtgccatgcgtcgtgttcccggcaggcttcgaacctgcgccgaacgccgtttaggggcgtgcctctgccggttgggctacgggaacctggccgactgttcctcaccaaggtcgaccttcgtggccgatatcaacctgagcatcccgcaagagagaaggaaatgggatgccggtcatggggaagaatgcggggcgatggctccggtcgaacagccgaagagaatagaacatccttcaaacgacgatcggaaccgggtgggacggtatcattcggcttgacgaatccgtgagtagtaaggagccaaacgataccgtcctggcgcgtcgggtgagtctcgacctcacacccaccggttttggagaccggtactctgccgttaagctaccgacgcatgtggagcaggaagccgaagataggcagcggaatagcttcctgctccgagtgccctcaacgagaatcggactcgtggccttccgctccggaggcggacgctctatccactgagctacaagggcgatggcacatttcgttcctttaacgacgtacgcctgtgccgggccgtgttcggcatggtcctcattgatgtcgctccggagaccatcgctgcaaaaagagcgtcctccccacccgtcctgaatgacggatggagggaatcgggagactggattgggttttcaccagcaacgtcgaggacaaacgggaaggttcagatcccctctggacgtgccgcatgttcggtcgcaaaccaccctgccgggccatgctcgccttgggcgtcccgttttcgatacgcctgttcagccactcccatgaaaacgactcattgatcggatgaaccgtttcgtgcctccgtctgaaatcgaaccagcatccacggtgcttcagaccgttgctctaccgtttaagccacagaggcgccgtgcgacggaccgtcatgggatctgggttacaggcccttccccggtccgtcgcaccagtgtgtttccttcccctgtttcgcgcgcggccggaggaagaagctgccgcagcctatctgataatagattgatgcgcttatgcatggcgatgtaccaagcatcgtgcccccgtgggattcgaacccacgaccacaaacggattaaaagtccggtattctgaccgctgaactagaggggcttttctgatatcaagcaacaggaaggaattttgaattgcttccaatgcgctcagggaacctatcgtcgacgttgaaaatcgaaaccttgtttcgaagatttcctgcggcgatgaccgcatcattcagatctcgatattcaccaccgtagaatgtttccccttttcgggttacattgacttgccatcttttatctttgttggaccagctcacattgagatggccactccgtgaatttgttgttgtcgagatattttgacgatttaattcttgggtgccgagtctcaagtgatttggattcacacatttacgattgcggcaaatgtgatcaatgatcaagtcgtctggtatgaaaccattggcgattcgatatgcgaatcgatgagaaccgtaacgttggcctccatatccgaatactccgtagccgcatctaagagagcccgtccattcccaacagccgtatgtcatccgctggacgttagaccaaaatctgacagcgttctgtcgatcgactggctcattgatgcttttacgtcctccaccttcttgaatgggaagatgaggtaatagatgatcaggattgaaacaaagcggatttccacagatgtcatccatccagttgcaatctccctcatcacctttgaataaacgataagctatccttttcagaggaatggactcattgtttacatagatgcacaaatcggctcgactgttgtctttcacgattacacacccgttatccaattgagtggtgagctcatcgaagtcctccacagagaaagacttgtgatgtctgagtctatgtatcggcttccctcgataccactgctgataatgtccggtgcaaaatcctcttgcgagaacctttttggcgcatcccggaaaggtgcattgtgccatatattcctttctccttgggtataagaaaaagaaagcatggagtgtttcgttccgtttacggtgtccacccacttcgaggtcgtgttcgttcatgcgtctccggattcctcggcacgaaaatcaaggaataatagatattgcatccggatagagcggatgacggggttcgaacccgcggtctcctgcttgggaagcaggcgtgctgccactgcaccacatccgcgtcgcggggacgggccggccggcccgctgtctcgcgtattccattccgggggcgcgccgtcttgacatgacgtcgtccctcggaatgtccgcgcttacacgcggcggcatgccgcgtgtcgtggagccggcggggttcgaacccgcgaccttcccgttgcggacgggacgccctgccactgggcgacggccccgaagcgcccctgacccgattcgaacgggcgacacccggatccggaatccggtgctctgtcccctgagctacaagggcgtgcatccgccatgcgacggcatgcgtccccgcactgggcggggggattagggcgggatcatggcgctggcatggtcgcggacgggagaataaaagaagaaagaacccgtctcgcatgccatcgttcccgcacgcgcggagagaagagtccggcgtcgcgtgcgggcggcgttcacgccatgagccgcttcgagccccgggccggacacgatccggcgaccttccgcttacgaggcggacgctctaccggttgagctaccggggcggatgccggaaacccccggccgtccggcgacggcccccacgcgcccgtcacgggccatggggccggaccgggaggcgggcatgccgtcgtccggtccgaggggcgcgccgtttccgcggcacgggcctgcgcgccatggaggagtcgaacctccgtctacggttttggagaccgtgtgttttagcaagttggcgtccgctttgtgagcggtgtttttccgcagtgtaggcagcgggttttccgcagggtgtgcggtatcggccgctgcctgtctgcgttgtgttggttatttggtcatgagggcgtgttcgcttcggtaggagcggccctcgaatctgatgagccgtccgtggtggacggtgcggtcgatgagggcggcggccatgttcttgtcgccgagcacgcgtccccatccgctgaattcgatgttggtggtgtagatgatgctccttgtctcgtaggaatcggaaatgatctggaagaggagcctgctgccctcctcgtctatgggcaggtagccgaactcgtcgatgatgagaagtcgggccttgccgatgctcgcgagttcccggtcgagccggttctcctgctgggcgcggcgcagacgcatgagcagtccggtcgcggtgaagaagcgcaccgggacgccccgctcgcaggcgagccgtccgatcgcgatggccaggtggctcttgccggtgccgacgggcccgtagagcacgaggtcctcgcatccggcgacgaagtcgaggttctcgagctgcgcgcgcccccagtcggcgggcatcttcaggttggtccagtcatagccgtcgagggtcttgtcggcggggaagccggcctgtttgagcaggcgcaggcgtttggatcgctcgcgcgagtcgagttcggccgtgaaccatcgttcgatgaagtcgagctggttgggcgtggcctcggcgagcgtgcccgcgagcacgctgcgtgtcagggtcaggctgcggctcatcttcaggatcctctcgctcttctcggtcgtggacgcgcgacggcggcgggtctccgggatcaccggatcgggtctgacgctcaccgttcttcccctccgtcgtccgtgccggtgatgaaccggtcgtagccgctcaggtcgggctcctcgatcccgccggggtattcccactcgccgtcgcgcatgcgcaacgcgataggggtgagcgagtccgcgtgcaggcccatgtccctgttcgagcgcaggatctcgccgcacgcctgcatcgcgggatcgaacccggccgcccggcacgcgtccccgatcgctttgaggctctccctcaacgtcttttcgtccatggaatcaagccacgcgcgtatatcgtcgggcacgtccgggcggatcgagctttcccgccacgcgcggggtttgaccgcgagccggggaagcacgagcgcgggatcctccacattgcgcgaccgtccgtactgtctgggatactccgcgaagagctcgccggtggcgggcgaggtgagcgtgaccgtgtcccaccggatcgcggccaataccctggaacgcgccgaatcggggccggcgaggtaccggttcgagtcgatgtcgaccagcccgtacttgtcggccgtccggctttcccagcgaaccgggtcgaacgccgtggacggcaacggcatcaacgcggccctctcctcgtcgaacacctcggccacgggcacgtccagcaacctcgggcaatacgagtccctggcgagcccgtcgcaccgctccagcaggagacggctcaactgcccatacgattccgcgcgcatgggcggcaccatgagattgcgccgcaaaaacccgaccgcgttctccacgctgcccttctcgttgcccgaatacgggttgcagaaccggacctcgagccggtaatgcgccacgaacgcggagaacaccccggtcaacgcgacctcgcccttcgcgttgcgccggccggcaccggtcgcgttgtccatcacgatcacgggaggaacacccccgatatgctcgaacacgagcatcaggccatggcacagacactccgcgttctcgcccggcaacgccacgcacaaccgcatgttcgaatacggcaacgagaccaccaggcaatgcacgtccgccatctcgccagcgatccgggcccgggccacgccgaaatcgacctgcatgctgcccgccgcccactcgagccgcacgtacccctcgcgatccggcacgccgcggttcgcctcgcgccaccggtgcacgtaacgcatcgtggtcgaatactcgccgtcgtaatccgtctccgccagcagacggtcgtgcacgcgcctgatcgtgtgccgctgcttcctgggcagcagacgatcggcctccagccactcgtccaccagatgcgcgtacgggtcgatcttcgacccgtacctgcgatccgccttcggcttgggcgagcaatcctccatatccgcgtacttcgcgaccgtcccgcgatccacgtgaagacgccgcgctatctgcgcgcgcgacattccctgccggtcgagtctcctgatatcttgcacaatgggcatcggtatcgccatgttcctttccttcccgagcgccggccggcggcaaccggccgaatcaaaaccgattggcaactcgggaatatacaggcggcggcaccgatgcctatcacatcaccgggaaacgatgacgacaccggggaaaaccatcagcccacactacggaaaaacactgccgaacctgtcgaacaaacattgaagcaaaacagagaccgtcgggctgccgccgtcccgatggcgcgttcattgtttccgctcttcggttttcaaccatgccatgccggccgtgtccgcggcggcatggcatggtatgcgtctccggacggcaggccgacggaacgcgttccgccggccgagtggttccgggcggcttcgctccgccggcctgtccgattgattcgggccgttccgccggatcgggctacgaaaccgaccggaatcccgtcgtctcatgaccaggtgtcatcccggcttccaccgttcgccgtcgatccaatgggactggcctgacaggcggatcaaaccgcctgtcgtcgatccgcctgtttgcggccaggcggatggtggtggcgggaggactcgaacctccggtgtttctctgtcgcagagttacagtctgctgccgtcgccgctgggccacgccaccggtgcatcgcttttgcccgtcacggtgcgatgcgtaccgtgcccggttcatctgtgcccgcaagctcatgggagatggatcgggtcgtggagctgccgggaatcgaacccgggtctggcctgccgtcaaccattgcttgccgtcacgtgcgtatccgacgcttgacgctcatccgtggacgggtgcgttcggcgaacccgcacggcttgtagacgatgttcgtatgctggccgggcgaatccatcgtccgactgtccgaccagtccgattcgaagttctccggctttgacccgttaatcggcaatgggatcaaagccgggtttcacgccgcgagggtgaaacgggaagaagaaacggtgttggcgttcgttcttgtggcaaggttgatgacggttgtccctgccggcctccggcacgtagcgaatggtctccggcaggccatcgaaagcctgtcagccccgtgacatgggtcggatggcgtgaacatcagccatccgacccatgtcttcaatgccgccatcttgcaggggtggcgtctggtccaaggtcttgtcctcacgcccatgcgggtatgagtcgccttggacaggaatgtttctgatgtcgctcttcggttttcaagtctcgtcgccgaccgtccgtgcggtggcatgcgacggtatgcgtccccggtcgcggcgatcccctatgcgggggcgtgtatgcattccggccggcctgtatgcatccgtatgcatccggggatgcatacatcttctcttcccgtttcggcttggttccaacgttccggggatggtccgggggcgtgtatgcattgtatgcatcattcccttataggggattcgggaaaaaggaaggaaaccccttatattgatgcatacaatgcatacaagagaaaggaattctgtttttccctttatatataagggttttcgggctttttccaagccttttttgtatgcatccccggatgcatacagatgcatacatgcatacaagacggccggaagaacttcacaatgttgtaaagtccgcgcatgcggctccacggcatcgcgaaccccccggggagcccggcgaaacggatcggaggatcgcttgacgtcctcccctcggctgaagccggggattcctcccatcctgacgatgggaggaatccctccccacgcctgaaggcgggggcaccctcacggcaaaacggtcggggcgggcatcggggctgtatgcattccggttcgcgtgtatgcatccgtatgcatccggggatgcatacgtcttttctttccgtttcggcttgtttccaacgttccggggatggtccgggggcgtgtatgcattgtatgcatcattcccttataggggattcgggaaaaaggaaggaaaccccttatattgatgcatacaatgcatacaagataaaggaattctgttttttcctttatttataagggttttcgggctttttccgggctttttctgtatgcatccccggatgcatacagatgcatacacgcatacaaaacgggccggaaaactttacaatattgtaaaggccgggaccatgcccgtccggccccgcccccgcgtgacgcatacatgcgcgcatgatcgaaaaccagtacggccgtcccggcatcacgggcccggccacccccgggcacgcggacggggcgttcctcgcccgcgtcgccgaccagcacgtgctgctcagaaacccgacgggcgtgaccggcgtatgcaacaccatccaccccatggccggcgaccccgcgaccgacatgcccggcatccccatgctgcggagcctcgtgcagagggacggggcgagcacatggacatggaccgatccgagcggcctcatgcccatgtgggcgatccgcatgatcagcgagatcgtgtgccccgaccccgacctgcgcgtcctgcccgacccgcaggcgcccggcaagggcatcctctaccggcgcgtcctgcccgaccacaccgtcgaacgcgcgcccagccgatgggcgcccatcggacccgtgcgcatcgcctacggcggctccaaggccaaggacgaccaattggacggggacgacggatgggtcaaggactcgctcctcctcgccggacagaccatacgccgcggatgcagcttcatgtgcacggacggggagatccgcttcgaacacgaccccgtgtccggcgcgtggacgcgcaccgagacccgatccggcgtcacccgctcctggaccggcgcgaaagacctcgaatgccgggaaccggatttcaggacggccacgctccgggagacgacgccgaaccgggtcgacgagcccatgacctacacggtggagaccggatgcacgtgcgaacaggccgcgacgctcgcgaacgaggccggatggatcctcgaccagtggaccggccaggacacggacagcaccctcaacctgcaacgctcgctcgccgccccgttcctccgcagccatccggaatgcgcgtacgtgtaccaggggccgggcggcaccggcaaaagcacgctcgccaaggacctcatggagcatctcggcgaccaggccacgaccatgagcctcgacctgctcgcccagccgaccgccatgagcgccgaaaacaagatgggcgacctgatgagccacctgctcgccctgtccgacgactacgatccgacccacggacggttcgagaagagcctgccgaacctgaagaccctcctgaccgggctcctccccttctccgcgcgccgccagggcgagaacagcgtggacggcatgccgcaaagcacgcatctgatcaccacgaactaccatctgcccgtgtccagctccgaggccgaacaacgccgcttcgcgttcagcaccatcgcctcgcagacgacgcgcgcccgccactatctcccgttccgccgcaaacacggtttctggccgttcatgctggtcggcgcgatcacatggctgaagatcggcgaccggcaatgccggtccgtcgcgttcgtcgacctggaaagcctgtccgacatggaggtcgccgccatccgcagcgtgctcgacacgggcgtcgtgatccccgaccccggcatgcgcgtcaactggaagaacatcggcctggtgcgcaccagcacgcgtatcggcagcgaggacgggcgtccgcacaccgcgtaccggcccgccccgagggcgacggcctgcacgccgtatggaaggcgtgcgcggccgccgtgtccggcatgcccgccgacgagcccgagatccggcccgtccccgaccgggatctcaaggtcacggacccggacgggtgggcggacatgatccgggaggcggatccgcggatcttcccctgccatgcggacaagagcccgtccagcgacgtgccccaccattcgtggaaggacgcgtgccaggatccgcgggtggacatgtcgcaccggatcgacccgtcgaagccgatctacgggacgaccgtcgccgacgactacatgtgggtggacctcgactgccacaagcaggatcagacgtccggctgggagcagatccagacggacgtcggcccgtacgggacgccgctcctgccgcgcacgttcgcggtgcgcaccccgtccggcggcgtccacctcctctaccacatccctgacggggcgcgcctgaaatccaggacgcacaacggaggccagatcgacttcaaaatcggccgcgacggctacgtggtcatgggcgggtccgtcctgcccgacgggcggcgctacacgccgatagaccggcccgaggatcggatccccgacctgtccgacgcgttcctgcgctgggcggaacgcgtcgacgcgaccgacaaaccccgtcgccccgcccccgcgcggacggcggccgcgccggcgggcggcgcgtacgatccgctggccgcgttcgacctgccctcccccggcgtggccgggggcccggagggggagccggacatgagccccatccccgaggggcggcgcaacgacacgctctaccggtggggtacgggcgttggaagaaccatcccgaggacggggagcggatcgcgcgggacatcatggaacgcggacggatcagcgggctgcccgatcgcgagacgcttcagatcgtgaaaagcgtgagaagttcggtggaaggagaccgatgacgggcatgagcacggacgaatggcggctcctggtctcgacgcgcgccacggggcgcggcgaccggacggcaggcagggacgacaacagctgcggggcgctcatcgacgggcgcggcgaacggcacaccgcgttcatcgaccacatgcccgaacatccgagcgacgaatacaggcagttgcacgagtgggcggacggatacgggtggatgctcaccccggccgcggaccggctggccgaccggatcatcgacggcatgggcccgcatcccgcgcccgccgtcgcggccgcgctcgcctcctgctatcccgaccggctgatcatggcggacacgcgggccgtccgccgtcccgcggaacgatggttccacgaggccggacccctgcgtctcgaccggtacatgcacggcggcatgggcgacgtggcgcgcatgatcgtccacgaccggctgcacccggacatgcccgtcctggcgggacgccgcctggacgagctgatcgacgcccacgcgtacgacgcgctcatcgcgacgggcatgggcgacatgctcaccgtcgcccaatggacgagtatcgcccgccacggcgatccggcagcatgccggatcctcgacgggatgcgacgcggcatggacgacgcgttcgcctgcgggcgtctgcgcggcatgtgcacgcccgcataggccctctccggcggatcccgcgcgcgcgggacgccggaaagggaacctgaggaacaacaagatcgtgacggcaatggcctgcgcgaccgcgagcatgctggccggcctggcactggccccatccgcaatggcagccgacacgaccatcacactgcaaggcgcagacggagcaagcctggccggacacacgttcaacgtctaccagataggcacatacaccggagtggtgctgaaaggcaaccagatctccagcctcggaatccaaggcaccaccgaatccaacgcatgggcggatgacgccatcaccatcgccaacggttacgacaaggacacgtccgacgacatcaccaaggtcggcggatacgatgccgcaggcagcatcgccgccatcgacatggccaagcaggccaagcagctgagcaacatccaagccgccctcaacgcctccagcaggaagccggccaccgtcacgggcggagccgacctgaccacgcaggatgccaccctgaacatcaccgtgccggaagaaggcctctactacatcaccgactccgcaggcagcccgatcatcatcggcaccaaatccggtgcaggcaccgccatgagcggcgcccccggccgaaccctcggcgtcgcggtcatcaagtcgaagagcgtgacaaccgacaagaaggtcgtcgtggaccgtgacggccgacaggtctccaagcagggtgatgccgccgacccggtggccgtgaccgtgggcgataccgtcacccacaccatcgacgtgaccgttccgaacacggccgtcaaattcaagctcgccgatgcccctgccggacaggaatacgtgaaaggcagcctgaaggtggctttgagcgggactgccactgacgtgaccgccgataccgtcatctacgacggcgaaacccagcacggcgcgaaaaccctgccaggtgacgccactctcaagaaggaagacagaaccccggccgacccggatatcaccgttccggccggaggctgggctctgaacgccaccaagctcatcaccacgcagggcggcaagaagatcaccatcacctaccagagcgtcgtcaccaaggccacggccgagaaaccatccgaaaactcggtttccggcaccgccatcttcaaggacggagcccactacaccgtcgtcaccaatggcgacaaggttgacctgaaatcctacgatttcaccctcaagaaggtgagcgcagccgacgtgaacacgctcgtggatggagctgaattccagatccaacgcggagacaaatacctgaagctggatacgacgaccggcgaatggtccgaagccgccgaccaggcttccgcgaccacattcaccaccggtgactccaacaacgacggcaaggtcgaccataaggacaatgccgcgcaaaagggtcttatcgcattcaagggtctcggctacggcacctatacggtgaccgaaaccaaggagcccgccggctatgcctcctatgcgaagccgagcttcaccgtcaccatcgacgatgcaggcaccgccatcaggttcgccggcaaggatcagccgggcctgaccaccggcatcgacaacaacacggtccaagtcaagaacatcaccaacctgacccaattgccgcagaccggtggagccttggccttcgccttctggctggcggtctcctgcccattgtggggcagtggaatcgtcctcgccgaacgcagcctgaagaaccgtcgcaaggcagtcaatctggccggcaacggtctcgcctgatccaagagagaccatgacgcgggacgtgcgtcggaaaacgaaaacccgtcgaacgtcccgctcaataccttttttccaaaaccatgccgaacatgagattcaggggaagagaaaacacaatgcacagcatattgaaacgttccgccgcactgatcgcatccgcggccacgcttctcggcggaggcatgctcatggcgggcaccgcgcaggcggacgggatcggcctgccggtcatgaccatccatccggccgcgagcacatcgtatccgaaggagctggtcaacggcgatttccagacgttcggcaaccggatcgtcgacaaacgttccggcggccggcagtacctctcgttcgtcgacggcaacggcatggccatggaaggctcgagcgagcgaccatgggcgaaggtggacggctgggatgccgtgaaattcggctggaaatccaatgattccgtcagcgggcacagagggatcgtggaagtccaacgctttaggacggccgtcaaaggcagcacgggcaacgtgtggggcgagatcgcggccgccacgcagggcaaatacctctaccaggacatcgacacggcgaacacatccgacgccatgtacacggtccgtctgaagcacgccagccgcaacaaggacgccagggacagcatgcaggtgctcgtcggcgcgcccggccgggagaagccggtcacgatgcgccgcaccatcgccaatgcgggcgacaaggccggcgaggaatccaccacgatcacgtccacgggaaccggccaggacgaccagtgggacacgtacgagggcacggtcctcgtccccaggggacaggatgtcacacggttcacgttcaaaagcgtggccgattcgaacagtgccggccgtcccgacagcgcggaaggcaacctgatcgacgatgtcgtgttcaccaaggcctaccagctcacgtacgacgcgaacggaggcgtgaaaacccggaccagccagatcgactacacgacaggcggtgaaacccggggcaaggtgaagaccgtgcgggattcgcccgcaccgcccgcaggccaagagaagatcgtcaacggcgacttcgaatactcggggaccggggcgggcctgtccgactccccgtttaactacgtgagcctgagccggaaatcctactattacaaggattccaggaacgtcaaccaccgtgtcgccctgcccgccggattcgacgcgaaacggttcgcatggaaaagcgaccagaccggcaaggatctaggcaacccgccctacgaacaggccggcgacgtgcaggtgtggaacaggtacgacggctccaaccattacgccgaactcacggccgcccaggccggatcggccatctaccaggacatcgacaccgaatccgacagcgacgtgcagtacatcgtcagcctcaggcacgcgagcctgaacgccagccacctggacagcatgcaggtgctcatcggcgctcccggccacgagaccccggtaaccatgacccgcgtgaccgccaacgggtacggcgacaaggttggcgaatcctccgacacgatcgccaccagggtgtccaacccgaaacccgcggacagggaggactccgaccatacaggccaatgggagacgtacacgggaaccgtgaccgtgcccgctgggcggccggtcacccggttcacgttccgcaacgtgtcgtcgaagagcgcatggaacggcaacctcatcgacgacatcgcgttcacgaaagcccgcaggctcgactatgacgcgaacgggggaaccaaagcgcaggccagccagatcggctacaggaccgacgcgacccaaggcgcggtggagaccgtcgcatccaagacccttcccaccgaactggtgaacggttcgttcgattatctgctggatggcggttgggatactatcagcccggtaggtcgtggcggatacgctgatgaccgtggttggggcaggttcacaagtgtggaccccgctagcggcgaatacatccagaacgccggacagaatccggcaacattcgattccaccggcaagtgggtgaagtggcccggtttcgatgccgcgaagttcggctgggcttcggaccaaaagggcggacagccgcaaggcggagtcgggttgaccgaccggcccaatgcggtcgaattgcagcaggattccgtgacaggcaacacgtatgcggagatcgtcggctcggagaggggcaaggcgatcctacagaagatcgacacgcagcatgattcggacaccgtatacacggtgcgtttcgaccatgcgagcctgtccaaggagcacgcggactcgatgcaggttttggtcaacggcaagcccgtgaccatgacccgcgtcaccagcaacaaggcgggtgacgaacagggttggaccggtacgagcatcaccacgcacgcgaccaacaccaaccgtttccagcatgacggccagtgggcgacctacgagggcaaggtcacgatcccggcgaacacgcctgtcagcacgttcactttcaaagccctgaacgccgtggacccgaccaagggcaacctgatcgacaatctgacgttcaagatcgcatacaggctcagctacgacgcgaacggcggaaccggccaagtgccctcgcgcaccgagacgggcaggaccgaaaccgccgcctccaggatgaacggcacggtcaggcttgcggccgacagggacaccgaaccggagtccggaaccaccaccgacgatcgcaaggtgctgaccgacacgatcgccagacaggatgatgggaccagtcagcggacgatcacccgatccgacggcagcgtgcaggtgcagaccatcgccacgacgggcgccgtatccggctgccaggtctactatccggccggcgccaggatcaccctggcgaccgcgaaagccgactccgactgctgggattccagccagatcggcaagaccaaccgcacgttctacgggtggagcgcgaacacggacgccaacgacagggacgtgcccgtcgccgacaccatggaccgcgccaccctggatgcgaacgtcaggacggagatcgtcatgcccgccagggcgaagaccgtatacgcattgtgggccatcaaccccaccctgtcgtacaacgtgaacgcgcccgccggcagcaacgcgcccggcacgcccgcatcgcagaccgtgccctacaacacggccgccgccgacaaatccggttgggcggccggcgacacgggcaagattcccggctaccggttcgacggctggtacacggccccgaacggcggaaacaaatacgatttcaacacgccgctcaccggcaacgtgaccgtatacgcgaaatggacggccaacggctacaccgtgaaatacgatgcgggcggcggcaacggcaccatgagcgaccagaagttcacgttcgacgtgccgcagaacctgagcccgaacaccttcactcgcgacgggtacacgtttacggattggaagcgtgccgacaccggagactcctacacggatgggcagcaggtccccaacctgaccagcacgcccaacggggtcgtcacattggtcgcccaatggacgcccaaccaggcggcgatcaactacaacgcgaacccgccgacaggcaggacgccgggtggtcagggcaccgccaactggacgggccatacgggtgatacgccgaccatcagccagaacggctggacggtggacggttacacgttcaccggttggaacacgcaggctggcggcaaggggcaggcttacgcgcccggcaccaagtgggccgcgaacggcacgctcaccctgtacgcgcagtggactgcaggcgaggccagcctctcctacgacggcaacggggcgaccggcggcaagaccgacccgcagactggcaagaccgacgagaagatcaacgtgcgcgacaacggattcacccgcgacggctacacgttcgtcacgtggaacactcaggccgactgcaagggcaatgcagtgaaacctaacagcgagtggacgttgcgtggttccagcaccctatatgcctgctgggccggtaacgcacaaaccctcacctatcacggcaacggcgcaaccggaggcaacacggcggcacaatccggcaagaccggtgacgaactgaccacaaacgccaatggtttgacccgcgacggatacacgttcgttcgttgggacaccgccaaggacggttccggcaccgcatacggcgaaggcaagaacggcgtcagccggtacacgatgaagccagcaggcaacgacctgtacgcgatctggcaggccaaccccgccagcatccaatacagggacgactggggggccaccggttcgacgcccgacaccacgggcgtcaccggccagaacgtgaccatcgcccgaaacgggttcacccgccccggctacacgttcaccggctgggccagggacaggcgcacgaatccgagcctccagtccggaggccggtacacgctcactcccggcaccacgacactgtgggcccaatggaaggccgacccggcgcacctgatctacaacgcaaacaccggctccaccagccagacccgcaggacggacggcgtggtcgaccagacgctcaccgtcatcgccaacccgttcacccgccccggctacacgttcaccggctggaacacgcaggccgacggcaggggcagggcgtacacggcgggcaacgggttcagactggtcgccgatccgaagagcaacccggtcaacacgagcgtcctgtacgcgcagtggaggatcaaccgggtcaccctgaagttcaatccgaacgggggaaccggcggatacccggacatcaccatcgacgcgttcacgacggtcaccatcccggccgacgcgaaggagcccaaggtgcaaaggcccggcttccggttcaccggctgggccatgaaacccacgcccggcgccggtgacacgatcctcagccccggcaagggcacggtcagcatacccgaccggggcagcatcaccgtgtacgcgcaatgggcgccggccatgaccacgctcccgttcaccggcggccacgcccaggtgccgaccatcggcctgtacgcgggcctcgcgttcatgatcctcgccatgggcgggctcatgcccgtgatccggctgcgcatggccgcggcccgcaggggacgccacgccggcggcacgggcacggccggaaggcatgccaggtgagtatgggcacggccgcacccgacgtgtgggagaccatcgcggaagccgtccgcgaccggcgggaccgtgacaggcgggcccgccggctcctcgcccgcagccgcatgtacgcggccgcggccctcgcctgcctgatcgtcggcggcatcctcatctgcatgccgcggatccagcagctgatcggggaccggaccgtcgaccggcaggcgcgcggcgtcagccaatccgcggccatgttcccctcatccagccgccaggacgcgatccgcagcgccgtcgcatacaacgaacggctctaccggagcgggcagccccagatcggcgaacccgtgttcgacggcaagaccaagggaaacttcgagggcgacgacgaataccggcgccaactgtccgtcaacgggttggacgcgatgggtgaactgctgattccgaaaatcagcgtggatctgcctatcatgcacggcgcgagccaggatgtgctcgaacatgctgcgggtcatctggccggcacgagtctgcctgtcggaggcaggagcactcgtgccgtgattaccgggcattcgaacctgagggggcgaccctgttcacccggctcggggaactcgatgaggggacccgttctatatcaaggtcatgggcaacacgctcgcctaccgggtcaacgacatccgcattgtcagccccacggacacgaaggcgttgaagatccggaaaggacgggacgaagtcacgctgctgacctgcaccgggcagggcaacacgctccgtctcctcgtcaccggggaacgcaacagcatgcccgaccaggccccattgcccggcgatgcgccgagcgacacgaaacaggcgatcgtcatctcgctgatcgtcatggccggcgtgctgatcagcgggttcgcggcctgccgcagccgggatgtgttcggccggcatgttggaggtcatgggaacggacgtcgatagccgtcccatacggatcaaggacccgtctcatccgtgatgttgcttcgcggatgagacgggtccttgatgttcccggcggattggaatccgtcagtcgttcacatgccatccgtccgcatgcttggcggcacgcaccctcacgagcacgcagccggcgcccgcgatggtcatgatcgccgccagcgtggcgattgcggtggtgtccgatccggtggaggccagaccgtcgccggtcacgcctgcggcctgcttcctggcctgttcggccttctgcttcttggcttcggcatccttcttggcctggtcggccttcttctgggcttcctgctgcttcttggcttcctcctcggccttcttctgggcttcggcttcggcctgcttggcggcggcgagctccttgtcggacgcctgcttgtcggcgagcttggcgtcatagtcggccttggcgttggcgtatgccttgtcggcctcatccttggccttgttcgccgcgtccagcttggactgagcttccgtcagcttcgcgttcgccttcttgaggttctcctcggcgttctgcagacgcttgatggtgttctgggcgtcgtggagcttgccggtggccgtgttgaggtcgtccttcgccttcgcgtatgcggccttggcgtcggcgatggcctcgtcggcggccttgacctgcttgtcggcggcttcaaccttcgcgtcggaaacggtcttggcgtcgagcgcggcctgcttggccttctcggcctcggccttcgcggtcttggcggcggccaggtcggctgcggccttcgtcttgtccgtgttggcctgcttgatcgcggcttccgcatccgtcttgttcctggcggcggtttgggccagcttgtcggcggtatcgatcttcgcctgtgcggcggcgaccgccgtgttcgccttgtccactgccgtctgggctgcggtctgggcgtcggtggcggtggcggctgcggtctgggcttccttggtggcctgctgggcggcggagtacgcttcgttcttcgccgtctgatccttcctggcttcctccaacgccttggccttgtcctcgttcgccttcacggcctcgtcatacgctttctgcgcctcgtcggcggcagcctgcaaatccttggccttctgagcggcctgctgggccttgtcggcggccttttgcgcggactgctgggcggcggccagcgccttggccgcggcggaggcgtcctgtgcggcctgcttgctcttggacaatgcggcctgccagttcgcgtccgcgttggtcagcgaatcacgccatgcggtcagatccgccagatacgcgtccacgtccatgacacgccccgactggtcgggggccgcgtactggaacgtctgcccgtgcgtggtcccgtagccgagcgtcccgttctggctgatcgcgaaaccggtgaccgcgtagctcttgttgacgacattcagataatggccggtctcgcccaccgcgttcccgtccttgtcctggccgtcgagcacgccgtcggtcatgtccttctcgtaattggccttctcggtcgtgtaccagccgtcgaacgggtccttgtaaccccaggccatgttctcgccgacgtcgaactggccggaatggccgatgttgtcgtcggaccagtcgacgttcgccatgctcatcgccatgagcgtgtccgacaccttcaacggcgccaatccctccttggcgcgaagctggttcgcctccttgatatacgagagcgcggcgatcatgttgtcgaggctggtcgcatcgcccttcgccccgttctggatgctggacaggtagagggtcgtgtccttgtcggtgaggaccttgaccgcgtccgacgcgttccggtcgccgaagtaggcgaccgcaccctgcgagagcttcgactgcgcgtccgccgcgacctgcttcagccggtcggcctcggccttcgcctgttcggcggcctgccgtttcgccgtggcgttggaagaggagtcggacaccgtcttgtccgcgtccttccgcgcctgttccgccttccgctgggcggccgcggcatcggctgcggccttcttcgccgcttcgagcttcgcggccaggtcggaaagacctccatcatccttggacaattgctcgaccttggcatcggccttccgcttggcttcaagcgccttggcctcggcctgctcggccgcggccagcttggcctgcgcggcgttcaccgcctcgtcggccttcgtcttgtcgccggtcgccgtggcctgctgctgcttggccgcggccagctccttctcggcggccgccttgtcgctcgcggcctgcttcgcgtccgcgtcggcccggtcggccttcttctgcgcatcactgatggcggtatccgcctgatcggccttcttctgcgcgtccgtggtctgcttgtcggccgcgtcgatatcggtctgggccttgtcggcgtcctgctgatgggaggcggattcggccgtggcctcatccttcgcggtctgtgcggtctgcttgtcggcttctgccttcgactggttgtcggatgcctgttgcatggccttgttggcgtcgttgatggcgttggacgcggcgttcgcggcctgctgggcggcggcgatcttgtcggccgtgtcggtcgcatcctgtgcggcctgctgctgggccttgctggcatcgtcataattcttctgggcctgctgctggccgttcgcggctgtctgctgctgggcggcggcggcgtcgaggttccgcttggcggtgtccaacgcggctgcggcggcgtcggccttcgcctgcgcctcggtcacgccggtaggcgcggcctgcgcgatcgcctgattggcgtccgccgtgctttgtcgggcctgcgcgacactgtcctgcgcctgcgcgatcgcctgaccggcctgatccgtggtcgtggtctcgtcggccatggcgaccgcgggggcggcgagcgtggcgagcgtggccgtcgcggccaccgcgactgatgtgagtttgcgtgacatgttcgaatcctttcttccgggacttcctcatccaaccctccatcataggaaagagtggaccatatccgacggtcccgtctcatcatgcgacgcacggacccgccggcatgccccgtatgcgtcccgggcgcatccgccatgacatcgcggaccgggcgatccccgacccgttcccatgggcgtatgcggaccatcatcgacatgaatgcggcgtacaggccgctcccgccgcccgtacgccttccctagtcgagcacccaatcatcgtcgtccgggtccgcggcgacgttcaccgtcgtatccccgtccgcgtccgacgattggtcgacgacgcccacctgcttcggtttggccggcagcagatccgaccagtcgaccggcgtcgcgtccggcacgcccgccatgcgggcccgcacgtccgcgttcggaccgcaccaccagcattgcaccatctgcaggccgcgccccatgcgctcgtacacgcccctgcctttcggcatgccgcccgaatccatggcctgacggatcagccggccccccctccctctcgttccgcgcgctcacgttccccctcacgtcgcccgcgccgacgaacaggcggcccatctggctcttcgccagccccgcgtccggcaaagcgtccatgctctccgccttcatcatctgcgagcccaggatcatcgtgatcccctgggagcgatgctgggtgaggatatggctcaccgacgcgccgatccggcgtttcagccggtcgcgccacgcgtccatcatgatcatgttgtccacatccgggtcgcccgtcggattccgtttcacgcccttcgacagttccaggaggctcacgaactcgtccaggaacacgatgatgcgcggcgggcggatgccggccggcagcatgtcgatgttctccgccccatgctccttctgcaatgcgagccggcgccgcccctcacggtcgatccagtcgagcatggccgcgcactcgtccaacccggtcgcgaacccggacagtttgcctttcacgggcgcgaaatcgttgcccgacttcaccggatcgccgacgaacgcctgccagccgtgcaacagggcggcgttcaccagggtgacggccgcgctcgtcttgccgctcatcgtctgcccggtgatcagcagatgcgccgtgtcatgagggtcgaacaggaccgtgcgcccgtcgtcgccgaccgcgaacggcaggcccgtcgaatccgggtccgcgcccatgagccgccagtccgccatgacccgttccggcagcggatccatgcgtgacaggaggagcgtgagcggcgcatctcccctgacgcggcgcgcgtacatgaacccgccggtcgcgcggaacgcgtccagacggcccatcgcgccctccacgcccaggccggccggcagggcgaacgacgccttgacgagccggccgcccccgtcctcgacgcgcagcgtggtcacgggacgcccgtccgcgcccgtcgccttggacgcggcccacgcctcgtccaggcgcagcctgatcatccggtccatgtcccggcgggaacgccagtcgcgcgcgtccatgctcggcacgccgcccgcccacaggatcgcatgcccctggtcgcgccactcccacagcgtctcgtccgcacccatcgcgcttttcagacgttcctgcacgcgacgcagatccgacgcggtcagcccgccctccaggcggatcgggatacgccatgcgctgttcgcgcccacgcccaactggcttgcggccccgaccgtgggcggcgtcttcagggcgagcgcgcacgcgtgcgacacgatgacgcgcgccaggaggctgcgcgccctcgaatcgccggtcagggcgcgcagcgtgtccggcatcccccggttgtcgtccgtgttgggcgcgtgcacgaactggaggagccgggagcggggccggtctccttccagccagggcaggaagtccgcgatcgggctttccgagaacgcgccgcgcaggttcgaacgcatgtagtcggcggccgtgtacgcgcggcctatcgccatcgcgtacgatgtgatccgccagccggccggatcggcgatgatttccgtgttgtcgtggaagatcgtttcgggggcgggcagtttcacgggttccaggccgcccgacatgatcgatttcaaccgtttgtcctcgccgatcagccgcatgtagcggaccggatcgtcatggcggcgggtcagcgtgtcggacatgagcggccgcatcgtctccacgtcccattcataggagtcccagtccgcgtccacgctcacccagccgtgcccgccgcccggatccgcggtcaccagtatgttctccgtgttcatccagtcgccgaacgcgccgggcgcggcccccttcagccagtcgcgggagatcatgtcccagtcggcgttcgacccgtcgatgcggaacgagcggaccgcgggcctgccgtcccgggacgcgacgatcctcacgtccgtgacgcgtccggggaacgcgccgtacatggcgcccatgcgcgtctcgtcgaccatgaggcgcgcttcgagcatcgtccggtcggcgagcaggtccgccgggtcgggcgcgtccgcggggcagacggcgaccgtgacccgcgtcctgtcgcgccccatgaacgcgaagcccgcaagcatgccgtccgcctgggtgacgggcgtgaacgtcttcatggtcgaatcgttcgcccattggacggcgttcgacacgtccagttggaagacgcgcgacccgtccgcgccgacacgcgtgtcgtgcgcgccgccgggcagcgcgtcgaacggcggcttgttcaggcccgcgatccaccggccgaccatgaggcggctctcataatccgtatggaagcgtttccggttcgcccgccatgcgggccacatggggcggcggcgcccaggcacatgagcatgggcatgggccaccagacgcccgtccacgcggattggaggacgccgagaacgagtcccgcgcccagtcccgtgagtatccacggcagccgtttcctcgcccatctgacgcgcatgcgccgcatgttcgaatccaggccgcgcacggtgcaggtcatgtcgcggcgctgctggccgacgcccatgacggccagccagcaggccagcatgtccgcgcccgccatgatcggacgccacgtgccggacgcggacgatatccacccgtagtcgaggcatgcgatcgccatggcgggcatcgcgtccgcatacaggggagacagcccgccgtcgagccaacgggaggcgcgacgccatgacgcctccatgcgccgctccctctcgtccccgggcgccggccggccgtccagacccttgccggacaggacgggacgccgggccgtcagacgggccgccagccagcccagacaccagacggtcatgcccggcagacggaacgcggtcagcatgagcgcgacgacgagcgtgaggacacggacgaacgcgtgcgggctggacggttcgtcccgtttcgttttcggccgcgaccggccgttccgacggtatgccatgcgcgccgcctatgccggcccgcgcataggcgcccccgcagacgaccacggaaaggagccatcatgggcgtggacaggaacgggaggagccacaggccgagcggactgccgcaggggtatgcgggcacgttcgacaggacgggcggggatgcgggcggcgacgtggccccgcccgacccgctgatcgccatggcgagcgaaagcatgcgcatgcgcgcgctgaccgaccatacacaggtgaaaagcgcgtcggagacgcggggcctgctcgacatggccgaccatgtcgaatacgggccggacggcgcgatcctgtacgacggggacgggaacatcctgttccgtgaggatccgtccgtgcccggactcgactcgacggtgatgcggcacgatccgaaaacgcaggccgcggttcgagccgcgttccaggcggacctgggcgaatacccggccgccggccggcgcgccctgatccgtgccgcgaaccggcatgcgagcgcgtattcacggcgccgcgccatcgattcgagcccgaaccgcaggtatctgcccgcatccacgatcgcgtcgagcctcgcccggcgtgccgaccgggacacggcggaccggatcctgcgcgaactgcactacgaggacgcgaacgcgagcgcgaacgtgatccgcgccggctacccggacgacaaggcgagcgcgttcaaattcatcaactacacgaagatccgacgcgacaaggacggcaggccggtgcacggcgaatggaccgaccgggacgggaagcgcaagagcgggatcatgcccgaaccgcgggggccgcgtcccgcgcctacctcaggatgctgtaccagccgaccgacggcgtcccctcgaagcaggagtgcgaccgcatggcccacgtgttcgcccgcatggacgatccggacatccaggccagggcgttctggaacctgtgccacggcaacgcgaacccggacgaccggtgggacgacgtgaacttcgaaatcgggctgatcggccagaaaaggacggacaggggcggcgccgcgctgctcgacgcgtacagtcggcgcaaaggcggtcagggcaacgcggcgcgcatgctcgcctacaggaaatgcatgagccgtgacgcggccgtccgtttcctcgccatggacgacatggacgcgcggcgcgcgcacacccagtacacgcgccgccgtcgcagcaggacgacggggctcatggaggacgtgaagccgaaacggctcaccgagatgcgcgcgttcatccacgcggtctaccagatccccaaccgtgaggtcgacgagtaccgggccgtacgggacgcggacgcgtgacgatcagggaagaaaagagggggccgtccggttcccgcctgccccgatggggttgcgggaccggacggcccctcttcctgtgccggaacggcccgtcatgcgacgggtcggggttcggcgggctcccagtcctcgccgatctcctcctcgttgacccagtcgcgctcccacagggagtagccgccggccagcgcgtattccacgccggtcaggccgttcaggtcggccacgtgcaacgcgtcctccttggacgcgcaccatgtggcgttctgcgcgtccggctcccatgcgccgtccgtgccgtcaaggtcggcgtcgtacagccatgcgccgtccatatcgcggcgcaccgcgtattcgacgccgcccttaccgttcaatcggaccatgtcgtcttcctttcgtccatgattgatgccgttttccgaagcccgctatgcgtccccgcgcagcatgcgcgtggattcggcgagcatgagggccgcgaggcgtcccgcggcgcggatgcgttccagccgggcgtccagcgtcccctccccgtccccgtcatggtcgaggatgaggcggatcacgcgttccacgtcgcgggcgagcgtggagtccagccacgcgaacagggcggcccgttccggccggccttcggccagtccgggcacgtcgggcacgatcggcccgtacgccttgcgcgccgccgcccattggacgcgcagcagttccagcgcgatcgggcggatgcgttccgtatgcccgtcggcgagcaggccggcgcgggcgaacgtgagcgtcagctgcgtgaacccgtatccggcgacgttgaacccgtgttccgaccaggacgggtcgtacggcctgcgctccgcgagcgtcacctccggcacgggctccggctcggatgcggcggattccggcgcctgttccggcacgggttccggcttcgcctccggatccgtcgcgggttccgtcccggatgcgacgggttccggcttcggcgtcggattccacggatcctcgcccggacccgaacccatccaccggtccatcgtctcacgcccctgcggcgtctcccacggatccggcgccggggcgggcaggcccgcgcgaggacgcgccacggcctccccctccggccccgagggcttcgcctccgcgacgggggcgtccaatccgaacagatcaagcatgacgggctcctttcccacatgattccaaccgccggtatgcgtccccgcgaacccgacgcgcggatcgtccggaccgacgctcgacaaggcgtcccgccggcccgacggtatgatccgggccagcgggcaggcgcgcgccaccggacaccaggcgcacaggcccgacggcctcaacggcaggacgccgtccccgtccgcgcccgtcgcgcgcacaatcccgtcccacgcatgatggaaacgggacacggtgtccgtgcacgccgcatccgacaggtccgcggccgcccacgcatgatgctccacatacacgtcacgcgccgcacgcacctcgcacacgccgttcgcctccagcatcagccggtacaggcgcagctggtccgcatgccgccggcgggcgtcacggtacttcggcgtgccgcccgtcttccaatccaccaccgtgccgtccacgtcacgatagtccacggcgccacgcaacgggatgccgtcgacatccgcctccagatcctgctccaacgcggccggctccaacacgcggcccaacgcgtccgtcaaaacgaaccccgacagcttcgccgccgcggcccccacccaatcatcctgcgtggcgggcgaaccgtccggcatcgccacgccgggcgggatcggctcatcgccccaaccccgcgccctccaccgctcgtactccacgccgacgcccctggcgcacagggcccgccaatccggggcgacacgatccggcgtacggcaggcaagctccaacgcggcgtgcgcgatgccgcccaggacgagcggactgccccacagacggggcttcggcatcagcttctccgccgcccaacgcgccgggcacgacatccacttgtccaacgcgctgaacgacgcgtgcgagggacgcgccagacgcgcacgggcgacacccgcccccatatcgaacgtcatcaacagttcatcactcatacgcgcgcttatgcgtccccgaaaaaaaacaggccggggcccgccggccccctcccggaaaaggaaagggacgacgggtcccggcccatgtcgccgccggttcaggcggcgagcctccacgcatggtccaggcactcccacaaggggcagtaccggcgcgacgcccactcgaaccccctgaacgggggacggtcagccgcgggtcgatccgcgcgagctccctgtcgcacaacgggacgcccagacggcgcagccacggcagacgcgccatcgccgccctcaccatgcgcgcgtcatacgagccgtccgccgacggccggggcagcgcatgatgttcggacaggagcgggaggaacgattccggcacgtccaaaagacgcgccgtctggcccgcggccagcatgcccggcatcaccatcaggccaaccccctgaccgcatccacatccaggccgggcgcggcggacgccagcgcgtactgcaggtcggtgggcgacgagcccgtcggcttgaccgaacccgccagatccgggtcgagcgcgagcgcgaccctggcggcgcgcctgacgcccgccatgtccttctccaacgcctggccgaccaggatcgcgcgtcgcagcggatccgtctcgtcatgccatgcgacaagcaggccgaccggcgccgacaggccgcccttcaacacggccagggcgagacggtccgcatcgtccgcgtccacgtccgcggcggacgcgaccacgcggcgcgtccgcccgtcgtccagcagggccagcgcctcgcgcgcctgacgcacccgatccgcggtccacgcgaacgcggggcgcgcgcgtttcggacgcggcctcgcctccacggccttcggctccgccggccccgcgtcggcctgcggttccggcgcggccggaacatccggcacgggttccggcacgggttccggctgcgggtcgaaaccgttccaaccccgatcaccatcgaacatcgacatgctattgctccttcaatccagggacggatatcgtcacgccgcccctatgcgcgtgcgacgcatcatgccacgccccgtcgaacagacggcggcgcggccggcgggcgtccggcgcaagccgcggacgaaaacgaaaaaaaggagacaaagaaaaggaaaaagagaaaaagagcaaaagaggaaaacacgatacgacaccatcccatcagccatcggaaaagaaaaaagacaggacaccgacacccaggaacacacgcgacggacatcacaccacaaaacagcatcacatcaaggggagggatcgtttttccttgcaaaaaaccgggtttcgggggcgcatagccgcccgccatgactcaggcggctatcacgttcgtgaccggcggatccggcggcatcggcaaaagcaccgccgcccgcatgctcgcccacgcgctcggctccgcccggctgcgcaccgcgctcgtcgacggcaaccccggacagcagtcccaacgcgcctggctgaacgtccccgattcgaaggcgttggaatacgcgttcgtcgacggattgcagtccgcgctcgtccggccccgggacacgggcggcatgttcgcgctgctcgccggacccgccgacccgcattccagggacatgacccacgactacctggaagcggtcatcggactgcgggccatgtgcgacatgatcgtcgtggacgcggaccgtgtcgacgggcgcctgtgggacgatcccgcttcgttcgcgggcggcgtcatgcggcccatggtcgagacgggcggggcgcgcatcctgttcaggatcggccagtccggctcgcagacggacgacgggctcgccgcattggacgcgatccgccggccggaccggatccgcgcggtggcggtcgcgcctcccggcgtgaagccgtggccggcccgccgctggcgggcattgctcgacgggctcgccgaatacgggggcgtggacgagtgggatgaggcgagccgccggctcatcgactcgcatgcgtgcggatgggcgcatggcatggaaccggattggctgcgcggcgcatgcatatggatgggcgtcgaccctcatgcatggaacccggcggagggggggcgatcatggctgccatggtcccggacgcgatgagcggcgtccaggcggcgcgggacgcgaacctgatacgcgcggaggccttggtcgcggtgcgcgcgaaggcggagcgcggggatttcacgcatgccctgtccgacctgctgcgtgacgcgttgggatcgaggccgctgctgcgcctgcacatctggcgtgtcgaacaggccgcgttcgacaatcggacggcgacatgcaaacggcatgcgcgcatcgcggccggatggtgcggggtggacggggcgcgcgccggatccctgacgctcgcctggctgttggacgagcggacgggcggcgcgaggctcgccgcatggctgctcgccatcagcctggacatgcgtgacgcgcatggcgggcacgcgttccgcctgtccggcccggacccgttcgcgcatgtacgctcctagtcgctgatcaggcgggcggccatggtgccgagctccctgatcacgtcgaattcggtgacgtcgttggcggcggcgacccgttggacggcgcgtttcaggtcgggctgccagacgcgccgccggctggtctgggtcggccagtagaggcggacggcgtcatgcatgccggtccacggatgcgggtcgtgttcgaggagtggcgccatgtcctgcgggatgggggcgagcatgagcatgcacgcggtgttcgcgtcgagcctgtcgagcgtatggtcccacaggcccgcgtcgcgtgcgatccggatcgcgtcctcgcatgtgccgtcggtcacggcgcgcatcatctgctccctgatccggccgacggggcgcggcaccctgagcgtcggatcgcgttcgaacggggcggacgccatgctgccgccggccacgctcgtgctcgacgcgtcgtcgtacacgggattatgcccgtcctcggtctcgaacgcgctcgcgctgggcgtcctggttttgagcacgcgtttcgcgttccactgggcgagcggcaggctgatgcgccgaacccatccgcagaagctggtgggttcggtcggatcccacaggccgttccagttccattgcgtgcttttcgattcgacgggcacgcccgtgatcttctcgaacacgcggaccgtgacccagcgggtcatggtgtcccgctgctcctcgaccgggtagaggcgtcgcatctcgccttccacgaggtcggtctgctgcatccacgcggcggccagcatccgttcccgggatccgaattcgacggccctgtcggtccagtcgatgccgcgcacatgccggtcgagctcctccctggcggccggatcgtcggccagcctgtgtttcggcttccattcgcccatcatgcgtccgatcgaggtcgcgatcccgtgccgcgcatccgcccccatcggcctcctttcacgcgcgcgtatgcgttccggggcataggggcgggcatgtggttcgaactggttcccgcgccgcgcgcggatgagacggatgacgatgtgaggttccagcgtgacgcgaaggccatggccgacgcgatcggcttgtcgtcgcgtcccggatggctggactggtggaggcatgacgacgggtgccggctcgtggcggccggcgaacgccggtgggtggaggtgtccgaccggtacgggcagaaggcgggcgaactggtcgcccgtgcggcgcacgcgtcgattcgcgcgtgcgggcggccggacgtgctggaccgtccccgcgtgtgggcgcacgcgttcgtcccgatcagcgcgtccctggcgcgtacggcgcgcgacggggagccgagcatggagcgtccccgcctggatgcgggcgaggacacggtgatcgtggtgaacgtgcgccggctcggctgggtcgagtcgggccgcctgtcggattggctgggcgacgagtacaacatgcaggcggacacgtcgaagctcaggggcgaggggttgggcgcgtgccgtgtgatggcgggcggcgcggatccgcgcacggcgatggatcaggcgaagcgggcggcgaacgcgttgaacctgggcctggtgccgggcctgtccgcgcatgtgagccgtcccggcctggggttcctcctgtgcatgctcctcctgacggccgtgtccgtgcctgccgtcctgctcctgcccgccgcgcccgcctggctcatgaccgtccccgcgttcatgctcgccgggacggcgggggcggtcgtgcgttggcgtctgcgccatgatcccgtgaacgatctggctcagaggccccgccattactggtggcgtgcgcgcagacggtgggcgcgcgccgcggatttgaagacccggatggcgggcgacgatcagaacgcggacgggccgggccggaagcggcgcgtccacgcgtacgcgttccaacggtccacgctgccgttgccgtgcggcgcgctggccgccctggcggtcccgtcgggacggcgcaacgcgtcggtgagcgcgctgacggtcatgcccgaccagttggacgggtgcgacgggcccatactgggcgtggacgcggaacggcgcacggtgcgcatgagcgtggacgcgttgtacggcggcgtgttcctcatgggcgagcctggcggcgggaaaagcaacatgatgcatggggtggccgggtggatgggcggccggcatcggacgggcgacgtgctcgtcgacttcgaatcgaagggcgtggacgcgcagcccgtgctgaagcgtctcatcccgggcctgctcgtcgtggacgtgaacgatccgggcacgccgatgatcgacctgctgggcgccgggtcgaacgtggagcgtgcgggccggttcgcggatctcatgcaggccgcgttgggcgtccagcagatcggcccccagtcgcgcatccagttgcgtgacgcgacgttcgtcgccctggagggtctggcggcggcggatctgggggcgcggtgcaacgcgtgctccgttcccgtgccggatggctgggtcgaatatgcggcgcgccttttgggacgtaacggggtgatggatgcgcgcatgctgggccgtgcgagcgtgttcgcgtgcgacacgcgtggggtgcgggacgcggtggagcgattgcatggcggcgtgtcggacaaggggacgccgaagatccgcgacggggagcttgccggcctgctgcgcgcgcccatgaacaagatggacgtgctcgcgtccgcgggccgcgtgttcgcgccgtcccggcgcgtcctgtcctgggcgtccgtgatccgccggtccgcgcatgcgggcgacgtgcgcatcatggtcaacctgggcgccgcgatccggacgggcgcggacggccggcatgcggatctgcccgacggggcgcgccgtctgatcggcgcgctcctgttccgcggcctgaaggacgagatcgtcgcctcctgcgcgggctggcaggcgcgggggcgtgcggcgcgcatcctggtcgacgagctgacggacgtgctgggcgcggacggcgacacgggtggcggcaacgcggacatcctcgcctggctgcgtgagaaggggcgcgcgtacggcgtgcagctggtggcgggcacgcagaacgcggtccagttggagggcgggctgctcgcctcggtgaccggcctgatgacggtcggcacgttcgtgttgcgcgcggatctgacggcgggcccgtccgccgtggcggtcgggtcggatccggcgacggtgcgcggcctgccgttgcacacggtgctggtgcgcacggtcggccctcccccggacatggcgggcctgcctcccatgatcctgtccgtcccccatttcgacgcgggcgcgcccgtgtgacgcatacccgggtcgcaaaccgttgttttgtgtggaaaggacatgatggtgagggtattggtcgatgcgagggagttcgcgaacatggtcgcgcatgcggcgcgcgtgctggagcgcgacaacccgtatgtcgcgttggatgccgcggatgacggcctggcgatcggcgcggcgggcgacagccagtggtcgcatggccgtgtggacgcgaccgtcctggaggcgggttccgcggtcgtgtcgggcctgtggctgaacgcgttggcgaacgcgatgccgtcgggcgagatcggcgtggaggcggatggcgtgtatctgacgttgcgtggcggcgaggcgtcgctgcgcatgcgtgtgggcgatgagggggatcgtccggccgaaccggccgccccggagcggatggtgcccgtggatgccgacgcgtacgccgcgttgtgcggcagcgtcgccccggaggcgggcggcacgagggaccagccggtcctcgcgtccgtcaggttcgtcgcggccggcggcctgctgacggcgacggccacgaaccggtacatggccggccgcaggtccatcccggtcggcggcgtgccggacggcgaatggctggcggacgcggattgggtgaaacgcaatgcgaagggggtgaacgcgatcgggttcacggaccggatgatggttgtggatacgggtgggttcacggacgcgatcatgctgaccgccggacagtatccgatggtggaccgcctgttcgacaggccgggggatccggcgggcgtggcggtcgtggacaggcgcgccctgatggatgcggcgcgcatgctgaaaagcgtctgcttcgactcgcgcatgggcatcatcccgctgatcctggacgagcgggacgggatgcttcgcgtccggtatgcgggcgacgggcaggatgcggattcgcagggcgtgcgtctcctggaggcggacatcaccggggatgtggacgtgaaactgaacgcggattacctgctgaccgtgcttgcgggcatggatgcggacagggtgtcggtggtgaagacccgtgaaatgaagcccgtcctgttcgaacaggacgattccgcggtggagcatttggtgatgcccgtccgttaggattgtccccgacatgcgggggaaacggtgtcgcgtccggacggacgcgacaccgttgtagatgactttgttttagcttgtcgctagagcgaagtcatctgcatggcctcgttgccgagaccagctccaagcctcacgcggctctcgccgccgcttggttcgcgtttcacaggggtcggcattgtccgactgctgccggtctgtcttacgtcccctccacgcgcgtttaacgtctccggggcactcccggcgacttggatgttgatggccgcgttcagatcgcggtcgatgacaagcccgcactcctcgcaatggtagacgcgctcggacagggacagtttggctttcaccgtcccgcagctcgagcatgtcttgctgcttggataccagcggtcgatgacgtggagcctcgcgccggcgcgtgcggtcttgtaggtcagtagacgtcggaactccgcgaacgcggcgtcctgaatcgattgggcgagcccgtggttcttgaccatgcccgccacgttcaagtcctcgatgccgatgtccgcgtaggcatgggcgagcatggtggtggtcttgtccagtaggtcgcggcgtaggtccgccacgcgggcgtgcagacgcgcgactctcgttctcgccttgcggcggcggttggagcctttccgtttgcggctcagattcttctgttcccgcctcaatcgtctgaggttcgagtccaacgcgcgtggattgcggatgatggtgccgtctgacagtgtggcgagctgtttcacacccaaatcgatgccgacactaccacctttcagcggcgtgggcatcggaccatccttgcgctcgacggtcaaactcgccatccagcgtcccgcatgccgggatacgctcatgcgcagtatcttcgcgccatccacccgcttggatacgttctccatgcaatgcacgcggcctatcttcgggagccgcagcgcataagggtcatagtcaatgagaccaaacgaacccgtcgtgtacgcgaagcggggtgtcgccctgtccttggacttgaatcggggaagccgaccctgcgccccttcctcaatcccttgcgagacttcgaccagttcgacagcgcgtccgccaaagacttaagaccagcgttgtacgcctccttactgttcttccgccaccacgtttcgcccgtcacggcgttgacggcgagcgtgcccttggcctgattccaccacccgcgcagcgcgtagtatgaccattccggcttctcctgccgttcaagcatgtccttgacgtgcgccagtcccgcgttgtacgcgaatcgcgccgcaccagcatgggactccaagagtcgttcctgccgtggcgtcgggtcgagcgccaccttgaccgcctcaagcatcgcgtgccgccctcaacgccgcgtccgtcttgtgcttggcggcacgccttccgtacagtctcgcgcagaacgaggtcagcacctcggtcatatcgcgcaccaaatcgtcatccagtcccgtgtcatccaccacgatgattcggcgtccctgcgccttcaacgcgctctccaccaagcccgcgttcatacgggcgagcctgtcgcgatgctccacgatcagccctttttttgtccggtcctggccgtcaggggcgcgtgtcgtgcgcggcgagcatcctgtcggcgaggctgtccccggcgtcgccgagggcctgcgcccagcgtcgccccaacggctccccgtcggccggcccgggcgtgtccggtcccggttccgtatcgtgatccgtctcgatgacgggtccggggtcgtccggtccgggcgtgattccgggcgtgggctccggcgtcggagccgccgaaggcccggccgggtccggcgacgcggcctcggccatggcctgccggtcgaacgtgcggcccgcggcgagcacgatcatgtgcgtggtcgcgagcagggcgaccggcggcacggtcatgatgaccggcggcacccagtcgggcagcagcatcccgttgacccgcaccggatgcgcgtgcagcgcgttgccggccaggctgatcacgctgaacaggacgagcatgagccacgggtacagggtgcccatgcgccgcgtcttgaacgcccacgccgcccacgtgaacgcgagcgtcgacccgtcgatgatgatcgggaacatccacgccagcgacgcgttgatcccgcacgcgagcccgacggcgcgcaacgcgtcgaagctgatgatgaacgcgagcagggcgagcacgaccgcgaccgtcacgcccggccacatgcgcgcctcgcgccccccgttcacatggcctccgtgagttccgccgccacccggttcagcagtctcgcatgtttgaggtcatgggccttcacgcacgtgtcgtacaggccgagcgccagggtggccgcatgcgacgggtccgccgcccgggcgacgcgggccggctccacgcccgcctctttgaacaggttcagggcatgacgcgccctcgcccggcgtcgatcgtactcgttgtcctcaagccaggcctcaatgacgccggccaggcggcgcatgtcctcgatcgtctcgtccatgggtggtcccctttctcgatggtcaaccgtccggccttgtatgcgtcccccggccccgcgcatagcccggcatgcatgaaacgtctcctgcccttcctgctcgccgccggcccgccggcgctcgtcctgctgctcgcgctcgccatggtggtcgtgggcgcgcccgcgggcatgaccgccaccaccatggccaccatggcggacatggccgactgtacggacgacacggacacgacggccgcggcggcgacggggacgacggtcacgcccaacgacgtggccgtgtccctcgccagggcgttcgccaaggccgggtattcgagggcgagcacggcgggcgtgctcggcgtcatccagttcgaatcgggcatgaaccccgcgcaggagcagatcggcgaacccgatcccatgctgcgcggctacgggctgaaccagtggacgccgcgaagcaagatccgcgactggatggacgcgaaccacgtgtcgggcgaggattccgacgcggacgtgcagatccgcatgctcgtcgccaccgcgcagaccgatttcaacaaccatttcctcgccgccgtcagggccgaggggcacgagcccaccgacaacgacctgcacacgtggtggctgaaggccgacaatcccgaggatgcggccgtcgcctggatggccggctacgggcgcccctactgggcggaccggcatgagaaggaacgcgagcagtacgcgcgctcctactacgattcgaaggagctcgccgacatcgacttcccggccgaatcgaagccggacgggaagaaggacgccgccttcccgtcggacacgtcggacacggacgcgtcatgcgacgcggatgcggacgattcgtccgacggggacgcgaaatacggggatgtgggcggcgctcccacgaacacgcatgacttcggctggatgtgcgccacgaagctgaagatctgccatgccggggacatgggcgcccctcccctcgactggcaggccgtgggcgactaccagtgctactggtattggctggcccgctcctggctggtgcatgacggggacgtcatcaacccgcacacggcgaacggcgggcaactgtccgactgggcggcgggcacgaaggggtggacgcgttccgacgagcccaggccgggcgcgggcgtctgcttctggggcggcggcaacaaccacgtcgcgttcgtggagaaggtggacaaggatccgtccggctggaagatcatgatcagcgagggcaacttcaacgacgggggcgcgggcctgtggaccagctacaacgcgcgctggctgacgaaaggcgaatacgcggccgcctccggcaacgggttcttctggaaggacagctggaagctctagcagtagcccgggttctggcaggactggccgtcgccgacccgcacggggatgctcccccacaggctcatgtccacgttttcgtcggccatgaaccgggtttcgggcgggatgacggtcagcccgtcgccggtcagcgccccccagtcgggttcgcccctcacggggatgccgacccttccccggccgttcatccggtcgccgatgcccgtgtcccatacgccgagccacgggtcgatccaccaggggtcggcctgccggtggcggatccccgtgatccgcccgtcccggaccgtgagcctgtcgtccaccggatagtcgatccaggtgggcgtgatcccccaccagtcgtccacgtgcaacgtgttcgggttctggttgccggccaggtacatgaagcggacggtgccggtcacgcgtacgcccgtcccgtccgcggccgcgtgggggccgtccgtccaccggctcccgtacccccaggcgatgcgggcgagccatgcggccgcgtcgagcccgtccgcgcaccaggcgcgttcgcccgtgtcgccgacctggtcgagccgccggtaggcgcggcatgcggggttggcggcgtgcgggcccgcgtccgcctggcgggcgggcaggttctcgcccgtggccggatcgtccgcgggcggcgtgccgtgcagtgaggcgagcacgcttcccgcgtcctttcgcgcgagcgtgtcggcgcggatggtgctgtcggcgccccattcgcgcaggcgtctctcgaacgtcgcggcgtgttcgacggtcttcgcgtcgggcgcggccgtcacggcctgcggtttcgtcccggtcttccccgtgtcggtctcctgccgcgcgcatccggcggccagtatgacgccggcgagcgtggcgacggctatgagggtgcgcgatcgtggtctcatgcgcgcaggctatgcgcgcataggcgtcgcacatgccgttcaatcctttcgccgccggtcccgccgaacccgtcgcggagccgtcgccggcggagccggccgatgggggcgcgacgcgggaatccgacgtcgacgacggctggtgggatttcgggagcggaccggatgcggcggacgcgacgccggaccccgatccggcggacgccgcggcggacgacggccggcgggatgcggacgggaggggcgggcgatccgaagacgcgcccgatcccatgccggacgacggggcggacgacgactggtggggcatggcctccgatgcgggaggggacgacgcgcccccggcccggacggcgcgggaccccgccggacccgccgcccatgcgggcgacgacacggatgcggacgacgactggtggggcatggccggcggggaggccatgccgggcccgccggccgggatcccggcgcgcacggggacggacgagacccccggcatggacgcggacgacgactggtggggcatggccggcggggacgggccgcgatccgacgacgccgatccgacgccgcggctcgtcagcgtgcccggcaccagcgtgcgcatccccgcggacttcgactggggcaccgacaccccgcggccgggccggccgacggcgtgcgggagcccgccccggcccccgcacgccggcccggcccgtcgcgccgcatcctcatcgccgccacggccgccatcctcgccctcgccctcctggcgggcggcgtcgtcgcggcgcgcacgctcatcgcctccgaccggcagcggaaggcccacgacgaggcgtgcgcgacgctcaccgcgcaggccggaacatgggacgggctcgcacggcaggcgaagacgctcggcgtgaaacccggcgacgggcccgacacgtcctgcaaggcggacacggacacgctcagggcccgggcccgcacgctcaaggcccgagcccgcaccctcgccagggcgaaccggaacgcgctggacgccgcatgggaaaacctgtccggccggatcgcggcaagccgcaagaaccatccgaaggccggcgggcagacgctcgccgcgctcgaaacgctcgccgagaccgcgcccgaggacgcggacggcctggccgcgaaggaacgcgaattcgaacggctcgacaagcaggccggacgggagcagcagcaggccgaacaggaggagaaggcggaggccgaggcgcgacaggaggccgaacgggaggccgaggcgcgacgggaggccgaggcgcaggacacgccccagaccgccgcccccacgccggcgcccatgccgcagaccacccccacgccggccccgcagcccacgccgacacccacacccacaccggcgcccggcaacgcggacgccagcatgtgacgcatacccgaccccatgaacgacgcatacgaacgactcaccatcggccaggcgcagaccctggcccgcatcatcgacggcctgcgcgaccacgggttcgaccccgacgggcagggcatccacacgcccaacctgcacgtcgaacccggggacgggacacgcgtcaactggtggctcgacggcgacacggcgttcgccaacggcagcatggacgcgcaggggcacggcgtatggtggacgcgccgcgcctacgcgcccaccctgcgacgctcctaatccagggaaccgtcgacgcgcaccaccaccgggatcgcgctcgccgcatcccccacctgcaggtaggcgaccgacccgcgcagcagcccgcccgtctccggatccctcaacgggtacaggctctcccagtccggggcccgggaatccggatccacatacctgtcatgcatcatgcgcgcatgcatgcgcccgtccaacggctggttcgcgagccggcaggcggcctgcgcctggctgtcgcggcccgaaccctcgttgcgggcccccacggccagcacgtacaccttgccgacgaaatcctcgatccccgcgtccacgaactcgtcggccttctgggagagcatcatcaccatgtaatgctggtcgcgggccagacggcccatacggtcgacgacgctccggccgaaccggtcctgcagcaggctccacgcctcgtcgatgacgacggccccgttgcggccgatcaccaggcaggaggcgcccagcgcggccatgcggcacacccagcgctgcacgtcggtgggcgcgccctggatctccttgtcggtgatcacgttcaacgagcccgcgctgatcagggtcatgccctggctcagggacaggcggcgcccgcccggctccgtcccgtagatgagcggcatcaacgggtcgttcttgacggcacggtccaacacgggccggatcctttcgacgagcgggtcgatgtccttcgcctcccgccccctatgggaatactcctcccaggcgaggcgcacgcattcgcccagacagtcggcgccgtggcgcaaaccgtagccgacgatgctggacacgcccatctcccaggcgcggtccgggttcgcgccgcccgtgatctggctgagcatcgcgaccgacgtctgcacgatcgtgtccgtcatatgcctggggatgcagcgcagcgggtcgaggatgccgcgcgcctccggccggtcgagcttgacgaccacgccgccgcgtttcctcacgaacggttcgaagtcggatgatttcggtttcggatcccagaagacgacggggatctgcacgccgggatgctcggggtcgggcagacgcccccattgggcggcgacatgcaggccgagccgggtgttatgcgtgggcacgtagccgccgatcaggtacgtgcgatcggggctggcaatgctcagacaacggtgcgggcagtcggcgatcggccggatgcctttcacgtacagccatttcgaggtctcacgcaattcagtggggagaagcgcgcgtttgcgcggcagggagaacacgggcaggcttgtggtgaacgtgaggcgcagacggtcgcgggtctcgtggcgttccccgtccgccgtgtatccggccttcgtgcgggtggcctcgtgcacgacgacgcccagggagcgcagaagacgggtcagcccgtcgacgatcggcttgtggtcgatggactgggtgaactcgacgctcccgttccggtcgatggcgccgtcctggtcgagcaggcctcgcacgagttcgagcctctgttcgacatcggcatggaaatagggttcggggatgtgcttgtcgccgtaaagcccgttcgcccggagctgtcggacaaggcgtttcgcgtaggtcttctgcgggtcgcacgcactccgggtgacctcgtatccggcggttcgcagacggttctccagatggtcgaggtcgccgttcgacgggtcggaagcgaagccgccgccggtcttcgacccgtcagccagccatgcgccgagcgtccacgggtcgatgggcaggtccgtgcggacgccctggacgggggccgtggcgcggatcgcccagttcgcctgcccgccgtcggcgagcagcccctcgtcgagcatctcgcgggtggtgacggtctgttcgccgtgtccggacccgggttcgtcccggtaccgccagccgatgcggtcggcgaggcgggcgagggcgagcggcgcgggccatgcgacgcgcatgcgacgggccgttcccgcaggctccgcccgcggcccgtcgtaggatctcagggcggactcgaacgcgcctttcgatacgccgaggtccccgaaccgttccaggagccaagccgtgtcgatcggttcggcgggagggtcggcgatgagcccgtcgagcctggcgagccgcagcgccctggcttcgaccccgaaaccgttgccgacggtgtgctcccacctgtcgcggatgtgcccgagcagcggggcgggctcgtagaagcgtcccccgggcctgttgcgcgccctgccgggctgcatgcgggagggcacgtcggcgaagcggagcgcgttcctcacccacgtctccccgcccttgcccgcgaacggcgcgacgaggggccggacctcgcgccagatgcgttcgcagtcccaccattcgtccatgccgtgtccggcggccatggcgcgcagccgttcctgcgccttccggacccgttcgcggcgttcgaggctcttccggtgtttgccggtgcgggcgaagttgcggtcgcgccatgtccacgcgcaccattgatggtcgccgctggctttgatcctctgcccgtcggacaggacgatctcgtacatgtcgtcgtcaccgatggggctcatgccgagaatcgggtaggttttcccgtcgcgcgcatagagcatgtcgccgtcctcgaggtcgcgcaacggcacgaggccgccctcggggaaccttttctgcgggggacggggagaggcgtgtcgagggaaaccgattttccggatcctgtgctgcccacgattatggaaatcgctttcccgctgcgtctggacgcggcgaacggcgaatcgtagaccggctgcccgtccgcctccgtgacgcccacgaacgcgcccggcaggtcggagtccaggccgcgccccgaatcgtcgcccgtcatggaacagcccgcgagcccgctgaacgcgaggatcggggccggccagtacaggggggacggatcgtattcgatcatgtcgtcggaaccgatctgcatgtcctcgaacgcggcctcctgacggtccgggttcaacccgacgtgccccggataggggacgcggttcgactgctccacgatcatgggcagtgcggcgtgcgcatgcgcctggacgagcgtgggccacggcttgccgtccgcctggtattcgccgttcgccgcctccagctcgcgcgccacgcccaggttcgccttgcggccgcccgccgcctgctcgtacgccttgtcgagcaccttgtccgcgtccttgtccaattgctcgcgggtcatctcccccggttcgaccaggcccttcacgctgatcgcgaccgccccgcaccggctcgcgtccaggaggccggccgcccagtcggagccgggggcggtgttgttctcgcccttgaaggggagcacgccgagcgtgaccacggtcaaagggtaggagccgggaatcctcgccgaccatttgcggcagtcgtcgaccttctcgcgcatgcgggccgcgacgaacgcggaccggtagtcggggaacgtgtgcatgtggtcgtgctcgaccatgacgggcagtccctcgggcttgcggtcggtgggccagaacgccatggcgcggcgcatcgtcgcgtcggacgggatgcggcagcccgcgtcctccatgagggcgcgcacatcctccagatcgtgttcgaacgcgtcgtcgggcgtccacccgtcctcgtcggcgacgcctttcaggaaccctttcacgccgccctgcccgccgcccgtgttcagccggacgccgaacagggtgaaccggtcgcgcacggcgagcccctcctgttcggcggcgaggcgcagccggttgtccgggtcgagcgtgggactgggttcgaaggggcgggagccgctgaccgcgaggatgtggacccgccggtacaggcccttcatggccttgcgtccggcgaatgggacgcgcggcgtccggtcggcgagcccgccgagtatcgacagcatggggcgggcggccttcaaacgctcctccatgccggacgcgtccgtgacggacggctggtcgggcatcctcatgtacagccatgcggcgccgttgaccgtgcgcacgaacccgccgcccatatgccgggcgaacgtgcccgtctccctgacaatgcgtttcctcgtcatgcggcgcgcctatgcgcgcgtcgcatgacggtcagccgagcgtggcgaggatcgcgcccagaccgtccggatccgtcggatccgagcacaggcgcgccagcaggccggccgcctcgcgcatcgcgcgccgcgcatccggcgaccccgcagccagcagccgcaattggcgtggcgtgtagccgccgtgccgtcggcgccggtagagcacgtccatcgcatgcgcgtccgcgtaggcgagcagcatgtccacctgcgcggacgacaggccgtcgccgaggcgggcgagcgtggccgcgcccgaaccacgttcgaggatcatgtcgacgcggcggggcgtgaacatctgcctttcgacgctgagggagaggcgttccagcaggccggccgacccgtgctccgcccaatggtcgtacagggtttcggtcaggcgttcgcggcgcggatcgtcgtcgggcatccagccggacaggtaggagccgaccatgtccgggtcgccgtgttcgagcaggaggcggatgtccttctccgtgagcgtgggacggtccgaaccgtcgcgtgccgcggcgtccggcgcgtacaggctccagcacgcccggtcggccaggccggattcggcgatccggcgcaacagggccgcgtccggccggccgtaccggagcacgagccatgcggcgtccgggcttccggtttcgaacaggcggacggcgcggtcggcgatccagccgggggcacggtattcgagtttcgtcaggacccccgggtccgtctccttgccgaacacgtgcagacggtcgtcgggcgtatggtccaccagttcgaggcgcaccgtcggatccggatcgtccaggaacgaatccagccggccgtccgtcagcatgcccatatgcttcaacgcgtccagacggattttcggatccgggtccgcgagcacgaggccgggttcatgcgcggcgagcgcgcggcgtatggccttcggcagcggttcgcccgcctccgccatgcgtatcgcgtcacgggccgtgtcgcgtcccatgccggtgacggtcaggcggcgcgcgcgccagcctccggccgcatcgtccacggcgaagcagccggtgcgggcggccgcgcgcgccgcgttcgcgctcgccgcctcgaacgagttcggcacggtcccgccccatcgttcgcgggtctccggctcgccgtagtgggccatcagcaggttccattggctttccgacagtttcctaaggctcatcgtgttctcccgtcatcgcgccccggcatcgtcgccgcgacgcatgcgtccccccccggcggacgtttttttcagcccgattcagaacaggctgtcctgcacgggcatgggcggcctggggcgggcgagccggcccatgaacccggcgaccgccggatcggccttcacgtcgcgtgccgtgagcggccggtcgaggctcaggccggccagggacgtgcaccggctcaacgcgacgtacgcctgcccggcggcgaacaggggcgcgggccgagctcgagccgcacccggtcgaacgtcctgccctggcttttgtggatggtgaccgcccagccgggcctgaacggcagctgccggtaggagccgaccaccacgttctccagacgcccgggcttgtcgggctcgtcggggtcgcggacgatgcgcggcgcgacgatctcccacgcgtggacgcccacgtcggcgaccgtcccgtcgtccatgcggacggtcgcgaccgggcccgccgggtccatatgctccaggacgcccatggtgccgttcgcccacaaacccgtcggatcgttggacagcatcatgacgcgcatgccgggcttcacgtcgagcaggcgcggcgcgggctccagggtctggttccattcgccgcccgcccgggcggcgaagcgcatgggcggggcgggcagacggtcgagcatcgccttgttgatggcgtcggcccgccggttggcggcgcacaggacgacgctcccccgggcgtccagggggctcccgtccgccggttgatcacggcgagcgcggccggtccgggcgtcccgtcgcgcaacgcgttcaacgcgttgacgaacacggggtcggactgccggtgcacccgggcgagcgcgacgccggcgagcagcccccggtcgagcaggcgggcgatcgcgtgggattggaagaaccaggggccgtcccattggccgccgggccggaacgcggcgccttcccggcgttcgtcgacgacgggcggcagttgggcgaggtcgccgaccagtatggtcctgaggccgccgaacgggcggtcgtcgccgcgcgcgccttggaggaaccggtcgaggcagtccatgaggtcggcgcgcaccatgctgacctcgtcgatcacgatcgcgcccagtgtatttagtcaagtcggtgtttcgtgtttcgtcactaatttttttcggttttcggcatgaggagtgccggccggtggtttgttttactggttgtccgtcttgccgaacatgagggcctggctgacgcgtcggctggggccggtgaattcgatgaggcgtccgtggtggacgatgcggtcgatgatcgcggcggcgagtttgtcgtcggcgaagatcgtcccccatttgctgaactcgatgttcgtggtgaagatgatgctgcgccgctcgtagctgccggcgatgatctggtagaggaggcgggccccgtcgatgtcgaagggcacgtagccgaactcgtcgaggatgatcaggtcggcacgggcgaggtctttgagcaggttgtcgagggcgccgtcgcgtttggccttgccgagctggagcacgagctccgcggtctgccggaacctcacgctcctgccttgctcgatggcgagcatgcccagggcggtggccaggtgggtcttgccgcgtcccgtcttgccgtagaacacgaggtcctgcgccttggccacgaaatcgaggccggtcagctgctccttggtgtatccgtcgggcaggcgcacgttcgcgaagtcgtagccgtcgaggcttttgggcaccgggaaccgggcctggcgcatgagccttgcccgtttggaggcctccctgttggccagttccgtggcgagcatgcggtcgatggcgtccagttggcggggcgtggcccattcgagcgtttcgtcgatggtggcctgcgagatgaacaggctcctcgcccgctcgcgcagcgggccggggtcggtccgtccgttcttctggttcactcgtcctccttggtgtaggcgatgtcgtattcgctcaggtccacggggtcgtcgtaggccacgggtcccaggcccgaggcgtggcgtgccgcggccagacataccccggcccggtccgtgcctccggtggattcgaggatctcgagcatgccggccacggccgcccgccagccgctctcgccgtcggcgtgcagcagggcacgcaggctgtcgcgccgcgtggcctcgtcctgcgcgtcgatccattcgcgaagcgggtcgggcatcgcgtcgcgcacccggctgttgcgccaggccgccggccggtcgcacaacagcccgagctggctcgacgggtcgccgctgtcggtcggcttgtccccgtaggacctcggatgcgtgatcacgcgtttgccttcggcatcgaggatctccacctccagggccctcaggccgacgatcatctcatggccggcgtgttcgggtccggccgcgtaccggtggcggccctggacggtgacgtttccgtatttgtcggccttcatcctcgtccacgtgaccacgtcgaacggcttggcgggcaggggcagcagcgccttgcgatcatcctcgaacaggccggcctggctctcgcccttcctgtaatggtccttgtccccctcgagacagcggtcgggaaggcgcaggttgaagttgtcgaggctccacacgctgggcaccggcacgaacagccttcggcgcacggccccgaccctggcctcgaccgcgcccttctcgtggcccgagtacgggttgcagaacgagtactcgaacccgtaatgggcctggaacgcctggaacaggcgggtcaggcggatctcgtcgaaccgtcggcggcccacgccggcggcattgtcgtacacgatgcgccggggcaccccgcccagccattcgaacaggttaagcaaagcctgacacgtgcattccgcgttctccccgggcatcagctggcacggcgagatgttcgagtacgggaaatccaacacgaaatgccgcatccgcgtcacgacgccccggtagcgcacgtcgacctggccgaagtccgcctggcattcgcccggatgccacgacaggtccaggaaacccatctcgcgctccgccatgaactcacgcttcaaccgggccaccgtccgggtcaccgtcgacaacgacgcctccaccccgtactcgtcacgcaaccgctcgtggatgcgcgtcgccgtgtgacgttgcttgtgccaggtctcccggtcctcggcgagcatgccctcgatcacgggaatccactcgtcgagcaccgagccacggcgtctccttaccggaggcctggccgacaggtcgtcggccttgagatacttgcgcacggtcggctcgctgaccttctcgccgcgcgcgatcgaggcgacggactccccattcctgcgcctctgacggatagactgtattttgggcatgctgatcatttgcctttccggccctttcccgaatggattcgaagcaccatcaggctaaggcccacgggtggtcggcatgcctttctgcctaaacccgaaaaaactacgtgactaaaacctcaactccctattgaacacatacagcgcccagcatccggtagagggggtcgcgggcgttctcgcgtcccttgcgggccgcctcggccggggtgacgccgggcttggcgtggatgaaccggtggatggtggtcccgttcacgttgagggcggcgatgccggtgggcgcgagggtgagcgtgttgcgcggcgcgatcgtgcttcgccaatggttgacgagggtgcttttgcccgtgcccgccttgccggtcaggatcgagacgccctggggttcggacagcatggcgagcgccttcgcgtcgaaagtgaggtcttcggtcatgcgccggggtatgcgtcagtcggcctccgggccgtgtatgcattccggccgggctgtatgcatccgtatgcatcaggggatgcatacacgcccgttctccgtttcggcttgtttccagcgttccggggcggcctccacgcgtgtatgcattgtatgcatcattcccttatagaggattcgggaaaaggaaggaaaccccatatattgatgcatacaatgcatacaagataaaggaattatattttttcctttatttataagggttttcgggctttttccgggctttttctgtatgcatccccggatgcatacagatgcatacatgcatacatcggggtgaaaacagtacactgacggactgttttccaggcccttccgaccccgatacggtggatccatggccccggcgggcatgacgaggggcggccgacagtacacagacggactgttcgcgattgaacgcccggatcgccgacccgtatgttccagagggaaaggagtctcgcgatggaagacaaggacaggctggaagggttcggacagcatggcgagcgccttcgcgtcgaaagtgaggtcttcggtcatgcgccggggcatgcgtccgatcggcctccgggccgtgtatgcattccggggcgcgtgtatgcatccgtatgcatcaggggatgcatacatgcccgttcttcgtttcggcttgtttccagcgttccggggcggcctccacgcgtgtatgcattgtatgcatcattcccttataggggattcgggaaaaggaaggaaaccccttatattgatgcatacaatgcatacaagagaaaggaattctgttctttcctttatatataagggttttcgggctttttccaagctttttctgtatgcatccccggatgcatacaaatgcatacatgcatacagaacaggccgggggacgtcacgattggctgtacagatggacgctgtacagccacaccggggcgttggtgaggaaaatcctcgctaaggacgtcggactgtcggaggtcgagattcgggagatactcaaatgagcgcacacgtgaaatcagtgaagatcgtataccaccgtgacgagggcgcatggtgggccgactccccggacatgccgggattctccgccgtcggggacaccttcgacgacacgaggaagcttgccctcgagggcatccccttctacttcgatggcaataggcccgatatcgtggacgagcgcatggagaacggggcgagcctgaagcccacgagaccgtaagacgcaacccggacgccgttccgggggcgcatgtcacatcaaagcttagaatcccccggctttagccgtggggagaagtcaaatcatccgaagcgagaaaaggccggtcttggtagaacgtctcgccaacactaccgttgtagcatacggtaattgtattggctgggtgcatattctcggtattaccgaccattgcggtgcaaccgttgttcatcgcagaagaaccgataaagcgtatatcacccggaatcatatttgcttttgtcagccttgttcctttaacaacgtcaaacagcttccaaataacaaactcctgccattcggctatgcccagcgcatgcttgctctcatcggcttgcctcagcctctcaaggcttgcttcagactctcaaggcttgcttcagactctttcatgactgccgacatgtactcgtccatgtaagcccaatcaggctcgccggacgtatcaacgggcaaacgaatcatttcgtcttctatagtcttggaatttaactggtcagaatacgtatatttggtcagtgactggcgaatcacagacgaaacaaatagtcccgacagttctgttaaacctgcattgtgcaacatcaagattgcagaaccagcaccaccacgacccagaaaaggcttggcttgataaaaagctgaaccatcaatcggacttactgtgatgcaatttcctgcatccagcacttcatcatcttttggcttacaccacttagtgacaccattgttgaaatttccagatgcaacaaaaggaatatttccgtcttcatactttgcttgactacgagcaactggtcgctttatttcaaacaacttacctatcttgaactctttccatccgttcgtatcaatcttcgccatcgccgtctccgcctttcctcatggttacggtcacggacttgtcatcggcgctcactcggctcgaatacatcgctgtgtccagcagcttctcgccgaactcctttgcgtcgatgccctgccggaacatcaggtagtccatcgccgtcttgcggaagtcctcctcgaatatctcgaacggcttctgcggcatctgataggacaggtgctcggcggggttcacccactggcatgtatcgtcgccggactgcttctcgaccacatcgacccaatgagcctcaatggccgcccacttgccgtagacgtcatggcgtcccttgttcttgaccgtcgccagaccatcggactccatgtaacaggcgaaaaactccttgccgtcctgtccgacgcccgcctcgaacacgaagatgctcgtggtcacgcccacgccgaagaacaggtcttccggcagcttgatgaccttgcgcaggcgatggttcttcagaatgcgcttcatctgcgccttcgatgctttctccagcttcttgtccggcaggatgaacgcgcactgggtatgtgcgggaacgctgtccatcacgttctcgacgatggtcatgcagccgtacttgttctcgtacggcgggttcatcagcaccttcgtgatcggcttggactgcatccattcgttggctgcatccgtgcgagtatccatctgttcaaggttcgtcttgccgtccttgtgaatcagcatgttcgcgcacgccagcgcgtaaatctcgcggtcgaactcgatgccgtagagctgcttggatttaatctcgccggccttcttcgtttccatgccgccggcctcgcgaatcatgttcgccatggccttcacgaggaagccgccggaaccgcacgtggcgtccagaacgcagtcgtccatgttcacttcgagaatcttgtatatgaagtccgtgatgtgctcgggcgtgaatatctgccccgattcggactttttcttgtaacggttgaactcgttgaagaaaatgcccatcacgtcctcgccgcgccattcgttcgagttgacgcactcggaaatctcgacgacccagtcgatgaagtcattgattgccttctggttgtcggtcgtgttcatcttgatgtcggaatattcctccagcaggatgtcaattttcgcattctgtttgcgactggctatcaatgattttgcaagcgtcgagtgaatcgccgtatggaacgtctcatacccaaggtctttcagacgcttcaatcccgcaccgtaacgctcggcaaccaacgcgcatgccgtgaaaatcatgcggtggtacaggttcttgatgccgaactcgaaatgcaggcagttgttgatacgtgccgtcagctggtagatgcgctccttgtcgatgctatcgacggtatagagcgacaggtaatagccgacatgctgcaacttgtcgggcgtcttgacttcctcctcgcccttgaacacgcgcacatcctcgccgttgtacaaaacgccgacaaccttctcatattgtgtctgcatgatgcggacgttcttcagcacctcgtccacctgcgccttgcccagggcaatgcgcgtcgccttcgtctccaacaccagcgctacatccgccttgttcttcggtagataccagccgtccggcttgtcggcaatgcctgaaaatccgagctggttgaacgtcgtgagctggccaacgccggcacaagccaaatcactatccgcaagtccaagaatgtcacgtgccaaatcgcgcacggcatcctctgtcatattcttcgccactactcatccacctcctcaagatactcctgcacccactcgtggatgattgcggcaatcgtcgtcccacgctccgcagccgtcatcttgagcgccttcttgtcgctcacggtgagcgacagcgagagcgtggtgcgcttctcgtccgccgtcgtgtcggcgacgacggcctcctctgtcttcttctgcccggcctcgcggtcggcggcgtattgctcgaacatgttcgccatggcccgacctcctttaatcatttgcacaattgcacaatcatacatcttgctttatgggatgcgcagacggaacatcgccctgacctcccagaagtgccgggaccgcaccccgcggaaccttcccaagcatccccgtgggatccgccccgtggaatgcgtgacgcatacccgggggcatgagcacacacgacaatgatgacaagccggtccgcctcctgtgggtggacacggagaccacgggcctcgacccacgcaaggatcccatcctcgagatcggcatgatcgccaccggccccgacctgaagccggtggacgacgggttccacacgaccgtccactgggaaggcaaaccatccgaattcatccagggcatgcacgggcccaacggactgctcgccgaatgcgcgcacccgagcgcccccacatgttcgccgccgccctgtccgcacgcgactacgtggcccgacacctcggccagggggtccgcctcctgcccgccggcagcaccgtccgcttcgaccgggacatgatcgacagctggatgcccggcgtgctcgacggctgctcccaccggtccctggacatcagcgccgtctgcgaggccgtccgcatgtggaaccccgcgatcctgcccgacatggaaccgtccaccgaccaccgggtcatgcactgcctggccgacacgctccgctacgcgcgcgcataccgggggctcatatgctcgatcggctgaaacacgcgcccgcccgcctgtgggcgtggctgaaacgcctcccccgccggatcggcgcatggaccatgtccgagcgcggccgcatcgtatggacgcgcctgctcgccgccctcctcctgctccccctcaccccgtccctgaccgtcgtatggaagatcatgttcgagggcggcaccatcgccgaccagaccgtcgtcatctacatcacgatcctcatcctcctgatccggggcatgcgacgcggcctgaaacgccatccccgcgacaaggaggacgagcggtgagacgcccgccgcgcgggttcacctcctacgccgcctacgccctctggcatgcggccgtgttcgcgtccatgaacctcctgtactggccggcggtcatccccggactcgccggaacggtcccgcccgcggcgggcgtcctggtcgcgggcatcgggatcacgctcgccgcaggcgtcgaatgcacgcagggatacggtttcgaggaggcacgcgaaggcggcttccataccggcctcgcggtcgcatgccagatgcccgccgtctgcttccgcctcatcctcctgaccatgggaacgccggacggaaccctgttctggacgcgcacgctcgccgtcctgggcgtgctcgcatggcagacatgctgcatcgtcatggaccggctgtgaccacaatgggacgcatgaccagactcatcgactacggggcgtgggcgtcgtcccgctccgacccgtcgaaacgccgcacatggccgttgcgccgcgccggatggcgtttcgaccgcgcgtccggcgcatgggacgggccggacggcgaacggctgaccgtatccttcctcgggttcgccatcctcgaacgggaggacgcggactgggagcatcccggcacgggctacgggacgcaatggcatggcggcaggtacggcatgccatatgcccgacgcgtcgacggcgactggaggccccgcgtggccgtcatgctcgcccggaacgccgtcaaggtccaggatctgatgctctcccgtcccctgaccgccgtgtccgcggcggacgcgcgccggctcctcgtccggtgccggcgcgccgccgacctgtatccgcccgacgatccggacctgttccggcgtctcatggacggattggaggagaggacgacgcgtatcggatcgtacgccatggtggaataccggcgggggttcgccggcccggtcctcgccctggcgggcggcctgctcaccccggtcggctcgttcctcctcggatccgatccggcggggttggcgggcatcgccgcgctcgccgccggactcgcctgctccggactgtcctcgctgatcgacgggacggaacgcgcgggcggcgcataggcgtcgcgccgacggcatgatccgttcatgaaaagcgatatgccatgaccaatccgaacccaaccaatctcaatacgcgcaaccagcctacgggcagccgaactatgcgccgccagttcaaccccgtatacccgcagcccacggcatcctatgggagaacccctccgacacaggctccttcggtttgggctgttctcggcttcttcattcctctggtcgggcttgttttctgtggatgatctggaagaacgatcgtcctggtgatgcgggcatggcaggcaaaggcgcactggtttcagcgatcatcaacgtcgtgctcttcatcctatggatcgtgttcgcaggcatcctattcgccgcatccggctcctactaaagagacaaaccgaaacgacagtcccataaaagacgagggtggcacatcccatatcaggatgcgtcaccctccttcaagcggaaactgaaagcgattagttgcagggtacctggacgcctggtttgccactggtatcaaccgcccagcaaatatcctcgtacccgtcatcaccgccgccgccctgggacggcggtggcgcgggctgcggctgtggcgtcggcgtataaccgcctccggtcgaaccacctgtggactgctgtggcatgtacgcgtacccgccctgggattgcgtgtagcctccgcccgtgtatccggtgtagcctccggttgtatcgcccgtgtaggagccgctgttatccgtctgcgcctgggcggcattgtcggccgcctgcttctccttttcggccctggcattcgcgtccgcatccgacttcgccttgatggagtcgttgaccgccttcaccgcatccgagatcgccttcccgtccttcgatttgatggcgttctccaatgcggcgcgaaccttgtcgtccttcaccctgcccttcgaatcattcaggatcctggtcgcgtcggcaacaatcttgtcgagcttcgaggcgttcacggcctcggcctcggccttgacctcgcctacggtcttcgcgtacacgtccgcggtcttgtcgagccacgcggtcacggccttgatgtccttcaacccatccgccgggcatccggggatatcggttttcgtcttcgaggccgtcttcaccgtcgaagccaacgtcccgaccgttttcgcgtccctgacctccgaatccttgaccctgatcgcggtctgcagggcgtccgacttcaggtattccgtcagcttcttccgcgccttcaccgccctgtcgtatgaggtggcgcattcctctgaagccgccgtcaaccgatcatggttccaatacaggcatccgccgataccgcccgccgcgaggacgacggcgcatccgcccgcgatcaccggcaccagccatttcgggcgcttcggtttcgaggcggcgcgggcggcccccgacggttccgtcgggggctggggcacgggattcgatccgctcatgttatgttcctctttcatgtttccgctacgcgcacgatgataaatcatcaaaacaataaagaggtgtggcatatcccattatgggatataccacacctctcacgcggaaagaggaaagatcaactgcagggaacttggacgcccggcttgccactggtatcacccacccagcaatcttcataataaccgtcatcaccaccagaggagcctccgttgccgccgccctgggaaggctgctgtggctgcggctgtggcgtcggcgtatagccgtctccgttaccggtgggctgctgtggcatgtacgtgtagccgccgccctgggattgcgtgtagcctccgcccgtgtatccggtgtagccatcggtcgtatcgcccgtgtaggaggagccgttgtccggcgcctgggcggcattgtcggccgcctgcttctccttttcggccctggcattcgcgtccgcatccgacttcgccttgatggagtcgttgaccgccttcaccgcatccgagatcgccttcccgtccttcgatttgatggcgttctccaatgcggcgcgaaccttgtcgtccttcaccctgcccttcgaatcattcaggatcctggtcgcgtcggcgacggtcttgtcgagcttcgaggcgttcacggcctcggccttgcccttgacctcgcctacggtcttcgcatacgcggtcgcggtcttgtcgagccacgcggtcacggccttgatgtccttcaacccatccgccgggcatccggggatatcggtcttcgtcttcgaggccgtcttcacggtcgaagccaacgtcccgaccgttttcgcgtccctgacctccgaatccttgaccctgatcgcggtctgcagggcgtccgacttcaggtattccgtcagcttcttccgcgccttcaccgccctgtcgtatgaggtggcgcattcctccgaagccgccgtcaaccgatcatggttccaatacaggcatccgccgataccgcccgccgcgaggacgacggcgcatccgcccgcgatcaccggcaccagccatttcgggcgcttcggtttcgaggcggcgcgggcggcccccgacggttccgtcgggggctggggcacgggattcgatccgctcatgttatgttcctctttcatgtttccgctacgcgcacgatggtagcatcatgcgtggcttgttccggtcggtttcctcacatcccggggattcatccattcctggcgcttgcctcggcttcaatcatcccacggtatgcgtccctcgggaagccaacggatttaaaccatgaaagtgaaccgggtgccgcatcccctgcggcccgtcatgggccggggggatgcggcaccctttgccgtcccgcgtgtcaggcgcgcctgcggttgcgcagcgcgaacgcggcgcccaggccggcgagcagcatgccggccgcgacggcgggcaggacgcccgtgccggtggaggcgagctgcttctccctgacggtcacggtctcgttcggcttgcgcgcgtcgccataggagacgagcctgcccgtctggtcgtacaccttctcacgccagtagtaggtgccggtctccttgacggtcacggtcggcgagtggacgccgtccttcgcgccgaccttgccggtgacggtgatgagcacgtctcccgactggtctccgttggcctgcttccacagttcgaattcggccttggctgcctgctcgcagttcttgagcaggagctcgtcgtgcaggtcggccctgccgttctccaacgtgacctcaccctggctcctggtggacacctcgcacctgggcgtttcgggcttcctgccttggacgcgcacgatttcggatgcgaggccgaaagcgtgctgcaccctgccgtgggtgagctgacgccaggccaaggcggcgagcggattatggttctggtcgccggtcaggctcggtgtcatgacccaatgccaagcgtaggtgcccgattcggtcagggtgaacgagtcggtcgtgtaggtgccgaacctggtgacgtccttgatgtcggcctcgtgaaccttcaccgcgttttcgggcacggtgtcggtctgttcgatcgcggcggacgggtcgtcactcaccttgtagaggacgccgtggaagtcgaggctcaacggggtgctcttcgcggtctcgccttcggtgacgttagtctccgggtaggtgggccacacgtccttttcgttggtcttggcgacgacgagcttgtcgatggtggtctcccccgccttgacttccttgctggacaccgtggagtcgagcttcggggtgaggcggaacatgacggtctcatccgcggtgaacggagcctcatgaacatccttggcgaacggatagtccctggacggttcgatgccggtctggttttccgtgtcctgatccttgttcgcgatgtcgaacacgaacgtggcgtatccggatggcaggttcgtcagattcacaccatcctcggccttccattgggcgacaggcttgtcctcgtcactgctggaaatcaggtagtcgccggccttgttcgtggtgaacgtggcggtggcgagcttcacggcctgcttgggcagttcgacggtcttgcctgcggcggtatccttctgagcctgttcggcctgttcgcgggtcataccaccgtagatggtgccattcacggtaagcgtgatctggttgtcttccgtttccttgccttcgccctgaccgtccttggtgtgcagccagtcctgggtgtcgaccttgccgtcaccgttcacgtcggtcacgttgagtgtgaccttatcgcggatgacgctgcccttttcaaggtagacgacatcggtcttgtcggatgcctgagcggaaccgatttgcacgctcggacgttcggtgccgtcggcgccggtcaccgtgctctgatcggtcttgtaggcgtcgctcacactcgacttgatggtcggctgcatgttgcgcacgtgctgagtggattccgcttcgagcacgttgtcggaccagtcgtagtccgtggacaggtactgcttcatgttggcgtcctgcatgtcgggcgtgatctgccacacccacgtgtaccagccggtgtccggcaggctcgacggggtggctcccgggtgcgtcttcacgaagtcggggtccatggtgatggaggcggcgtccacgtgattggtggcgccgtccctgtcgccggcggcggtcgcggtcgcggccttcaccccatccttgacggtcgtccggccttcgaccggcttgttcgcgaagtagtagagggtgccggtgctcttgatggtcgcgccttcaatccagtcgccgcccgtcgggtccacatgccaggtcagatcgtcttcgggcgcatgcccgtattcgatgcgatgatccgactggtcggactggatggtcggcttgaagttgttcagcacctcgaactggatgttctccgacacggtctcgggatcagagggacccatcaggttctggttcggggagctcagcttgacggccttcgggatctttctccatacgctccacgtcactttgccgttgcccgttgccgtccacggaaggtggatcgcctgacctgtggtggtgccgctgatcgtgttcgtcttggtctggtcgaacacggccgggccgttcagggtcgccgtgtactggatgcccgcgatttcgacgccgttctcggtcgtgatgctcggggtgaccgttcccttgcgtttgccgatggtgtactggtatctcatgtcgaggttcgagggcgtgttggcgaccgcctccgtccacaggctgttcattttggccgtgtacgtgtcccagctggtgccgtccttccagccgaggcgttcgatgcccgacaggtattcgttgcccatcgggtcgagcttctggtggatgaggcctgcgatcgcggcctgcgtgaggtcgtccgtgttcccgttgtacttgtcggtcagccatgcgagccgctgcgcgtccggtttcgtcttcgcgtcggtccactcgccccacgtgcccgccgtgcccgtgtagagcgtgtcggcctggatgcagtacacgttcttcccgttgaccttgtcgaccacgccgagcgactgctccatgccctcgtacttgtgtccgttgctgaacgtgatcgtgcccaggttcgcccacaggcccgggttgccgttctggatggagcgctcaaacggatcacgcatgtcggccgcgtccgccgtgcccgcgacgagcatgcccgccgccagggtggcggctgccgcgacgcccgcggcgagcgtgcgcgcccagtgtctgtcgttatgagtcgaacccataaggatgtttcctttctgtcggataggggacggcgtacgtccgcccccgcacgcgcgtctatgcgggccggaaaggcatgatcgtcccgggacatggaagaacggcatgggattggatttgacggtttctagccgagcgcgtccctgaccttgacgacgatgtcgagcaacggggacaggagacccgtcggcccgtacgtccttcgcagccgatcgtattcgacgcacgcgtcccggacggtcacgtcccagccctcacgggcgattagcggataccggccggccgtgttcaggctgcggcgcaccggcccgaacatcaaccggtatcggagccatgcgagacgcggccgcgcggaatcctccaacgttcgcgcccggtcgaggatgagcgtcgcaccgtaacgcagcatgcaggcgcgaaccgtcatgtcaaggtcctccgcgtcgccggtccggtacgtccacccggggtatgggacgcgacgggagcgcatgccgtccatcaggccgcgccgttcccgcccggccacgcatacgctggcgcttaggccggtggcccggcccatgaccatgagcatcgcggaatcccccgccgtccgccccatgaccaggctccgctcggaatagcggaacggggaccgatcccgtctccacgaggcgtcccgatggaagtagcgcgccgggttcgcgtcgaacacgccgtgcccgatgaggaacggccgtatcgtgatatgcccctgtcccgtcatggcggcccatggtacgcgcgtccgaaccggccggtcccgtcgtgtcccgtgatgcggacgggggatggcatcccagccggccgcgtagccgacggccaggagcatgaggcgcggagcccacacgccgccggcggcgaacggggcgagcacggcggcgaacagggcgagacgcgcgggccatgggccggggcccgccgcccgcgcccaccgttcccggcccgcgtccaggagcatgagggggacgagccagcgcagcaggattcccgcggccggccagaacaggatgacgatcggggtcatgcctcccgtatgcgtccgtccggaacgcatacgggaggcatgcagcaggggacgcccgtccccgcacccacaaggaaaggaaaccgtcatgaccgatcaggagccgggagcccagctcacccaatcatacgaatcccagtcatacgcgccgcaggagagcaagcgccccgaaatcacgaccgtcgcgttcggcggataccggacggaggatgtggaccgtctggtcgaccagtacgaggagaggatggccggataccggcgcagcctcgcccggcagatcgcgatcgccgacaacctgaggaacctgaacacgcggctgaccgcccaattggaggccgcctgccgggaacgcgacgaactgcgccaccgggcggaaagcccgttcgaggcggccggcaaggccgcgcaggacctcgtcgacaacgcgaggaacacggcgcgcgacacgatcgcggaggcgcgggcgcaggcaaaaggcatcctcgacgaggcgaacgcgaaggcgggggacgtcgtcgcgtccgcgaagcagaccgccgacgggctcgccgaggaacacaagagggagcatgacaaggcgatggccgacctcgccgagcaacgcgacgcgttgaagacggagcacgcgaaggccatggccgacatcgaaacgcgccgcaaggacgcgcagaccgcgatcgcggaacgcgaacgacgggcgggggaactcgaacaacgggccagagggacggtggacgagatccgggagaccctgaagaacgcgatccgcacgctcgacgactgaaaacgaacgggatcaaggggatgcgggcatgcggccgtccggaccgtttcgcccgcatcacgatcccctctcaagcgcataccgggtgcgcattctcccaacgaaacgcgaaccaagcagccccatgatggcgtgagacgtggagcgaccacccgcaaggatggcctgcaagccagaacaaaccagtttgcaacggacaagaccatacccgcgtccatacgccggatcggtccagcccggttcgccgcatggacgcgggtatggtcgggcggacggcgacgcccaggagcatccacgcccagacgttgacgggcgtcagacggcgagcctttcgcgcacgcggagcgcccagtcgaccgccatggcggcctgcgggggcacgaccccgttgcccagggcgcgcagttggaggttcctgtgattgccgtccacatgccgccagatcgccggatcggtgacccagccgtcctccaggcccatcatccattccacgaacctcggggataggtgggcggccgacgggaaccgggggccttcgaatcgggtcttccaataaccgagcacgcttttgtcgggcagacgggtcgcggggatcgggatgtccgggtccatgtccttgcagccgggccagaacatggggtcgatgaggctcatcccccggtcggtttcacgccagagcgcgagcatgcggtcgcgcatcggctggtccagccgggctttcggatgcgcgtcgaacggggcgtggcgggcgagccagtacggttcgaacagcgtggggtcgtcggcgttcgccccgacccagcggcgcaggccgccggtcgcctgcgtgggacagggggcgggacggccggacacccgctcccagcggcggatcgcggcggcgaaccggccgaagcgcacgccccgcccgtcgtccagaccccagagtcccccatgataggggccgggcgcggggatcgcgcgcgtcccctgttcgacggcgccggtcatgcatgtctggtcgttcctctgattgcggcctttcacgtcgctggcgcgcggcgtgggcatcatatccacatcatccgtcatcacgtcctccctcaggttcccggtcgaatcgcgtcggctcccgtcccggtcgccgcgacgcaggacgcgttccaacgcggccccgtcgcggggcgcgatcgcatccatgcagttcggcgtggcgaacaggcgggcttccggcaggatgtcgatgtcgtcgctcttctccgcccagtcggcgacggtgaccgcatgccccatggccgcgcggcgttccgggatcatcgtgcccccgttccactcgttcgacgtgggcgtgggcaggtggtcgatgtcgtcgcgcaggttccggtagccggcgccttttccggcgcgcggccgttccgcatccgcatgcgggggcagcatgtccatacagttcggcgtgcccggcagttcgttttcgctcatgcccgtcgtatgcgttcccatgatccggatctcccccgcgtcgaggatcgcgttcaccagggcgacgccccgccagttctccccggccgccagcagccgcgcaccgtatgccgggtcgcgtccatcaccgtcggcgtgggcagccacagatcgtcatcagtcatggccacgggtatgcgtcaggcggggcaggcgtatcggatcatggaaacgggacggtccccgccgttccagacccttagtcttggccgcatggacatcatccgcttgacttcctcccccgcctaaagaggcgggagtctgcgccacccaaacaaagatcaagactcccagtatttccttcatgcccgatcctcccccatgccaatccaatctcacgaaatcgcgggaatggccgaacaaggtcttcccccgatggtcacgaacatggacgggtggtcgcccatgtggtcaaatacgcgaacgaggcggggcgagcccatgccgctgcgatcccggttcgggtatccgctttccatacgaggatcgcgcgatccggctggaatggcgcgagacgggacccgaagggcctatggacaaagaaacccggcatgcccgcgatttctccatgcgcaacgaagccgaccatgccccgggtcctacaggagattgatcgcatccgccaatccgagctgcgcgccccgcctccggcggcggaccgcatcctccgctgtgcccgccttcacgctgtcgtacaacgcgttcggcgtgggcagcatgacggccgccgtccgcaaatccggcgccccgtccccgtgcacgcccgccccgttcgcatcgttcgccctcggggtcggcagcttcgaatcatgctccctgaccttctccgggtccatacggcccggcaggtccatgagacgcacctgcgtggacaggaacgtgctcctgtccaacgggcggcccgacgtggccggggcggcgaacaccccgtccgactgcttcggcgtgtacaggaacccgtcggccgggatccccgcagcctgcgcgggcaggggcgcatcccccgtcccatacgcctggcccgggccgcccttcgccccgtcggacgccttcggcgtcgccaaaacggaaccggccgccggctccgggaccttcagccacgattcgggcaccgtatacacgcggccggcggccatcacgccggacttcggccacgcgtccatgaacacgtccacgtccccgaacagatccggctcgcccgtcgtccacacatccctgtccgcatcccacacgccccatgcgcgccccctcggcctcatgggcggcagttgggcgagacgcctcagccgggcgttcgacggttcgcgcgccgacttcggatcgcgcggccatgcggtcacgaagatgcgcagcctgtggtgggggcgccgatgtcggccgcctcaaggcctcgccacaccgcgtcgtagcccagattcgccagatcgcccagcacacggccgagcgcccggatcgtgggcgccgtatgcacgccggacaaccgttcgtcatccgccagcaccatgtcgcccctcacctcgaacacgcggcggccgcactgcctgcacgtgacgggcgagcaccgctccggatccgcatgcaggaaaccgcgcaggacgacggccaggggctgcgaggtttcctccttgggatccggggcttcgaatccgtcgggcagttcgaggtccggaatttcgcaggagcataatccggccttgtccaacgcttcggagcggagcgcgtccatgcgctcgtcctccttggagacgctgatgccgctcaggagtccggccacgttctccgcgaccacgagactggggcggatgatgccgattcccttggcgtagtcgagccacaggccgcttcgcgttcccgccttcaacccggcacggaaccccgcaagagaaagggactggcagcagaatccgccggccatcacctcgatgtccttgtatttctcccagtcgattttcgtgatgtcgcccaatcggcgggctttcggcgcgtgatgggagccaagggcgagaggcccgggttcgatgtcggaccatccgaccagttccccctcgccgatcgccttggatacgccgatgtcgaggccgagatagccggagaacagggaaatcgtcttgtatgtcttgttctgcatacgcggctgtatgcgttccgaggcattcgaaaaaacccgtcagccgttgcagatgacttcgctctggcgacaagctaaaacaaagtcatctgcaacggatcaatcctcgacgatcccgtcgggcgtccattcgcatgcataatagggtccgttgtcggtcatccacccgtccttcccgtccgccggacgcccctcgtagcggctgatgtcggcgatggccggatcgtcggtcttgtggaggcggatgaggtcgcccggctccggttcgcgccgtacggcctcgggcagcacggcgtccgggtcggggaacgcggagccgtccccgacccaatggtcggtgcagtccgagtccacgatgtaggattcgcccgcatcggtcctgccggccaatgcggggcggaagcgcgaccattcgtcgccgtcccgttggatcaagatcccgcctttgatgcggtcgaggaggcttgcgggcaggttctcccaaccgatgatgtcctcgttcatgcccgcgcgcatgcgtccccgacgcatggcctccggttccgcggacgggttcgaggacatggtgctcacggccgtcgacctcggcatcggcccgacgaccattcccatccgacggacggtccacaagacgacgatccggctatgcgccgtcgcgggggcgcatagccggatcgcatggtcatggacaggaacaatcgaagccaccgggcgaagggccttccccaagggtgtgcgggcaccttcgagccggcgtccggcacggcgggcggagacgtcatgccgcccgccgccgaggatctcgacccgaaacgctacgggcacaagagggccgtcaggcttgtgaactggcgggtcgaacacgatccgaccagcctgtggctgcaagaccggctcaaggccaccatgcccggcgtggacgcggacggcaacccgttcgactaccgggacgagccggtgctcgacccggcggccgaggcgcgcatgatcgacgacgcggtctaccgggaggatgcggacggacgcccgcactacgggcggatcatgcgcgccctcgcctcctggtatccgaacgaggcggaacgcttcgacatggcgcgcaggatcgcggaggaccggtgcgacgcgctgcgacgcaacgtgatcggcgacccggcccgatgctactccgccaggctcgtcggctacgcgctcacccgccccgtgcgcatggaggcgatcctcgcccgtccgccctacaatctgagcgcgcaccggatgcgcgtcggcaaacggtacatggaccggatcggcgcgtacgcgcgcgaacacggcggacgactgcccgacaaaaggcagcgcgaccggatctgggacgagaacatgggcgacttcatccacgagaagatcgcgaagggcgtccagtacgggcgcggcatgtactattccgacgggtcgaacgcgcgccccgaataccatgggcgcccgccccgtctggacgcggacgggaacccgttcaacgcgcgcgaggacttcgaacgcatgctggccgccggacgtgcggagctcggtcggacgcccgccgaattcgacgacgtggtcaacaggatggacgcgcatgcggcgttcgccccgggggcgcggacgcgcacgccgcatgggcggaggcgcgccggcgcggcctggacgtgcgcctggtcgaggccgcgctcgacgtggacgcgtcggacgcggccgcatgggaggcggagtatcaggcgagctcgggcacccggtaggtgcggggcacggccgcgcccgcgggccacatgtcatggtcgcgggcgaacctgaccgtcacgttgacgacggtcccgggcatggggcgggcgagcatcgcgtccaggccctttttgtcgccggccagccagaacacgaggagcgcgaggtccatggcgccggccgcgcatccgggcctcgtcccgacgagcgtcgaaagcgtgtcgcgcgcggccgtcagccggccgggcctgggcgtgacggggatgggacggcggcgcagcacgtccatcgcctcccccatgccggcgggcaggcgcgggtgatccgcggcgcgtgcggcgagcgtgcgcgcgtcgcacgtcgggtcgaggagggcgagcgccatcatgtcgcgtcccctgggatcgttcaggccggcggcgagccggtcggcggtctggtcgttcatccacgtgcccgcgccgccttcgaggcgcgcgatccactcgttggccaggttcatgtagtcttccattgccgttcctccgtttcgacggtgttgtgcgccccgggtatgcgttccccgtccgtcagaagagcgggaggcttgcggggcgttcgagccggtcggccgtgagcggcaggtacgtggggtcgagctccgtggccgcgcaccgcaggccttcccgccggcatgcgtccagtgtggtgccggagccggcgaacgggtcgaggacgaggccgtggggcgggcatgcgaggcgggcgagccatcgggtcaggtccaggggtttgacggtcgggtgggcgagccgtctttcgcccgccggcacggtcagggcgagcgccgccgtgtcgagcaggcacgcggggtacgcgtccgccccggattcgagtcccaggcgcgcgcagcacgccttccacgccttgtcccgtgtccgggggcggacgatgcgttccaggacgcgcacgggcctgtcctgcgctttcgggcagtagtagaagcgcggcgcgtccgcgggcaggagccgggccatggccttgtccatgaggacgttcgacgggtggcggcccggtatgcgcggccccatgggcctgggcgtgtccgaatcgcggaacgtgtcgccgccgcgcggcgcgtccggacgcccccggcggtcgcgttgagccggtagcggcgccccagctcccccatgtccgcgtccagggcgcaggcggccacgttcagggcgcccgtcccgtggtccatgaggttgcggccgagcatggactcgcgggggcgctgggcgacgaggatcggctcccatgcgggtttgagcgccgggttgaacccgcgccagggccgcgcctcgcgggtcttcgcctcgtagcgttccgtgtaggcgacgttgcgttccagggacgcggagtcgcgtatgacgccggtccggtcgtccttcacgccgagcgcccggtcgaccgcatggtcgccccattcgcccttcggcatgccggacgcgtacagccagcagaactggtcgcggatcagccagcccgcgtcctccatggcgcaggcgagccggtgccaggtgcggggcgagccgaacacgagggcgaacgcgccggggcggaccatgccgagcatggccgtccagaattccgggtcgaaggcgatgccggtggagtcccagcgtttcacctcgcccgcggtgcccaggccgagctcgtagggcgggtcggtgacgatcgcgtccgcgggcgcgtcgaggaggccgggcaggcgtctcgcgtccgcgttgtacagggtcaggccgtcatggtcgatgaatggtctcatgggccccgtgtatgcgtccgccggggcgggcgtcgggcccgtatgcattccgggcgggctgtatgcatccgtatgcatcgggggatgcatacatcttttctttccgtttcggcttgtttccgacgttccggggatggtccggaggcgtgtatgcattgtatgcatcattcccttataggggattcgggaaaaaggaaggaaaccccatatattgatgcatacaatgcatacaagagaaaggaattatattttttcctttatatataagggttttcgggccttttcccaagccttttctgtatgcatccccggatgcatacagatgcatacacgcatacaaaacgggccggaaaactttacaatattgtaaagccccggccccggactttacaatattgtaaagtccggggccggggagcccggcgaaacggatcggaggatcgcatggaagacgggaacgtgaaggcgacgctcgacatgctcgccggactgggactggacgtgcgcgtgatgcgcgagacgccgttcctcgccgtcgtggagaaccccgccatcccctcgcgcagggtcgccgtcgccgtcccggacggggacgggcccgcccgggccgccatgttcgaaaccgacccgcgcaccggccgcaaccggccgcacggggattccgcggccgtcccccgcgacgacccgtggccgacggtcgccggcatgtgccggacatggctggccgggctcggcgcgctcggggacgccgccgggctcacccgggccgaactcgcccgcaggacgggcgtcgcggccaccaggatcagcgaatacgcccggccgcgccccgggcgcgcggatcccgccaacatgacgctgcgcaccgcccgcgcactggcccgcgcgctcggcgtcaccatcgacgccctgtacgacaccatggcgatgcgcatcccggaaaacgggccgacggcccgacaggcgggaacatccgatccggcccgccgggcatgaaaaaaggcccgcacggcacgtcgccatgcgggcccgggatgcgccccggctaggggcggacgagcaggaaacggtacgggagcggatccgtctcgccgcgcatccacacgcgcagcagcggccaccccgcggcccgcgccgccgacgccgcatccgacaggtccgagacggcgtcgacgatcaggttcgcgatcccgtccgcggacacgaacgcgtcaggcaggcccgggatgcgcgccggcaggccgtcgcgctccatacggtacagctcccacacgtgcagcacgctcgcatcatacgggtgcgcttccggccccgcatgatccgacccgtcgcgcagacgcccggcggccgcgagggcggccgcatgcggcaggatcgcgacgagcctgtccgcacgcctgtcgaactcgcggaccgtcatgccggacggcatgtcacggctcgaatcccacgccacgtgcacgttcaggaccccgtcgaacgtctcgaacggggtcagcttcgaatcggctatgatacgccccctcttccggtcagacgcccatgcccgcgaacgggtccgggacgccggccgccgacgcgtccggcaggccgaacgccgccagcgggtcggtttcgccgccgatgcgctccccgtcgcccgtcttgacgaccgcgttcagcatggcgcccacgcccgaattgtcctgcctgtacgggtacagccagatgttggcgcgcacgatcgcgcccgaatacagttcgttggcggtcagacgtcgacggttctggtccacgacccagcccgcggcgacgaggtcgttcttcgtgccggccttcaggatccaatggccctcatactccttgtacacgtccttcttcagcttgcccacgttgtcgcccctggtgaacacggccgtgtccccgtcctcgacgggcaggcccaggcgcttcacccaatccgcgtcgtccatgctgtgcccggcgaacggcgcgtacgacttgccgtccctgccgggttcgccgtcgatgccgcggcggatcgcctccgtgcatttggcctgcaggtcgcgcatcatcttctgggcgtccggatccttcttgtcgaacaggatggacagcgtgtacttgccgttcttcggatccgtgtcgaacaggtgcgggaagttcgcgatcccgggcactgtcacgaggttcaggcgttccgcctgctggttctggtcagccatcaatgggctcctttccgatcatggtgggccgccccacgatggttgcggtccgacggttcccgtcagcgtccggtatgcgtccccggctcacgcgcggatgctttccggccggaagcccacgtcctggatgtccggcccgtcgatgcgcaccgtcgtcagctcccgcccgtcgaacagggccgcgtacgcgccgtccgcgaacgggatggagtcgcccgcgcacagggcgcccgcctcgtgggcgagccggcgcgcctgctccccgtcgcccaggtccgccagcgattcgatccggtccttcaaaccccaggcgcgcgcgtcgtcctccacgccgcgcgcccgccccgccggcgggccggcgggggcgggaccacgtccccgccggcggcccgcatgggcgcgaacgtgcccgcatacccctgcggcaggccgcccggcctgtgcgccctgttgttcctgtccacgctcattccagctccttccggtcgtcgtcccgcatgctatgcgcccgcccgtccggccacgcgtagccgcgcagacgggcggggaaatatttcaggcgcgaccggtacagcagccacgtgcgcaggagggtcggtatcccgtccgacttgcgcaggttgtggcgggcgcacaggccgaccagattgtgccggtccgtggccccgcccctcgaccacgggtaatgatggtccatatgctcgatcggcccccggcatcgcagcaggccgaacaggccccgatgctcgcaccggccgcccgccgccatgcggatccacgtccggtccgcgtccggaaacaggcggaccggatcccggtcgaacgggttgtcgggcttcggcatgcgcaggttcgcgagggccaggagcgcgatcaggacgacggccgcggccagaatcgggacgaggcgcgcgcccgacgcgtcccggatctgacggagcatgcgcgccagccccgccgcacgctcccccgcatgccacgggtccacggccgtgtccgccgcgtattcgggcgaatcctccgccaggccggccctgagccggcgggccaggagcgtccagtacgcgcccgccaggccgcccgcgccggccagcgcgcccgccgcgtacgaggcgacgcggagcagacggtacgcctcccaggcgcggcggatcgtgcgccgcacgctcacagcagcccgatcagccaggacaggagccgccacacggggatgaggaggaacgagcccacgccgatcagggccgcccacggcgaccaccggtccgtgtccgacgcgaaccggtcgcgttccctgtcctccgattcgcggctcatcgcaacgcctccatgtccccgtcggacgcgagccccatgcgattgaggaggcgcatcgccgcgaccgcgtccccgtgcaggtccgacacccatgcggcgagcgcgtcccggtcgggccggtcggggaacaggccgggccagacgcgcatggccgcgcggatcacgcccgtcgccccctcccggtcgccgtgcgcgtccatgtcgagggcgcgcatgcccgccaacgccagattggccgtcaacgccaggccggccgtccgccgggcgaacccgatctgctcgccggccggatacccgccgggccaggctttcagcatgcgcgcgcgcatccgttccacgaccagcatcgtccccgcgtcatccgcgtccccgtcgagggcggcgagcgtgcgggccgccgcgtccgcgtccgacggcgcgtcctccacggacgcgtaccagacgccgtcccccgtgtcggcgagcaggcccatcgcgtccagggcgacggtgacgcgggtcgcgtaccccgggtccgtctcatgcgggtagcgggcccagatctcgtcgggcagccatgcgaacgggagggcgagcagttccatggtgcgcggcgaatccggtctgacggccatgggttcgggtatgggcagcgggcccgtgccgggggcgagcagccatccgggcggcgtgccatgccccagctggtaggcgacggcggtccggttggcttcgagcagtcgcgggtcggacaggagatacgggttgtgttcgctcatgcgcccctcctatgccgcgccgtgttcgcccgctgttcggcgaggaacctccggtagttcggatcgttgctctcgtctgatatgtcgccccgctgttcggcgcggctgaaccgccgctcctccgtgctgcgcgcccgttcgcgttccaggagcgcgcgcgtcgcctcgctgttcgacgcgggtatgcggatcggacgggccggcgtggcggcgcgtccggacgcgggccggttcgtccggccgcgccgccgcatgtcgttcaggaggcgttcgccgacgcgtatcagcgtccgctcgtccaacccgttgttcacggtcagcttgtagcctttcccgaagccggccaggagggcgttcttcgacggggcgaggggccgggcgggcgcgtcggggcgcgcccccggacggccggccgggggccgggacgcgtccgcccggctcgcggggccgttcgcggcgcgcatgcgcgactgcggggaaccctgggcgaacgcgggccgggacggtgggcgcggggccttcgcctgctcgtggatgtcctcggcgagctggccgatgtcctcggccgccgtgtcggagcgcatgatcttcctcacctggctttcgagctcgtcgccccgcagggatttcgccaattcggcgcgcaccttgttctcgtatcggacggtcgccagccggttctcgtccggggtgggacggttcgcgagatattcggttctcgcccgcgcctccttgtctctggcggcgatggccgccttgtccgcctggctgggcccgtgcccgccggccgaccggccgccgcccgtcatgccatgcatggccggccccatgcccgccttcaccccgttcatcgcggtcccggcgaacccgccgcgcccaccgtccttcatggccatgcccgcggagccgagcgccatggcggccgagccgccggtcgccacgcacacgcccgccgcgatcgcggcgcccgcggccatggtcaggccccgtttcatgccgttgccgaacccggcgagctgggcgaggccgggcaggctgaacgggttgccgatcctccacaccttcacgcacaggagcttcacggccttcacgtacaggatcggcaggaagatcgccgcgacgagcaggcccgcgaccccgccctgcgtgttcccgtccgcgtcgaccaggcccaggagggccatgccgatgttggtgaacaggatgccgagactgccgaacagggcgacgaccgtggggcccgccacccatgcgagcatctggacgagcgcgttgccgaccgcccgccggcccgcgtccgggctgacggcgagcaggagcaatgcgaggaacaggccgagcgcggccaggcaggcgacgagcatgctcagcgtctgcaggctgccgcacagcaatccccagacgatcaggttcacctcgccggccacgccgttcaggaacccctccgacagggtgcccagggagcttttcccgtgctgctggtcgatgagccggtaggcggccgtgttctgctgcatgttcccgccgccgttcgtgaacacgagctgctgccagccgctggtcgccgtgttcacgtcgaacaggagcgtcaggttcgcgatctcgctgcgcttgttcgtcttgtccgaatcgtcggtgacgggcttcgccttgtccgcgtcgccgcgcgtcacataatacgtgtcgttcccgtccgggtcgatgccggtcaaagccgcctcgcaggaggatgcgagcggccctcccgcttcccggctgacgacgcccgccgcggagcccgccaggggtttcctctcgatcgcgccgacgaacttgaagcccgcgcgcgccttgaacgagccgtccgcatccaccttgcacacgttccacagcatgacccaccggtcgagcatctgggtggtggaatccgcgggcagtttcagcgtgtactggacgcgcaggtccttcgccgtgctcatcatggtcggccagaacgcgatcgcgttctgctggacggcgttcaagccgcccatgcccgcggtcgtgatgtcgctcatcgccttcgcgtccgcgcccgcacggtattccaggatccggcagaacacgttgctcgcgttcgcgcccgccccgtaggagccgcgcatccacacgcgcaatccggtctcctcccacatgaggttcacgccgtccgacatggcgttccggttcttgcgggccgcctggttcaatacggacgtgtaccgtcggcaggacgccatgttcgactggtcggacgggtcggcgaccagtccgcccgtcttctccaacgcgccgttgaacgccttcgtgacgccgccgcccgcctcgtcgaccacgcttttcgccgtggacaccagccagtacggggtgcccgggtacgcgtccgtcggatgggcggcgctcgtcgcgcccatcatgtagaacaggccgagcgcgaggaacaggcagacgagccgtctggcgagcacgcccgccccctgccgcatgtagacggcgacgacgcccgccacgatggcgacgaggacggggatggcgaggaagaagccgatggtcgccggatcgaacagggccttgtagatgccggccgccatcgtgttcgcggccgggccggccagggcgatcgccttgtccgacccggccaggacgccgccgtcggccaggttcgcggccgccgcccacatgccgttgcccaccgcgttcagcatgtggccgagcgagttgccgatggcgtccgtgaagttgagcatgttcacgatcttcgacgcgaaatcctcgcggctggtgcccgatatggtggccgtcgcccaccggtcgacgggcaggcagtcgagcgccctgcagaccacgtccgtgttgagcgtgtccgcgctggcgggcgcgcccggcgtgacgcccgccccctgcccgccgcccgcgtcctgcgtggcgagcacgatcatgtccgacatgaatcccatgcgggatcctccttcgttgtcagcggtcgatcacgtggtcgtggaattcgatgagctcgtagccgcccggatcgtacggttcgaggcttcccggacggacgaaccggccgtccatgccgtgccggcgcgccatgatccggtcgatgcgccgcatgttgcgctccccctccacgctgcgccggcggacgaacaggacgagcgcggcgaccatgcccgcggggatcagcaggtacggccaccattggccggcggcggccggcagcacgcgtacgagcgtggcgagcgccgcgcccgccacggcgcccgccacggcgatgaacaggttcgtgctggacacccattggcgtccgcccaggtgcagttcgtcgacctgggagacgcgctggccgctgaccgacgtcagatcgaacagcatgatcctacagtccgaacacctgggagatgacgttcaacacgatctggaacagcatggcgaccagtccggcggcgaacgggaggatctgggagggcaggatgccgcacaggccgagcgtgatgcccgcgcagcaccatccgaccgtgcctcccccctgcagcgcctgcccgatctgcgtggacggccaccatttgcgcaggacgagcagcacgacgcaggtgatgatcacgaccgcgccgagcaggacgagcagggtcgcgagcgccgcgttgcccgtcacaaagccgcacagtttcgccacgccgtccatgatgggccgcacgatctggggtgcggcggcgacttccacgcttcgcatggcttccatcctttccttccgacgtcatgatgcacgccccctatgcggcatagggggcgtgcatcatgcgaaggaaaagaatcgacgaggacgcgggctggcgcgcccccgacccgaaacgcgacggcgacccggaccgccagttctcgaggcgcgcgttccgcctcaccggcctgcggctgctcagatggcagcggtggatcgcgatcatgctgctcctgatcgtcgcctatctcatgtcgaacccgccggacgcgtcgaagcccgcccccgccgcggacctcgatcccgcgggacgcgtcgaatcatgggcgttgacggagcaatggctcgccaagggcgcgttgggcgcggacgcgcggatcgtcagctggaacggacaatcccacgccaccgtgtcggacgggtccaaggacatgacattgagcgtgaacacgctgatcgtggactccgcggccggctggtggcgggtcaggaccacggtcacgcccgacgggcgcctgtccggctggccgagcgtggaacgactcggcctggcgggcgcggacgacaggggcgatacgggcatgtggaaggacacgctcggacaattgaccgcgtccgacatgctggacacgaccgtgcgcaaatgggcggacgcgttcatgggctccgattcggacatgctgaccgtgctcgtcaacgatccggatccgaacgcctggtatcgggcgcaggggctcggcaaggcggcggcggccaccatcgacgggggcgcctacctggacaaggggaacgtggaccgtaacgaacgcaggtcggaccgggcggcgctcagggtcaccgtcaccgtcgcgcacgcggacgcgggcgacggttcggccgcccaatcccaatactcgtacgatctgctggtcgccgacccggacggcacgccgcgcatcctcgcctggggggctcccggcacgggcgcgaccctcagggagcatgggaaccgggcgcccggcgcgcgccccgcgcacgacgcgtcatccgacacgtccgcgtccgcgggcacggggggcgcggcgaaatgaggggaacgcatacccgggtccggcatgggaggacggacatgacggcggacacgagacgggatcggaccagactgcggcgcgggcgcgtcaggcagcggcatgtcgccctgctcctcctgttcgcgctcgcggcgtcgggcatgggagcatggctcgcgaaccccgcgcccgcgacggcggacacgacggtccgcgcctcgatcggcgtgcagggccgtcccgacccgttccccgccgcggaccgcgaccggacgcgcacggacctgacggtggacggcacatgggatatgggcgaccggccggagggcaagctcaccatcatccacgcggacaatccaacggtccgtgacctgatcaacgggcgcgacgaggatcagactccgaccggattcaatccggaccatgcgaccggcgacacgggcaacgcgtacgcgtacgggcaatgcacatggtgggcgtatgtgcggcgcacgcaactgggattgccggtcggcagccggctgggggatggcggcatgtgggccgattccgccaaggcgctcggctattgggtggatgatactccccgacaaggggatgtgatcgtgttcagcccggcgcaggtcaacaacgcatgggggcacgtcgccatcgtggagaaggtcaacggcgacggttccatcgagatcagcgaagcgaacgtgaacgggcaggtcggcccgttccgacgcgccatcgaggcgaaacagacgcatgcataccagtacatccactattagaagagctcccattgtcctgacggttctcctgccaatcgtcatgctcgccatgccgacgatcccggcatgggcggacgccgccgattcggctccaatccacatggcgagcagtgtcagatcgttcccgaaacacttggttccgcatcgttcgttcagtgaggccgtatcgaccgacgtggacggctcatggggaggcatcgaaaccctggacgtgccgcatgcggaaagccccgaggaacaggccacgcgcatccaggccgaacaggcgcgacagtcggaggccgcgtcacgcgccgagccacgcacaccggccgtatcggcgccgacgacaggtgacaaggagaaacccgcctcggatacggccgccgccctggtctcctacgcgctccaataccagggcgcgccatacgtgtacgggggcaatacgcctgccggctgggattgcagtggtttcacccaatacgtgtacgcgcggttcggcatccaattgccgcacccgtccggcatgcaggccacgatcggcacgcccgttactgacccgcagccgggtgatcttatggcaaacgcggggcatgcgggcatttacatcggcaacggtctgatgatccatgcgatgaacccggtcgacggcacgaaggtcacggccgtcatgcccggcatgggatattatcgcctgctcggctagggcacgctatactgtgtggaaagggtcggcgcgcgttttccggttctctgtccgaacgacgcgcgtcgacccttctttgtcaccggttgttgttggcgtacgggttttgcgtattgcctgatgttacgggcggttgggccgcctgctgtggaggcgcgtattggcctgcgtccggcggcgggatcatgccattgccggtaccgggcacctgaggcggatacgggttcaccggaggcaacggcccccgcgcccgcgcggcggacggtgtccgggtcggaaggatggcccgtatggcgtgttcccgtagtggtttttgtccggtcaagccgcatcctcccgtccgcatgcgggtcccagggggccggcgggcagcacgatcatgaccttgcggccccgatcgtccgccagggcggcccgcatgccccgccgtctcgcctcatgcaggacggacaacgcgagcatgtccggatccgatccgtgcaggacggtgcgttcgccgccgatgatgagcatcgccatcgcgcgtgtctccttcgccttcagtcgatgttgccgagcagtcgggcggcgagccggtagcggcggtccatcccgcgcgccgccgtccccggatccgcctcctcgcccatatgcgcgtccgtgtcctccaaaaggatccgctcccgttccggatcgagcccgtagcggccggcgagcgcacgggaatactgtcccacgccgtcccctccgcgatgcgttcgcccaacgcgtcccattccttctcgtccgccagggcgagcatgttgtcgcgccggacctgctcgttgagctggcgggctttggcgagcatgtaggcggccgcctccctggtgccggagatctccttgccgcgtttctcctcataggcgcggatctcgtccggatgcctccgtcgatgccgttcgaacgcgtcgatcgcgtccacatgcttcttcgacggtttcggctcctgcctcaaccgttcgatctccgcgtccacccaccggtcgagttcgccgaattcgggatcccgttcgcgttgcaggtcgcggcgggcgagcatgaacgcggccgcctcccggtccgacgagatcgggtcgcggcgtcgggcgacgaaagcgcccgcctcgtccgcatgccccgcccgccatcggtcgaacgcggcggcccaccggcgggtcgtgcggtgtctgacgtcccgttcctccagttcgagcagccgaccgtaatgcccctccatgagggagacgaaccgggcgtgcccatcgtccgtcacgggcgtgggcgcggcgacgtcatccggggccgcgcccgtgtttttcgcctcgtatcggccgccttcgggcgtgcccttcggcttgtggctcctgttgttcctgtccacggtcaagacgccgttcccctttccttactggttcttcccggccacacagccggcgaggtaggtgacggtctgctgtttctccctcggagtcatcgtcagaccgtatttcgttttgatgctgacgcgtttcgccatgtagtcgcaccggtacgccttgttgtccggcatccagatgtcgggcgcgcccgtatgctgcgtcaggtatccggatcgtccgttcacgtcgatgccgctccccttcgccatgttcgccggcccgtccgaggcgaggagcacgtccggatcgttcgcgtattcgacgcgtttcgcctgatcccagtcgcgggcgccggacgcccaagcgtcgtacagggacaccacatggtcgatctgcacgtcggcgctcgtcttcacgccccgtctgaacccgatggtcccgcccgtgtacgggtcgcgcagcgtgcccgacacgacccggcatgaggagtccttcctcacgccggtcatgtcacgggcgaggatcgtgtccctcgtggtcgccttcccgcagccggacgaagcccagccgccgaaccgcgtctcacggtcgtagccgcccggcctggcgtccgccgtgcctatccggccggccgcgtccaactgggcccgccatgcggccgcatcccccgtcggggccgtgtccggggttctccccgtgcccttcgcccccgcgtccgtctccccgcccgtatggacgccgaacagggagagcaggcccgacaggcttttggcatccgggttgcgtcccgcatcccccttcttcgattcggccaatgcggccgtggacgcgtccgggttcccgacgcccagcgtctcggacacggtccgccagcctcccgaggagacgagcacgacgacaagcacgcccaccatgaccagggtcgcgatcatggacagcagctgccggaacgggcctccccatcgccacgtcgcatggtcacgcctccgggatgtagacgggggcctgcacctgttcgagcagccagttgatcgcgggcgtcaatccggtcatgttcaggccgagcacgccgagcacgcccatgatcatgatcgcggacaggagcaatgcgaggacgcgcaggcccatggagagcgcggactgggcgcggttgaacgcgaagcccacgaggagcgcgatcatgaggacgatgaagtacacgccgaacgcgcccggcgcggtgacgctcgaccagaatgcgcgccagccggtgacgccgatatcaacaatgctcatggcctccccctatgccccaaaggggcccgtcgtacgggacgacggcccccggggggcgagggacatgatggcggatgccgatggacgggatcggcccgtgacgggcgtggaacgagaggctgcgggcgtgttcgacgaaaacgcgcgcctgcgcggacccgacccgcgggccgcggccggcgatgcatcatgccccgttgcgcacgcatagcctccgcacgcaacgggaaccggaacgggcggaggaaacggcgtaatgaccgtggacaggaacaacaggagccacaagccgaagggcacgcccgaaggcggccgatacgagacgaaaggcggcgccacgggcccggatgacgtgaggccgcccaccacggccgaaaacgcgtccgacatcctcgaccgggcacgggaacgcggcctcgactgggatctgctcgccggacgaagcgagaacgggcgcagcatcaacctggacgcgcggggtcacggcgaccggcgcgtccacgcggaacccgacgggcacggcggctgggacctcgtctaccgggaatggaggaaacccacattacgcgaatacaacgggcccggcatccacccgttcggcgtattcggctggatgtccgaccggatcaacgggaacgcggagacatggatccccatccgtcgcgggcacgccgccaatgacgaccagctgctcgacgccgccgccgactggtgcgggaccgactgaaacgggaagccggccgacggcacgcatagccatcccgcatgagcaaagacacgcacggccggacgcaccggcccgccggactgccgaaaggcgtggccggcacctacgacaggaatcccggcacgaacggcgacgacatcgccccgcccatgcccgtccacgacgatccggacatactgcgccgcgaactggcatccatcccccagcgggacggtccggaatacgacgggctgcgcaccaggctcgcccgcgccgaactgaggcaaatggaatcgaaagagaagcatgccaccgccgccgacatgttccgctcactcagcgaaacaggaggcgggacatggagtccgcgaaacgacgccactcccgttgtcgggttctgccattcaccataccccgaacggagcagggtcgtggcaatgccctccaccaccgatgatttcgcacgactgtccatggaatatctcatggacaatcgcgatctgctgtcgaaagacggcaactatctgggattatggcgcaacccggccgacgacagattatatgtcgacgtctccgtctgcgacatggacgcgcatgacgtccgggacgcatgtgccaaacatgatcagatagccttctgggacatccaattgggtgaagaggtcatcgtgaatccagacgcgcgatcaggacaataaacaaggagaacgacaatggcacgacagcttgaaggcctatacgatccgaagaccggagccgtaggcatggcaaagttcagcgtcatgatgatgcgtaaactcaacgggcacatcaccagccgtcaggaaatcctggacatgcaggacacgctgggccgcgaatggacggaagaggagataaaggagatcctcaaggcgaacgggacgtccgccgacgatccgtcgcagacagccttacgcgcatcgacatgcgggggcacgcatagccgtcccgcatgagcagagacatgcacggccgcggccggaccgccggatagaggacggccgtcctgtccgcgatcgcgcatgcgcccccgcgcgcccgggacgcatagccggaaccatcatgaacgataagcctctcttcgaaatccggcagggcacgacgcccatgctcgtccacacaccacacgcgggccggctcgtccccgacggattcgaccgcacccgcctgacggacgcggaagcattcgaccagacatgcgaacaggtacgagaccggcacgcggacacgctcggcctcatgatcgccgcccggctccacgcaaccatcatgctcgaccacacgacccgcatgtggtgcgacccggaacgataccccgacgaccgggaggagatgaacacggccggcatgggcgccatccccacacgcgacatcgacgggcatcccctctacaagcccggacaggcacccggcatgagggaacgcggacaacggttccgcctcctgtacacgccatggcaccgcatgctgcaagcccaatgccggaccatgctcgacacgtacggacgatgcacgatcatcgacgtccacacccaccccagagaaccacgcccgttcgaaccgcacgccgaccagccgcgcacccagaccatcatcggccacaacaacgatcccgcatcccgggcgatcggggcacgcgccgccgcgctcctcatgggccgcggcctcaccgtcggcgtcaacaccgcacaccggggcgccatcacccccgacggcatacacgacatacggctcgccagcatcatggtcgaaaccagatgggacacggccgccgaccccatggcgcgccatgacatcgccgacgcgatcgcacgcgccctggagggacgcgcatgaaaccacgcatgcaataccggagccgacgcgtccacggcatcctgttcgaacccgaccatgcgagcatgatcatccgcaacaagcccggccgccactacctgatccacggcgacgacacccgtctcatcaccgggttcgacaccccgctggacgcgcccgacaccatgggctacggcatctaccacgaagccgaccggccgaacaccatgtggatacgcgaccggaccggcctacgccgcatccaaggcacgcccgccacgccgctcgaacgcgacgcgccctggaaccgcgtcgccacccgcatccccaaccatcccatccccagcccatacgcataggcgcaccgcatgagcacagacaggaacaaccggagccacaggccgaaaggcctgcccccacgcgtggccggaacattcgaaccggaagcatgcggcggccacgagaccggcatacgaccgcccgaaccacccgaccgcatcgaactcatggaactcgaacgcctcgcccgcaccatgcccgcaccacggcccggcgacatcgcatggcgtttcggcacgcacaccatcccccagcaggccatcgacatgcgctacgggcgcgacgacatacgcctccaacggctcgtcatcctcacccacgcggacgaggacacgcgccgcatgctcgccgcacgcatgcacgaccacgattggattcgcagccacgccacacccctgttcaaagaccgcgcatgcatcatcatccccgaaccggacccctgggatgaacccggacacgaacccggccggccggacacacgccccgtctggccgcaccccatcgacacgcgcatgatcgccgaagactgcgccgcccacctcgacatccgacgctcatacacgcccacgcgcgtcagccgcacggggaacgaaacccacgtcgaatgcgtggacgacacgacccacacgtcccgctcctaccggaccggaacgaacatcgcgcatctccccgacggagcctgcatcgaacatgcggccgacggacgatggcatgtcatccacgacgatccgccgctccccccacgccccgccgacaggccgcacgcacgcgaagacacgcgcccgcacgacccccgacccgacacggaaccggaaccggaaccaaacccggatccgcccgggcgatccgacgaagcggacaggccgcgacgcccggcctccgacccgcgcatgcgccaagcctggatccggttcctcaccggactgttccagggcgtgtccagcatcatccgcgaatccaggcgcgcccactgacagggggcgccatgcgcgccgtccggcgcacgccgcggacgaaaacgaaaaaaaggagacaaagaaaaggaaaaagagaaaaagagcaaaagaggaaaacacgatacgacaccatcccatcagccatcggaaaagaaaaaagacaggacaccgacacccaggaacacacgcgacggacatcacaccacaaaacagcatcacatcaaggggagggaccgttttcccttgcaaaaaaccgggtttcggcatggtttccatgcccggacgccgggatttccccttcatgagggacgcatacccgatccgcaagggacgatggaaggggaaggcgtatgatcaccgtcagtttcgacgacacgacggccgggccggacgacctgccgttgcttcggatcgcggacgcggcgaaccggatccatggcatggacgcgcggcggctgcccggcctgctggaatcatcctggctggactgggcgccgccctcctcgcgtctgcccgacgtgggcatgccgtcgccgcccggccgggacgattggctgtgggcgcgcgggcatgcggggctgctggggttcgacgtgtccgcctacgggtcgggcatgatgttcgcgtccatgctggcgaagcgcgtgggcgtgcgccgggcgggctggtgcgcgctggcgttggcctggtgcgcgcgcatggcccggttggatgcgcgcgcatggacgctggccctgctggagcatgatccggcgcgcgtgcgggccgattcgcttcggcttgtgccggtgggcccgttgtcggggttgtggagcgtgtgggcgtcgcccgcgttcatgccgggcgtgacgggcgtggatgtggcgtgcgcgttgatggattgcgcgcgtgcgggacgctaccggtcggatcatgtggtcgcgccggacggccggacggtccgaatcccggatatggtgtgggatcgcgtggattcgatgggattggcttccgtgttcgccgacacggggttctagaacaggggcgtcatcgtcccctcgtccggcgtgctgttttcccgtctgcatgcgcgggcggcgtggatcatgcgtcccgcgtccgtctgacgagcagccgcttgtacagtcggcgtccgttgaccgtcggatcgtcgagcttgccgagcagcatgaacccgttgcctggcgcccaatgttcgaggaagttcaacgggacgcccatcggcccgtcatgatcgtcgggcatcatgcgcatggagtccacgttgatcgcgtcgtaggcatcatattccggatattcgtcctcatgtccccggtacgtgtgtcccgtgggaggctgggtcttgtcggcgcgtgcggcggcgaggctggtgagccatcggatgctgttgacgccgaccgtgccgtcgggccggatcatgcttcccgtcttcggccggtcgtcgggcagtcggaagaacatgctgcccgagtggatgctcaggccgacgaggcagcgtcccccttgaccatggggaatacgtcgttggcggtggcgaggttcaggttggcgacgatcaggaaatcggtgtccggatgccggcggagcatgcgcatgaaccggatggccttgctgaacggcgggttggtgacgacgatcgcgccgggccggtcgagcaggcgttcgcattcgggcgagtcgaacgagccgtcgccgtccaatgggcgggcggccaggtccgcgatcgaatatcttccctcgcggccgtcgttgtccacatgccattgcatggcgggcgtcccgtcgtcgaacagggtgtcatggtcgggttggaagctcgtgcaggtgagggacgcgatcccgtattcgctcatgtggtcgagcgtccatcggacgaacatgctcatgccgggccggtcattgcagtcgcagatcacatgccggccggccaggtcatggcggtaatgggacagttccctgtcgatcgcgtcgtacgtggtgtagaattcgtcggccttcgccttgcgcgcgccggtcaggtaccggtgatgcttgtgtgttcccatgccccgtcgtatgcgtcaggggcacggttttccggtcggctgtcagacggcgggaccgttgcagtctcacccccggatgccggtcggcggcatgtcatgcggggacgaatacggtttcgacgtgaaccagccgtgcacgccatgacccgtcctgcgctccgatacggacggggccattccaggggtccgcaaaggcgcgggctccggggcggccccttttcctttccgtcctacctctgcgcgcccttgcgcaggttgcagtcacggcacagcatctggcagttgtccggcacggtgtgcccgccacggctccacgggacgatgtggtccgcatgcatgtccgccaggccgaactcgccgccgcacacggcgcaccggtgcccttgggcttcataggcggcgcgctgggtgcgtttgtcgaacgcccggatgctgagtctccgctcgtcgccgtcgagcagataccggtagacgccgctcttgcgggtcacgtcctcgtcggccatcagctcttggacgcgggcctcaagcgcgttcgggtccaggtcggtacggtcccggttcgcatcgtacatgggaccccatggcaggcccttcatctcccgccggtagacggggaacacggcctgcgcccagtcgagcacgctgcggaagtagctccacagcgcctgcgcggtcgggtcgtgctggtgtgtgcccatgtagtcctcgacgctcgcgccgtgccgtgcggccgcccagccgagcacggtggccagatagtcctgccggatggccgagcccttcagccagtcgccgcccacctggaccgcggggccgcccggcttgctgaagcgggcgcgggcgtccgcgacccatgggcccgcgtatacggcgttcagcagctcctggtcgttcagctggacgccggcgatgttgacgatgcggaaccagtcgagcttctccgactcggtgccggagcatacgtacacggtcagcgggtagccgaggatacgctccttgacgtcgcggggcaggttgaagaagaaccgcccgtcgaggctgtactgtccggccacgtatgagcagacgctgatggtgcgctgctggccgtccatgacctcgtagcgtggccgcgcgtcgggtccccggtccacccagtacatgacgttcagcgggagccccttgagtatggtgcgcaccacctcgtcgcgccggtcgtcccggtagacgaactcgcgctggtagggcgggcgcacgtccaggtcgccgccgtaggcggtcacgcccccgaccgcattgtccgtgtagccttggctcaggtcgcgcaccgcgacggtgatgggttcgacgttcaattggatgcctccttgcggcggatgaggattcgcctgtatgtctcctggccgtgtatgcgcccgttcatcagaccgggcgcacggcgggtcatgttcggatagtcgcggtctatcggctcggtctgcggcgtatggtgatgcgggcgtacttcgatttgccgttgaccatcgtgtccttcggattgttgaacagcccggctatcgccgtcgccggacgagtatgcgaaagtacggttgtactctctctctctttctcgggtgaagaccaggtcgcgtccgtcatcgcccttgcggaacgcgacgatgtcgaattggtccgggttgtacttgtccatgaacgtgatgggcacgcccatcacgccgtagtaatcctcggggatgtcggccaccttcgacacctcgatggcgtcgtggttgtcgtacttcgggtagtcggtctcatggcccttgtaccggcgatagagcagcaggtcctcgtggcgctttttgatgtccaggttggtgtaccaacggcacaggccgttgacttgtttggtggtcccctcgccggggatggtgaagtcggacggcgaggtgaagcccaaccagaccttgtcatcgcgtaggagcggaaagatctccttgtaggtaatggcgttcttgttgcccagtaccacgaatttcttgccatgttccacgagcgtcgccacatactcgcggaacaggctgaacggcggattggtcacgacgatgtcggcctcgtcgagcagttcgaggcattcacggctgcggaagtccccggctccgtattcgccgtccccgtggagctcggccacctcgttgcccggggcgttcaacagcactttgacgtcctccatgtcgaagccgccgtcaccggtcgtatcctccacgtgggtgacgatggccttgtaggcgtgacgcgacggcgcgtccggttcgtcgccgaacagcgacggctggtactcggccccggcgataggcgagccgcagtagctcgtcgccatcagcttcttcagtcccagatggttgaagttcagggcgaagtacctgaagaagttcgactcgtaggggtcgtcgcagttgcaaagcacggtcctgcctttgaaatgctccgagtaatgccttagctcgttctcgatgtccggcattcgtgtgtagaactcgtcgttcttggccttcttggcggctgatagttggttgttgcccataccgggcgctatgcgtcgcggcgaaaggaaaggtgccgccgaagcctttggcggcacggcccgtcctgggcggatacgccgacgggccgccgccaataagccggaagtcccgcaccgtttgccgaacatgacaggaggccgcctcatgggataatcccgtggggcggcctccttacgactattcgacgcgttccaccttatcgtcgaacagatggaacccatggcgtgcggcggcgacgccctgcggtgtcctgtcggccaaacggcgtaggtcgctgtcgtcgtacgctttgatggtcagcgtgcaatggtagcctccctcgcccttggtcaggtccaggtcggggtcggcgagaagcccctcgcggtcgggcttgcttccttggggatagcacagtttgaaacggacggtccaatcggcgggctcgccgatctcatactcgtccgactttgcgccgggaatcctcgcggtgatgtccgcagcctgacggttcgcccgttcgatgcggtccgccttgccctgatgacggtcgagccaaagattcaccgcatgggacacgtccgccccttcggatcgggtgcagtcgcagtcgacgtggacgcgaagcgcatcctcatccccgtcatatccggccgtgacgatcacagccttgtggcagatgggacattcgcgccctgcatataggtcgcggaaccgctcgaacgattcgacgcaacgattccacctccaggcgcgcccgtacaacaattcctcatcgtatccatgcaggccggaacatgcggtcccgccccgtatagcaggcagcagccggaacaggatccggtattcgtggaacggagacgaccatgacggcagacaggaacaacaggagccacaggccgaagggcctgccccagggggtggcgggcacgttcgacacgacggccgtgacggcggggatcgacgacgtcgtcccgccgtcggccggcggacgtcggctggacgatgcgatgctcacagccgaaacatacatcatcatggatccggatgtagccgactgcgcgggatacgccgccagacgattgggtgagctcatcgcccgtccggcgaaaccgggcgaaaccgatgacatgccgttgatcattgaaaacctgcgatacgatccgcaggccccgggcggctcccatgccgactatatcgccgaccatatagaggccgcctatgacggcataccggtcaaagcgcctgaccgtacgcaattggaacaggaaacccgacagcatatcctcgagaccgcgttggatccgaaccgggagctccgcaagctcggattggagcccgtacggccagacgaacacacgaacgcatacgcgggaccgcagccggaggattgggtaagcgactacgacgaggagaccgccgaacgccgccacgaagccgcatggaaaggcacccggaccaaacaggcccgatatgccgcggcgacggagaaacacctgtcaccgttgaacgatgacatgcgcgacctgtacaagacgaacgtcgaccgtggactgatcaacggcagcgcgttcgatgacaggatggcgttcgccgacacgctgcacgaattgcaggaggatggctggaacccgcaggcggggcgcgaataccggaaatccaaggagttcaggaaactggagaaacaactgctggacgggcggaaaccgacccgacgataccggcagctgcgcgacgcgttgtgcgacgacgaacacgggtaccgggcgttcatggccgcggatcctgacgtgttcgacccggacgagagaatcgtgaagccgttcgccggactcggccccgacgtcggccaggccgccatgctgcgcctggccgccaaacaccggggcgtcaccggggcgctcgccctggcacgctgggatccgggcatcgaatacgtgacggcggacgcgaagacccacacgttccgcatggagcatgaccggccgggaatcgggtattacagcgacggctccacctatccgatcgggcacacggtcatcacggcgaacgggatcaaacccgcgagcgtgatgagctggatacacaacgagaagccgggcacgccggaatgggaggcgcggacccgcacccggttcgaggagtcgaacggcggcgaatggaagcccgccgaaaccgacgtaatctaatggggacgcatgcggaatgccgtaggattggaatcgaaggaggacgtgatggaagaagaatccgttcggctcgctatccggctcaaagatgattcggtgtggaagatttccaatctttccggcaccgtcataccctacaaggcagccgccggcatcgtccaccacggaaagggtcttgcaggccgtcccgtcgaggagacggtgttgttgtaccgtctgtcgaacgcattggagacgaccatcgccaatgcagatcatccacttgatgaagacctgttcgattgcttcaaggagcagttgggggcttcgaaggacattcccctgccggatcacaccaatccgacggaggaaaacgccacggacatgtttatggagctttggaatcaggataggatcctcgccgccgtgtgcgcgaaccatcttctcgtcgaaggcggcatcggcctgttcggaacctaccccgaccagcttccggcattggaatccgccataggggattccaaggaagccgccatctcctatattcacgacaatgcggtagagcttcttcccggaggcctcacccggaacaggatgccacaatgaccatggatgcgaacaaccggagtcatcgtcccgccggactgccacaaggcgtggccggcacgttcgatacgaccgtatccggagtggatgatgccgatgtcgcccctcccatgggggcgggaaccgtttccaatgcggaggcatgcgtcaatctggcgaaacgccgcaccatcgacctgctgtggaagaccgcgagcatcgaggtcaggggtctcacgttccccgatacgcgcgacgtgttcaagggcatcacgcccggggatgcgagggccagggatgtgatggtgctgaacaatctgaagcacgcctggcagttccttttcgacaacacggattggccggtcgactggcagtatctttccgaatacaaccggcttgtaggtgacgggctggagccctccccggcaggctgaggaacgacatggtcaccatcggaggcaccagatatgttccccctgttccctcgtatgatggggtcagggatcaaatcggaaaggatctcgggcttgacgatccggaggatagggcgttgaacctgttcgcatccatcagccggggccaatggttcagcaacggcaacaagcggacttcggcgatggccgccaaccattgcctcatccatgacggggtcggcatattcgcattgcctccggaacggatggatgacgagttcagggacaggctcatcggcttttacgaaagcgatgatcgcggaccgttcatcgactggctgaaataccatgcggtcggacgtctggtggacaatgggctgacttcggcgcagaaaaacggggatgatccgatccacgacgatatgtgatattcgacaatgacggggacgcatgcgggatgccataaaggatttctccgcatgcaaggagcccgtcatggccgaaagaatcaccacactgttacaggatcgtctcccggtggattcggaccgtcgtctgaaggtgccggccatccggccggaggacgacatggtcgccgtccgccgccgtctgggccgctacctgtacgattcattggagaaggacacggaccgcaaggcggtggccaaggccaccgcgaacgcgatctggccgggctgcacgcccatcgaccgcgacacggacgcggaggtcgcgcgcgacctgaggcgcacggaatcaaagaccggcagccccgcgatcgcattgcggcatccggcggggcggattctcatcatcgggctcggcccgcacaaacccatgctggcgagaatcgactacaggtaccgtctctcgaagcgcaccgtggacacggtgagcctgccgagcctgctggccgcccgcatgatcatggagcatatggcgaacccggatccggaggggccgatccgcgacctgctgaccgacgaccggcacacatggcagtatttccgtacgaacatggatcgccggttcgaaggcgtggacgggctcgtcgtctcctgcaacacccgcggcgtgagcctccccgacccgcccgaggcgggcgatgcgaaggcgttgctggcatggacggtcggggcgggactgatcggattggactgcgatgacgaacgcgcgaaaaggctgctggcggaacgcctcgaatgggtgcggtggacggcggagctgcggcttgcggccgagaccatcctgcgcgtcgaatcggattggcgcatgaaccgggatctcgcccgccgcacggaggccggagtatcggcgaccgtgttcgaggacaagaaacaccgtgatccgaagcacgacaaggccgggcaggccagcccgttcgccatggacttcgaccggatcgaggtcgaggacgacgtggacctcgccctgttcgcccgactgggagccgaatgggaggcgttgaagcccgccgtccccatgtccgggacgcgcgccgcattgcgcttccgctacacgggacgccaccgggcggacggcgtctaccacaccggtttgcgcgcgatcgcgatagacccgcgccaccccgaatcgttcggccacgagctcatgcatcacctcgaccacacgtggggcggaaccgacctgagcctcgacccgctgttccgccccctgctcgaccactatcgtgagaccgtggacacggcgcgcatgaagggcgcgaacccggaccggtggctcgcccccgcggaggcgttcgcaagggcgggcgagatttggctgcacatgcgactcgacggcgccgaaaacagtctgctctccgacggcgggcattacgaaacggattgggcgtacgccccctaccggggccggtggaatgagatcgggaccgtgttcgaccggctgttcgcctagaacacggcgtcgcgtatccgccatacgccgcccgtcgcatacgcgacatcccgggtgacgcacgtgacgccggccggcaccggaccgcaacggtcggccggccggcgttccgcatggcccggaccgtgaccgcgcaaaaaacgtcggacggcgcgcactccaggatttcacgccctcccgtaagcgtccgggcccggcatagccggcacgcatgatcagattcgaatacgaataccccgtccgcgtgaagacccaggcaggcgacagcgtcgaattcgacccggcgaacaacggcggccaccgggcgctcctcgaccggcagatagcgaaatggcaggccgggtatccggaggccaaggccgcccgcctcgaattcatcgaccgggaccggcatgtcgccgtcctcgtcgaccggcagtcgtccagcgtcgacatgcgcgacgattccagcctcgaagtcaatctgagcgccgaacattcgaaacccagcaagggcgccgaggtgcaggccgtatacgagacgaaataccccggataccggctcaccgtgttccacccgtacgaaggcaaggcgctcctcgaacggctcacggacgcgcaggccacggcccgcgcccagatcgccaccgaactcggcctgcacgactgggatctcagggtcacgcctttggaggacggcggatggaaggtcctcctcgacgagggcatcacctaccagccgtccaaaatggacacgcgcatggagaaggcctgcctgaccgtcggccggctcggctggtggtttgacgccgaccccgacaccggcgtcatcgagatccatcccggcgagccgcccaccttccccaaactcgtccccttcccgttcgaccggatcggcgacccgaccgtccgcgacaagaccccgttcggcatccgactggcccgccccggcgagaccggcgaacccgcgttcgtcgactggacccaatccctcggcctccttatagccggattgtcaggtggcggcaaggctcttcccttggatgcgcgtatccccgtgcccgtctccgaacgcttccccgccggctgggctaggaaccgggacctcaaagaaggcgatccggtgtacgggcgcgacgggcggatcatccccatcaaggacttcagcgacgtggaggagctgcccatctaccgtctgaccctgtccgatggccagattctggaatgcgcggacaaccatctgtggaccgtatcggattccgtcatgcgccaggccatgtccgacgaacgaggccgggagcgacgcgaacagaccatccggctcgtgaatcgtttgcgtgacgaagcggccacggtcggggatggcgtgagagccaaccgacgccatatcgccatcgaccacgggctgccccctaatgtgacccagaactgcgcggaacggcatgatctggtcgggtcggatggcctgtgcgacgaggcggaactgctgcacgccatcgccgacgaacgcgaatcctacgtcatgcccggcggcgtatgggcgaacaccgtcgaaacgatcctcactgcacgcgagatatcggagaatccgaaacctcacggcaaatgctggggtatccgccttgccaatcccatcgagaatccggacgccaacctgccgctcggcccgtatttcctcggcacctggcttggcgacggcatctcccgtgccggggccatctgtctcaacgatgacgacgaaccgcatatgcaacccgacattctctccagtctgggtggttcgatccgtcgcggaaaagttgaacacggggcgcatacctggttctatgacatggatgacgggcgcatcctcgtaaccgaactcaaaaggctcggcctgtacatggacaagcacatccccgccgtctatctgcgcgcctccaagagccagcgcctcgccctgctccaggggctcatggatacggacggttcggtttccagtcgcggatcatgcgaactgtgcttcaccaatcagcggcttgccgaaaccgcattggagctcatccgctccctgggcatcgccgccggcatgcactccggacgggcgggctatacaaaagacggcgaacgtgtggaggccggcatccggtatcggatccgtttcaccacctccaaacccgtgttccgcttgccccgcaaactggcacggctcaagaccgacacccgttccacgcaggattggctgtacatcacgtcctgcgagccgacggggcgcacggagccggtccgctgcctgaacgtggcgaccgacgaccacctgttcctcatgggcgggttcgtgcccacgcataacagcgtcaccatcaatgacgtgaccacgttgggcatcggcacgggcgcggaactgtacgtgatcgaccattccacgaaggccaccgactactactggtgccggccgtggatcgcggaccggggctggggcgcggattcgctgctccagaccgccggactgttgaaatggctgctcgacgacatcgaggacggcggcgagcgcgccagggcgtggaagagccacggctggcagaactggtacgacgacctgtcagacgaggacaagagacgatacccgtaccggctgatcgtcgtggacgagctgtcccagctgacggtcggcgcgaaggatgcgaccagcctgccgaagaacccgctgccgccggtcatggagaagatgttcgaacagcaggtgaaggcgctcatcctgtccaccctgatccgcatccttcagatcggccgagcctatggctaccgggtggtggtcgccacccagatcgcgtcgtcgacgacgggcatgccgcccgcgttgcgcggcaacctgggcaacaaggtcatcatgggcgcgaaggtcaacgacgcgcagaagaacctgatcttcaacatcgcgaaggacgtgcccgacattccggcgaacgtgatcgacgagggcgtgtccaagggcgcgggcctgagcgagatggaggggcagccgccctacgatttcaagagctcgttccccatgcttgggcatcatgcgggcgtggcggcgctcggcaaggctttggccgaacggatcggcctgcccgacgggatcggcatggacgaatacctcgactccctggacaaggacacgccttcgaacccggagttcgaacaacgggtcatggaacgcatccggttccccgaggcggaatcatatctgcgtttcccgttcctgcaggccatcaaggacaagtgggatgaaagcctcgacgagtacgggggcggcccggccgatgccggatccgggggaacggggatgacggcaccgcacccgccggccgaccggtcgcaccggccgcctccggcccggaaccgtccggcccgctcatggacgcggccgaactggcgcgcatcatgcgccggggctgatccggatcccggtctccgggcccatcctgttccaatcggccagccaaacgacgatccgatcatcatcatgcatgtaccaggccggccgttcagaagcgcaaaccgaccgtatcgcactgatacgggactcccatgcctcaggcatgggaggacgtcaacgtatcggcttccgatgctagcgcatgcgccttgtccccggccggtggtcatccatgcgccggataagcgtcccgtggcgtcccgtcgtcggcgatgctcgcccaatggtatccgtaggcgacgtgatccgggtcgcccgccacatgcccgatgttggtggccgacccggcgggcagtcccaatgcgactgcggcggcgcgcaacgacgggtatatggttcccgtctccacgcagcggatggcgtgccggttgcctttcggcgcggatcccgccctcagccgggccaggagcgccggatcagccgaggccagccgggccagccattccgggctcgcccaatggaagccgccggcgcggcgatccggattgtctcgcacatggttgatcaggtcgcgcatgccgggcgtgttccttgtccggcccgtcagggccagggtttcggcggcgcgcatcgcgtccccgtattcgacgcccgtctccacgcatacgaccgggccgcgcagcatggtctcgcgcatcgtcctgcgccaggcggcgagcaggccgggatgccggcggcgtatccgcccgtacgtgacgccgtcgacccagtggacgcccccgttccgcctgtccagccggttgcgcttctgcaaccgggatacgggcatgccatgcgcttcggcggccagcgtcatcgtgtcgtacgcctcccccgtttcggcgcacacccacagtcccctgagccgctccccctccacaagcccccgcagccggcggcggccttgttcgcccagcgcatcccagcgtccggcggaaatccagtgcgcgccgccggcgctgcgacgccatggctgcgcgcttctggccgccacgctgatcctgcccacggccgccccggtctcatcatgggcggccttcagcgtgtcgaaccgtctgccgtcctcgatgcgcaccacgccggacaaccgtcgcggctcgaactcgaatcccgcggcctccagacgacgggtctgccccgcgtcgagccggccatgccgccacgcgtcgcggatccgcgccgcatacgcctggtatcgtctggcttcaacgcttgtcgccacggcgttcccccaatcgtcggatcacgtattcgatcttcccgtccatgctcatgcccagcatgtcctccagacgggaggcgaggatgcggatgtcggccgtctcgtccacgatccgcatgcccgccagcgggtttccggcatccatatccgcgccgccggccgcatccgcggggttccatgggcgagcagccatcccagccccgaataattgtccgatatgtcgaacacgaggggcgtccggttgcccgtcgcgtccaggacgcgccccaactgctggaggtacacgtgcgggcttgtggtggcgcgcagcatgacgatcgcgtccacgccgtccagatgcacgccctcgttgagcatgtccacgcagtacaggatcttccgccccggcgccgaatccgcctcgaacgcgcggatcgcgccgtcgggccgcccgtaccggctgtggatcgcgtaatccctcgcatccgggccgaaccattcgcgggcatgggcgcgcgccccctccagccgggtcaggtcggtgcagaacacgatgacgtgcgcgtccggcggcaggcggcgggcgaacatggcgtcgacgcctgccatgcccgtcacggcgcggcgcagccgttcgaacaggcggcgcgcgtccggcgtcccgcaccgttccacgcggggcggacgcgtccgatgagcgcatccccctcgtatccggcgatgacgtattcggggacgggcagtatccgtcgcgcccatgcctcgctcaatgtcatgcgggaggcgacccgcccgtcgaacagctcgtcggtcatgtccctggccccgtccccgtaccgtctgggcgtggccgacagtccgacgatcctcgccccggggttcgcgtccaggagacggcgcacccccgcgccccaatggcgggccccgcaatgatggtattcgtcgaggatgatcaggtccgcatgcggcatggggttcccgcggcgcgtgccgatcatcagcttcgcgtaggtgaggaccgtcacccggtcggcccggaagcccgggatgtcccgttccaggcatggcagccggccgtcggtgatggtccttgacggagtgcaccagatgacgtcccatgacgggcgggcggcgatgagcgcggcggcgacgtaggatttgccggtcccggtcggctggatgacggccgccctgtccgtcatgtcgagcatggcctccagtccgcgcaatgcggtccgattatgcgggagcagtccgttcatgccgtcgggtatgcgttcccctcgcgtttctcgaacgtttcgagcatggcgggcacgccttccatggggaacgtggccgtcgtgccgaggatgacgcccttcaacaggttcgcggccacatgctccgcctcccggacggctttcgtgttcgaggcgggacgccggtgcgcggccgcgtactcgcgcatgacgggcagttggcgcgccagctcgtcgtcatgcatgccgtgcgcgcggatgcgccgcaattccgcgaggtcgtcgtccggcaggcggcacggccatggggcggacgggtccgcgcagacgaggccggcggcgagcatgagccgcatcgattccgcctgcattttccgccgccgccgggcgtccatgtcccgttccagcagatgcaggttcgaggcgacgttgcccaacgccatgtccacggtccgccgtgtcgccagaccggccgccaggggcttcagaccgtccggcagccccgcgtcgaggagcaggcacccgtccggcagggacagggcctcgagcatgttcggggatcccttggcgacgcctttcaggaacgcgacgggcgtcatgatggtgatgtcgggatcgtgcagcccgatcgtcgcgtccgcgcgatccaggaggatgtcctccggatccggcgcgatgacgatcctcaggtcgatgtcgctgtccggacgggcgagcccgtgcgcgtggctgccgcccacccatgcggcgagcacgcgacgggccatgtggggtgcgagcgcctgttcgaaacggttcatcgttcgattcccaacgattcgaggtagtcgtcgccgagccgggcggcctgccggccttcgcggctgtggttgatgcggtcggccacgtcgcacgcctcgcggacgagaccggcgaacaggcgggcgtcgccggcgtcgcgggcgccgatgccggtccatgcgatgcgggccttgccgtattccatgcggatggtcacgcaggccggttcgccgaggcgcgtggcgtccgtcccgttgtcgatccggtatgggcgttccgggtcgtcgagacggtggacggtgaagtgttctgtggagaatgcgatgcgatcgttcatggagggatgcatgcgtccccgcggacgggttccgtcgggctttacattattgtaaagccccggccccggactttacaatattgtatagttttccggcccgttttgtatgcgtgtatgcatctgtatgcatccggggatgcatacagaaaaagcccggaaaaagcccgaaaacccttatatataaagggaaaaacagaattcctttctcttgtatgcattgtatgcatcaatataaggggtttcttccctttttcccgaatcccctataagggaacgatgcatacaatgcatacacgcccccggaccatccccggaacgtcggaaacaagccgaaacgggaagagaagatgtatgcatccccggatgcatacggatgcatacacgcgccccggaatgcatacacggcccggggccggcgaccgccggccaccgttttgccgtgagggtgccccgcctttaggcgtggggaggacgtcaagcgatcctccgatccgtttcgccgggctccccgggggttcgcgatgctgtggagccgcatgcgcgggaccgtgtatgcattccggttcgcgtgtatgcatttgtatgcatccggggatgcatacagaaaaagcccggaaaaagcccgaaaacccttatatataaagggaaaaacagaattcctttctcttgtatgcattgtatgcatcaatataaggggtttccttcctttttctcgaatcctctataagggaatgatgcatacaatgcatacacgcccccggaccatccccggaacgttggaaccaagccgaaacgggaagagaagatgtatgcatccccggatgcatacggatgcatacaggccggccggaatgcatacacggcccggggccggcgaccgccggccaccgttttgccgtgagggtgccccgcctttaggcgtggggaggacgtcaagcgatcctccgatccgtttcgccgggctccccgggggttcgcgatgctgtggagccgcatgcgcgggaccgtgtatgcattccggttcgcgtgtatgcatttgtatgcatccggggatgcatacagaaaaagcccggaaaaagcccgaaaacccttatatataaagggaaaaacagaattcctttctcttgtatgcattgtatgcatcaatataaggggtttcttccctttttcccgaatcctctataagggaatgatgcatacaatgcatacacgcccccggaccatccccggaacgtcggaaacaagccgaaacggaaagaaaagatgtatgcatcccctgatgcatacggatgcatacagcccgcccggaatgcatacgcgccccggggccggcatagccgcgccgcatgaacggcttgagaccatacgcggtccggttcacggtgtccgcctccctgtggatgacgaccaccggcgacgaggtgtgttttagcaagttggcgtccgctttgtgagcggtgtttttccgcagtgtaggcagcgggttttccgcagggtgtgcggtatcggccgctgcctgtctgcgttgtgttggttatttggtcatgagggcgtgttcgcttcggtaggagcggccctcgaatctgatgagccgtccgtggtggacggtgcggtcgatgagggcggcggccatgttcttgtcgccgagcacgcgtccccatccgctgaattcgatgttggtggtgtagatgatgctccttgtctcgtaggaatcggaaatgatctggaagaggagcctgctgccctcctcgtctatgggcaggtagccgaactcgtcgatgatgagaagtcgggccttgccgatgctcgcgagttcccggtcgagccggttctcctgctgggcgcggcgcagacgcatgagcagtccggtcgcggtgaagaagcgcaccgggacgccccgctcgcaggcgagccgtccgatcgcgatggccaggtggctcttgccggtgccgacgggcccgtagagcacgaggtcctcgcatccggcgacgaagtcgaggttctcgagctgcgcgcgcccccagtcggcgggcatcttcaggttggtccagtcatagccgtcgagggtcttgtcggcggggaagccggcctgtttgagcaggcgcaggcgtttggatcgctcgcgcgagtcgagttcggccgtgaaccatcgttcgatgaagtcgagctggttgggcgtggcctcggcgagcgtgcccgcgagcacgctgcgtgtcagggtcaggctgcggctcatcttcaggatcctctcgctcttctcggtcgtggacgcgcgacggcggcgggtctccgggatcaccggatcgggtctgacgctcaccgttcttcccctccgtcgtccgtgccggtgatgaaccggtcgtagccgctcaggtcgggctcctcgatcccgccggggtattcccactcgccgtcgcgcatgcgcaacgcgataggggtgagcgagtccgcgtgcaggcccatgtccctgttcgagcgcaggatctcgccgcacgcctgcatcgcgggatcgaacccggccgcccggcacgcgtccccgatcgctttgaggctctccctcaacgtcttttcgtccatggaatcaagccacgcgcgtatatcgtcgggcacgtccgggcggatcgagctttcccgccacgcgcggggtttgaccgcgagccggggaagcacgagcgcgggatcctccacattgcgcgaccgtccgtactgtctgggatactccgcgaagagctcgccggtggcgggcgaggtgagcgtgaccgtgtcccaccggatcgcggccaataccctggaacgcgccgaatcggggccggcgaggtaccggttcgagtcgatgtcgaccagcccgtacttgtcggccgtccggctttcccagcgaaccgggtcgaacgccgtggacggcaacggcatcaacgcggccctctcctcgtcgaacacctcggccacgggcacgtccagcaacctcgggcaatacgagtccctggcgagcccgtcgcaccgctccagcaggagacggctcaactgcccatacgattccgcgcgcatgggcggcaccatgagattgcgccgcaaaaacccgaccgcgttctccacgctgcccttctcgttgcccgaatacgggttgcagaaccggacctcgagccggtaatgcgccacgaacgcggagaacaccccggtcaacgcgacctcgcccttcgcgttgcgccggccggcaccggtcgcgttgtccatcacgatcacgggaggaacacccccgatatgctcgaacacgagcatcaggccatggcacagacactccgcgttctcgcccggcaacgccacgcacaaccgcatgttcgaatacggcaacgagaccaccaggcaatgcacgtccgccatctcgccagcgatccgggcccgggccacgccgaaatcgacctgcatgctgcccgccgcccactcgagccgcacgtacccctcgcgatccggcacgccgcggttcgcctcgcgccaccggtgcacgtaacgcatcgtggtcgaatactcgccgtcgtaatccgtctccgccagcagacggtcgtgcacgcgcctgatcgtgtgccgctgcttcctgggcagcagacgatcggcctccagccactcgtccaccagatgcgcgtacgggtcgatcttcgacccgtacctgcgatccgccttcggcttgggcgagcaatcctccatatccgcgtacttcgcgaccgtcccgcgatccacgtgaagacgccgcgctatctgcgcgcgcgacattccctgccggtcgagtctcctgatatcttgcacaatgggcatcggtatcgccatgttcctttccttcccgagcgccggccggcggcaaccggccgaatcaaaaccgattggcaactcgggaatatacaggcggcggcaccgatgcctatcacatcaccgggaaacgatgacgacaccggggaaaaccatcagcccacactacggaaaaacactgccgaacctgtcgaacaaacattgaagcaaaacaacgaggacgtgatcgaacggaaacggcggcggggacgcctgcgcgcctacggacggcaggtgtggcgggaggcgaagaccgcgggcgcgccccgggtcaaccggtacatgatgctcgtcaccgtgggggacgcccggaaagccccgtgctcgccgccgagaccctgaagcccctgatcgacgcgggcacggacgaggccctgtggccggacgacgacccgtaccatcgcgtgatgacctgctatctgagggatccccgccccctgccgggcggccgggcggaactgttcatctgggtgatcccattggcccccggcgtcgacccgctggcccggctgctggcccgcgtgcccggctccaaagcgaccctggcgcgcgccacgttcggcgaggattcgtggctgaccagcaacatgcgcatgacggcccgggagcgcaaggcgatgcagacgcgtgccatgcgcgcctgccaaggcgcatggcacgcgagcccgggcgcctgctgcggcgtcgtctgccaggtccgctacccggatccgagacgcgaatacaagggcgatccggacaacgtggcggagacggcgaccgccatgtggggcgtcggcgtcatgcagggcctcctgcccgccagcccgggcgtcttctgcttcatgctcgccgacggggaatccgaaccgaagcaccatgatctcgacatgctcgcgttcaccgtgccgtccgacgcggactggccccgcctgctgctcggggacgcataggagcatggcgaaaacgcaaccgaccggagggaggccgtcatggtcatggacaggcataacaggagccacaagccgaagggcacgcccgacggcggccgatacgaggcgaaaaacggttcggccgggtcggatgacgtggccgaaccgtcgggggcggacccgtcggcccgcatcatcggctcgcacgaacccctcaccggggatgacatcgagtacattcgcaccgtctccggccccgacacgatcggcctgatggccgcccaccggcccgaggtggacgcgtgcctcgcgtcgaatccgaacctcacggaggatgacgtggacaggctcgtattccggcagaagtcgaattcggcacgcgcggacacggtgtccggcgcctgcatgcgccccgtcatgtcggacgcgttccgcgaccgctgcgtgggctggatgcgcgaccagaccccgcgtatcaggcacgcggccatcgacgcgataggctccaacccgcacgcggctcccgaactcgtcaaggaaagcctgtgggccgacccgtgcatgcggcaggccgtccgcgtggccgcgaacccggcggcggacgattcgacgctcgccctcgccgtcaacatccacccgcgcgacagcagcgtgttcgcgggcaaggtgctccgccatccgcattgcggccccgacgcgctgcacgccatcgacgagaggaccacggacccgtggatccgagaacgcgtgtggagccatccgcgcatggacatggcgacgctcgccgactggaagagccacgtgtcctacgaccggtacgaggccgcgttcggcgcggccatgagcccgaagctcgacttcgcgctcgcctcaagccttgcatccttgaacaatccggatgtggacaggcggctcgcctacaatccgaggacgccgtcggagctgctgggctcgttcgccggacgcggcgaccgtcagaccgacctgaacctggccggcaatccgagcctgccgttggcgagcctcaaggtgctgcgcgaccggtatccggacgattccgacatgcatgccatactggccggcaatccggtcctgagcggcctgcgctgaaaaggaaaggaaaaccatcatggtcatggacaggaacaacaggagccacaggccgaagggaacgcccgacggcggccggtacgagccgaagaacgccgccggcgtatcgggggatgtggccgcgccccggaacacgccggacccgcatgatctggccgcgatcttcgaccggccggacctggcccgccaaatcgacttcacgctcgcggacggcagccatgtcaacgggtacgcgatggactgcgaacgcctcccccgcgagcatgtgcccgccgggtggcatgtgtacgcgatcatggaaagcgaatccgacgacgacgatctggacatcatgaccatcagggagaacacgtgggtgaatcatcgcatggatttcgccaccgaccgggacctgaccggcgtcatcgacgatccctcgttggagaacgtggcggactgggggttcaccgaccggacgcttgccgacgatctcgcctgatgtcaacgaccgcaatgacgagcattgcggcttgtccctgtccggtagtgccaatggaaaccgcgacggccccgcattccggaagggaggcggggccgtcgcgcatgcattgcggccgtgaagacgcgccccggactatccgacctcatcccccatgatcatgtcgaagaacgcgtccggatcgtccacgacccacacgtggaagccgcgtgtttcgagtttcgcgaacatggcgctctggctggccctgggctttcctcccggccgtttcagttccacgagatacagcctgccgccgggcatgaacaggagacggtcgggcacgcccaaccgtccgggcgacacccatttcagggacagtcccccatgccgtctcgccagcatgttgaaccggcgttccaccgtgttctccctcaccgccgccatccgaaccccctccgcgcgtccggcccgtccggctcgacggggagcatgcggatcaggcgcgcccgttccgggaagccggccgcctccaggacgcgcgcatccaagtccgtgccgagcacgcgcagcgtctccgcgtccagatcggtccgggtcgcgagcacgcggcgcacgcgcgcatcccggtcatgggcgagcgtggacatcagcgccgcgtccaggccgggccgggcggccacgcgggcgcgcacgcaggccgccggatcatccgccagacgttccacgacacggtcgggcagcggcatgcccgccgcatgcgcgcgcaccaccggattcgggtcgaacgcggcccgacgcgcgtcccccgacccgtccagcagggccaggaccctgtcatgccaatcatccatgccccatcgtatgcgttgcgcggttgcgcatagacgcattccgacgcgtgcggggccggttccaggcccgcacgacgattcggaaaaggagaaccatggacaaacgaatcagcaggaccctggccgcgacgctcgccgcggccaccctggccggcgggacggccgcacccgtctgggccgaccagccgacggcgggcggggcggcgacccgcaccggacagcgcgcgcccatcgccggcctggccggcgtgacggcccggtggagggacgcgcaaggcggcaccggccccgtcacgggattcgatccggccaacgggaggggaggcgacgtgcccgccggcacgaccgcggtcacccttgacggcctgcccgacggatggacccaatccgtctccaaggacgatccgctgaccgtcaccctcgccgcgcccgatcaggcccagtcccgcacctacacgttccgcgccgtgtccgccgccgaccggttcagggaatcattgaagaaggccgaaacgatccgcgacgacagggacgcgacggacgcgtacgaccgggcgagcctcgacgcgctcggcaaggcgatcggcgacgcggggaaactggacgcggacaccgccggcgaccagatgctcgccaaggccgcggacggcctcgaccaggcggtcgcgggcctgcgcgtcgtcaactggacgttccacggccagaccctcgcctacgacgtcgcgtcgaagacgtggacgcccgccaccccgttgggccaggcgcccggcacggacgagaagatcacgggcggcagcacgtccaaccggatcgaagtgtcgaccacggcctccgcacccgacgtcaggaacacgctggccggcgtcaccgaaacggatcaggtcctgaccgcgtcccacggcggcgaatcgttccgcatccccatacgcatcgtccagggcacggagatcacgttgaaggacgggacccgtttcaccggttcggagaacggctccgaatggaccgtcaccgacaccggccaccggctcgacaaggacaacatgcccgacacggacaaggtggaactgtccgacggatcgacgctccccgtcgcctggggcaaggccacgctcgacccgtcgggcgcggccggccccgtatggaccatgagcgggaaggccacgcgcacgctcgacaacgggcagacgctcacggtgaacctgaccgccagccgcgcctgggacgcgaaactcagcatcggcgtggagcatcggaccgccgacgggaacacgaccctcatccccggcgtcgacctggaggacgcgaccgccgcggacaccccgttggacgtgaccctgcccacgctcccctacgccgcggccggcgaccagtacgcgcccgccgtgaccggcggcgacgacgcgacggtcacgttgaaacccaccgggctcggcgatgacgggatgcgcgtgttcaccggcaccgtcaaggcgaccaggacggacggcaccatcgtgacccgcaggttcacgatccgccagccgttcgacaagccgtccaggaccgtcggcgcgccggacgccgcactggacgggctgctcgtcaacggccagcccatccaagggtgggatcccgacatcctcgaatacacgatcaccgcgggcgaggacgacaaggtcacggtcagtcccagggcgaaggccgggcagacggtgaaggcgtccgacacgaccctgaccgcgcacagcaccgtccagcattggacggtgaccgggccggacggcgggaaccgtacgtacacggtcacgctcgtccgcgaccacaggacccccaccgcggacgaggcgttcaaaccctccgatccgaaggacacgggcggcacccgggaggctcccggcccggacacggccacgctgaaaagcgtcggctggacgaaggacggcacgtaccacgcggagaagggcgacgaatacctgatcccggagggcggctcgttcgcctacgaatcgtacctgggccagatcgtgaagatcacgccgggccgcgaccacggcatgacgtggaaataccggatcggggtgctcgcccccgacggcgtcacctaccggacgcgtaccgtcacggtcacctacctgacggaggcgacccacagggcgggcctgaccgggttgagtgtcgacgggcgcgacgtggacgggttctcgccggacaggctcgaatacacggtcggggtcgccaacccggaacgctacgtggtcaccccgtcgtgggacaagcagacgggcatgagcgtcaccaagcatgtggacggcgcggacacgacgctcaccgtgaccagcgccgacgggctgacgtccgtcgtctacagggtgcacgtcgaatacgatgcggggctcgccgccaccggcgcgggcgtgacgggcgtgatcatgatcgccgtcgccgccgtcctggcggccgccggcacatggttcgcgtcccggcataagccgcatgatccggacggggacacggacgcgaccatgtgatccggatacccatacgcgcgggaaggccggatgcgggggcgcgtgttctccccgcatccggccttcccgcgcgtatgttcacactgttggtcaaacagggcggtatccgttatgaggtgacaccgggtggtcagaaggtatacgatccgcatgagatcgaccggtacatggccgaacgtcaaggcaagccgatccccgaggggaagctcgtgttctatgtgcgtgacagtgaggggaacatcgttcgcatgaacacgcaggtggaacggttgacggtcgcatacggcaagccggtgaggggccggcatccttccactcccaaggactaccaggagtggcgacggcgactatccggaataaaaggaagcagacaaccaccgtcacactacgggccagcgttgccatgcagttatggcaggaaccacaactacctcatcccgaataaccctaggcggccgggtcgagggccgcggcccgcctggtggcgagcatgcccgcacggcacatgatcgacgcctgggcgggcgtcaggccgccgccgaaccgtcccatgagacggaacgcgtcctccattagaatccggtccgttccgggcagtgtttccaggcatctggcggcgcgggcgaacacttccgcatcatgctccagcatggcgtacgcgtccatcatgcgcgtcccgccctcacggctgatgctctccgccgcgcgatcccaatccattccggtcatgcccccgtatatgcgttccggccacccgcctgtcgctcagccatgccaatgcccgcgcatgcgctccggcagccgccatgaggcggcgttcggcaggccgaacacgcggccgagcctgtccatgtcatgtcccgtccacccgtccagggggacgggaatgccgggtgagggcgtccacccgtccgtcatgaaaccgccggccatgacggacgccgcgtcgcccgcatgctggcgggagcgtgccgcgcacaagccgtccaaccgttccaggatccccgtgttcccgtcgccgcggccggccgacagccacaggacatgcgtgttccggcaggccggatggtcgagcaccctgtcccaccggcggaacttcgtctccaatgactgtccggtggacgcggtcagttccacgcatacgagcaggccctcgccgatgagcgccagatcggggccgccatggcccatgatcggatcatcgcagatccggtcgaaccggcaccacgcctcccccgcggtcagccacccgtcgcgccgggcgcggatggcgagccccgtgcagatcaggttgtgccggtcgtactggcgttgcccgcgcaaagggcccggcccgatgtccgcgatctcgacgggcgtgaggcccagccggcgcagttccgggtcgatcgcgtggtggacgggcaggcggacggccatgaagcccgcgcttttcggcccccatccgccgcgcccgttcacgttgatggggaagcccaggtcgatgaggcgcatgccggcgagcatcatccacagcgtggaccgcgggtcggcgggcagccgcgggtcgagctcgtggagttggcttgtctcgcaggtcctgtgcgagcggatgagcgcgagcgccgcccccgtgacgggggcatgccgttccagccatgcgagcgccctctcccggtcggggagccatgcgggagggtcggccacgcggctgtcccaccagttgagggccgatcccgccgaccaccatgattcgtcgaaagcgtcgaacatgacggccggctatgcgggtcgtccgcgtacggcgtgtcgccttgcgccggccgggatgcggggtggtggcgaaacgcatggtatgtgtcccgggacgcatacgcgcccgcatgtcagacgataacctcgcatgcactcccgcgcaatgggagcggatcatcagccgatacgccgacccggcccggtcgaactcgccggcgggccgggtcgccgccctgctgcgcgacgacgcgcgcgcctccgacctggtgcgcgaatgggtcgaggaccaggccatgcgatgcatggcgaaggggcagacggtcacgcccacgctgctgaccatgatctgcaaacggtgcagcaaggaggcgatcctccacagggagctgggcgtgagcgtcaaactgctgcgcgccggcgccgcctatgagaaacgtctcgccgaataccgtaacgatcatgcgtccgcccacccctcccggccggtcagggaacgcctgtgggacgaggcggtggacgcgcatatccatggtcagatggagcgcggcgtgagcagcatggtgttcctgccctaccatgacgggcgcaactcgcatccgggctcgtcgaacctgctcgcatgcggcggcctgccggaatgggaggcgctgttcggatcgaagcggcgtcgtttcgccccgttggaggatgtggacgaggatcatgatccggcgctcatggaccatacgggcggcatgccgttcgaggtgaccgcggaatggctcgaacggcatgggatcacgcccgccatgctgaaccgtctgaccgacacggatctggccgtattgggcgtggacgtcaggtccgcgcgcctcgaatccgcgggcggcgtcctggacggggtggcgggccgcctcgacctcatattggacgatccgcgggcgagccaggccctggcggccggccggccgatgctgggggccgtggagatcctccactcgctgggcatggatgtgggcatgatccgggcgggcatgcggctcggccgctggtcgcgggccggggacgtgcacgatccgggcatgctgcgcgccgcatgggaccggatcccgggccgtgggggcacgtacgacgagtatctgcgcgccgtgtccgacattctcgacaaggcccacgccctcgcatagcgaggcgatgaacgttgttttcccgagggaaaggagaccggtcatgaccgttgacgcgcatgggagaagccacaggccgtccggactgccccaagggtatgcgggcacgtatgacgggggcacgggcgcgtccgggggcatggacgtgacgccgccctcctcctattacgacgggcgcatgggcgaggcggaacgcgccgaccggccgaccggcacgtgccagcgtccaccctccgaaacctcgcatgcaggacaattgcgccgtcttctgggcgacgatccggtcgagggaagcgtttcgagcgtcgccggatcgtacccgggcccgaacgcgcgcctgtacgctgacttcgtgcgtcatccgcgccgccgcacctacacgctggagggcgagaccatgacccgctcccaggcccgcgactacgcgcgcggcatgctcgtcgaatcggcgcgcaacgatgccggggcgtggggcgacgggtatgatccggacgccatggccgaacaggcaggcgactggttcgacaggacatatcccatgccgaaacgacgttgacggagatccatgacggagggaaacggtatcatgggcgaccgtgaccggattcatactgatctttgccctactgttccttctcggcatgatcgccctgccgttcatccccgtcatcgcgatcatcctccagcgtcggcataacaggaaacgcgcgcaaggaggcgtgttcgtctcgcatcggagcgaatacgcgaacatggagccttcgcccgcggacgtggcgcacgtcgccgcacgatacgggataatgcccgatgcgcgtggatggatgggatggcggtgcgtgacgcatgatgcgggcggcatgggggacaacatccgcggggtcgccgcgaccgtggatctgaacggcttggcgacatatgggcttgtgcgcggcgtgcccggctcgggtctggaagactcctcgttcaccgcggatcagataggcgcgggcatatggggggaaagcctgctggcccgcgcgatcatggccggccggccgcgagtcttgtcatggtggagcctgtacggtttcgacgaatgcctgcgcctgtcggacagtgacatcgactgcgtgctggtcgggattcgtcccgacggcaggcctgtcgcatggttcgtcgacgcgaaacggtacaagggcggttcggacacgagttacgtgaatgtggatgcgtggcatctggcgcgcgtcagccgggcgagacgcgcgttcgtgcttgactccgcgggccgcgcgtggacatcgatgagcccgaacatgtgggagcagcgggaacggtggcagggtctgctggcccgatacggcgtcgtatcgtattgggtggtgtgcgtgaccccgccgggcgggcatgggacccccgatatgaccactgccgtatggccgggtggcgtgacctgcatggacataccatcgcttcgcgcgatgatcgattccgtgtgtgttccggacatgttcgccgcgatcccgcccggactggtctccctgcttgattcgcatatcaaatattaacgcccgccgtctctccttccaatgcgtccatgaccgcctcgtgcagcatcatgcggccggtcaatacgtcgagcttgcgacggtccacggtgttcgactccaataaccggtggacgcgcaccgtccttttctgcccctgacggtgtaatcggtcgcatgcctgacggtagtcgtcgaacgaccagggcaggctggtccacacgatctcgtgtcccccgtcctggatgttcagcccgtatttcgcggcctgggggtgggcggccaggagcgggacgcggccgttgcgccattcctccagcacgccttgctcatgcacctcgcgcatgccggggaagcgtgcgcgcatgcgctccaattcgtcggtgaactggtagaacacgagcaccgggccgtccgccgctgatatgatgtccgccaacgcgtcgagcttcacgtcgtccacgtgccggatcgtcccttccggatcgtccgcgtccgggtacaggcagccgcacgtcagttgggccagcttcgcggtcaggacgcccgcgttggcgacggtgacggtcgtcccgtcatccaggtcggcgaccatctgccgacgcagccggtcgtacgtgtcccgggtcggtttcggcatgtcgagccaatggtcggtctcgatcagggacgggagtccgggcagtttgtcgcttgccttcatggagaggcagaacggttcgatgaggtcgaggatctcctgttgggcgccgtcgcggggcgtgtagtcgatgggctgccggcggccgcccatgtcgatgtaccgggtgggcgtgaaccagcgttcccggtagcgggtcatggaccgttccaacgtttcggaccggtcgatgaccgcgatttcgccccacaggtccaataggtttttggtggcgggcgtgccggtcagtccgagcgcccaacgggccttcctcgcatgacggcgcaatacgagcccccggttggagcggggcgtcttgtagccggacagttcgtccacgacgaggcccgtccacggccagtcccccaccttcccgtccagccatttgaggttgtcctgcccgatgacggtcacgtccgcgccggcgtccagcgcctgcgaccgttgccgcggcgtgccgacggcgaccgcccaggtcagggagtgcatgcccttccagcgttcgagctcgtcgggccacgagttgcgggccaccaatgcgggcgctatgacgaggaaccgggcgtgcgggtcggccgcgtgcatgatgtccatgacggcgatgctggtcagcgtcttgccgagcccgggttcgaggaacaggccgcatccgcgggacggggaggcgaacgccttcagggcgaaccggatggcctgtttctggtagtcgtgcaatggggtttccatgcacgcgcgtatgcgtcagaaccgggacgcatatgacgggttcggtggaggacgtccggaaaggggttccgtcatgtttgattccgtcgtggcctggtatggcatgctgcccgtcggggcgaggggcgcggtcacgctggccgtgggcctgctcgtcgcctggatcgcgttcagggtggcggtcaggctggtgaagggcctggtccgttcgatcgtggccgcggtgctcgcgttcctgctggcgaccgtgccgggcaatctcatcctgcatgacgcgtacgcgcagctgagggagagggcgtccatgtcggccgtcatgtgacgtatggcgtccgtccgcctccggacgcgggtcccggacgtcctttgcgggaaacgcatatccatgggtgtccatcgtgtttcccgtcgtaaggagcctgacatggccgacaagccgttcgtccccgtcgagcatcgtctcgcgctgaccgtccccgaggcggcggccctgtgcggcattccggagaaggtggtgcgcgccgcggtcgtgcacggcgatctgaggcatttcgagaaggggtccacgaccgccaggatccgcaggtcggatctggaggattgggtggccttgctgtgagtccgacacggataggcacacttaggcacacatgccgtgtatgatgttctccagatgcgcgtgattccgccattccgtggtgccggctgacttagtgtacgttatgtcagattagttatccttgacaaggattcggtcgcctgtatcaactagtccacgcataccaaggccgacagccaaaggagcaccggagcataccaggccgacagccaaaggagcaccggagcgaccaccgcaattgcaagaatcgccgtgcctttcagccaatccttgtcatctcgtttccagtggaatgctcgccaaatgaaccatatcagcatgggaatctcatacagcgacagcaatggcaaaccgatgaaaaccaggtcgaagcccgcggcgcaggctccatcgcatcccatcatgaagaagtcctcgccgttgtgtttcagtgtgtttggaaataacggtttacggcttcttcgatctgctcgggcttctcgatgatttcgtaggcaccgtgttcttccatctcaccggccggagcgtagccccagcggcagccaatggcgtccagattgcaggcgtgggcgccgtcgatgtcggtgtagcggtcgccgatcatcacggccttgtcccccgctgcagcatcaaaaccgattttgtcgaagcagtaccgaatcacctgatccttgtccaaacgagagttatccctggatgcgccatagatgccgtccaacagctcggtcagatggaaatgctcacagatcggaacgcattggtactcgggcttgcagctggccaacgccagataatagccgtcggcacgcagcttgagcagctgttcgcggataccgggaaacacgacgttcaccaagcggccgggaactttgttgccgggctcgttcggatcatcgaacacggcgcgatccgcatagtagctgcggtagatggtgaccgcccggtcaagctcatcctccggcacatggttgcgtcgcagcgattcgatgatggccggaccaatgaaacgatgcagctcggcatcgtcgggaaccgggcgacccaattcctcgaacgtcttgacgacggaggcgatgatgccgccgtcggacttggtaagcgtgccgtcgaggtccaacaggaccactttcatcggatgctgtgccattgagattccactcccctttgttcatgtcgactgctttgaatggtcgtcaaacgatatgcgacttgttccaacaatgattatgcccagtcgggatgactgggcatcaagttcacgtgttgttcagtaggagatcactcgtagtcaggaatccaaccgtcacggtgcatttgcaggcgcttttcgagtagggtggccagttcctcttcgctacggcgttccagcagcatgtcccagtgggtgcgggtgggtttgctgatctcgtcgccctcacggtcggcgtcgccctcacggtgggccacggaaccacaacggcactcccactcgtccgggatttcggcaccctcggcaaacggcaggatggtgcggtggcccttcgggcatacatacgccacatcgtttcgtgcggcgaaatcgacgttgtcgtcggactccagcgatttcgctccgatgctcatgcccctgaggctacgttctgccatatcggcatcctccttgaaagatctttaaccctactaatttacgcaacagttcggacttggccgctattccaagcttccgacgtcggctgacaaactcccatcaaacggccccccgtcagtccacgccggagtaggccaccacgccacgattgacccggtcggccgcttcgtgggcgaggcctgccagccgctctcccccgtcgaacggcagcggctgggcgacagcgatctgctgcagcacgtcagccagtcgtttggcagtgcgcacgaagtcgccgccggtcatgtcggtgccgtacaggcacgatcccagcgaaccgccatccgcccattcatacatgatgtcgagaatgccgaagtccggccgctgcatctcgtccagaccgtgatcctcgcacaggatatcgatgtcttcacagatgcccttgagcttggacgaagcgattgcgatgggcccggagatgccgcccgggtagtgcctcggttcgccgtctcccccgcgtctggcctcgtataccagtgaagagagcacagcggccagtccgttggcgtcgagcttgtcgaacgtgccggcgagcagcgcctcgcacagttccaggtcatgttcactgtagatgcggcgcagcagcgagcctttttcggtcaacgtcatgtcaatgtggccggccgcattgacatgacgttcgaggtaaccaagcccggtgagaatatcgcagatgcgatcgaactgacgggccacggacccggtacgggagtcgtagcgatcggtgacgcgctgcagttcgcgggtctcgcgggcccagcggtggccccacttgaggtgttgctggaggtccgggcagttgcggcatggatgctcgtgctccgccttgcgcaaatcgcgaatgcgctggtcaaggttctggaaggcgcgtgaacgctcctgatcggtcaggaacacttcgtgcttcagtttgcggcggccttccttttcgatgtcgctcagctccatacgcagggtcatgaactgtttgaagtcgccgtgttcgcatgcgaacgcctgttcgtatccggccagcgcgttcttcagtgtgttgatctgcgattccagctgccaggccgattcgttggcctcccactgggcaaacgactggtccagggtaacgtgcgcggtctcgtagtcgctggagttgagcaggttcacggccatgttgaacgtgggtcggaagctcgagtgcagcgggtagacacgcttggatgacagcgcggcggccgtggcgggcacaaaaccgtgatggtcaaccacgatggcgtggccgatggtgtcgatgccgcgccgaccggcacgaccggtgagctgcgtgaattcgccgggcgtcaggcccacatgaccggtaccgtcgaacttctcgagtttctctaccaccacgcagcgggccggcatattgatgcccaaggccagtgtttccgtggcgaacaccattttgaccagaccttcttcgaacaatcgttcgactatctggcggaacagggcaatcatgccggcatgatgcgaagcgaagccttcttccaacgcaaagcggaacttggagaactgcagggctttcaggtcttcctgagtgagttgcccctccaccatctcatccacgatgcggcgaatcttggtcacttcctcatcggtggtgagctccagtccagcgttgatacactgttccacggcctggtcacaaccgttgcgcgagaagatgaagtagatgccgggcaacattcccagaaagttaagctcgtccaccacggcccagcggcgcggggtgtggcgttccgctttcggggcatggcccttggcgcctttgccgccgcggcctctgccgaagcccttgcgcttatcggggcgttcctcgccgcgccggcgtgcggccttgcggtccaactggtcgagccggttgatgagttcggcgttgagcttggtggtctgctcgccgttgccgtcgcggcgatagagatccagcacctcaggctcggtgtgttcgtccgcctgcacgatgacgtgctgttccaaaggcacggggcggtgttcgctgatcaccagtttggtgtcgcctcgcaccgaggcaatccagttggagaaatcctccacgttggacacggtagcggacaggccgacgatcttgaccgtcttgggcaggtggatgatgacttcctcccacacgggcccgcggaaccggtcggccagatagtgcacttcgtcgagaatcacgtagcgcagtgcgttcagcgtggtggaacgctcgtagagcatgttgcgcagcacttcggtggtcatgaccacgatgtccgcctcggagttgatcgaggtgtcgccggtgagcaggcctaccttgtccgggccgtacacgtcgaccagatcatggtatttctgattgctcagcgctttgatcggtgtggtatagaaggctttgacgttgcgttcctgggcgagataaatggcaaaatccgccactacggttttgccggcaccggttggggccgcgaccagtacgttgctgccggcttcgagcgcgtcattggcttcggtctggaagtcgtccagttcgaagggcagggattcggcgaatcgcgctgctgcggacgcccgatggcgctggactttttggaatgatgcgtaccgctgcgaagggctcagcgtctgggaatcggcattgcccttatggtgttggtgacgtgccattgctgctttccgttagttgttgaatcgcttccagcgggcccatgcctgggtgtggcgttcgcgcttggcggccttgctgcgaatcacgtccgcatgggcctcggcataacgattctgtgccacgctgagcggctgagtgaacagaggcggctcgctggtgtcggcagaggtgccagactcccccatcgcggccacgcgttcaccgagttggccgccgatgtcggacatgtctttcaaggcacggattccatgaagggctgcatagatgagtccggcaacaatcatggccagcatgaacagggccagaatcagccatatccaccaaggcatgaaaggctccttacttgttctcgctgatgctcagttcgcgttcggcgcgtgccacgatcatggtgcgcaacgtttccggggcgaccgccgtgatatgacgcgcgtgtgcgatgcagaaggccacgaaccaggagtcggaggaaacggtcagatgcaccttttcaccggcaccgcattgttcgacggtagcgcccggcaatgtcttgatgaatgccagatcgcgctgatcggtgatgaacaccgcgtcggtaccgttgtcgaaactccacttgcgcagttcgctcaccggcatgttcgggatgttgatctgcttggtgggcttgaccagttccgccttttcgatacgggccaagcgcagcacctgccagatgcgcggcttgccgttcgccttgtcgatggtcttgtctttggagacgtaggccttcttgtccttaggggcggcggaaccgacatccgtgtagacggcggcataatacacgccttcgtcgatgaaaatcttggcgggggccaccagcttgcgacgggtactaccggtaccgtcggagtactccatgtccaacagcgaatcggtgttgatcgcgcgcttgacgatggagaagcttcggggctccagctcatagccggtcaggctcagccacggggtctggcccgggctgacatggcggcgcaaacgctcatacagggattcggcctgcccacgctgcttgtccggcagtaacggcgaatgcgccaagtagctgaccgaggcggtgagcatgctgaggtattgcggcgaaatgccggcaagacgttcaaggcccaacgaattggtggcggaaacaataccctcggcatccagcagcggccagtcgatatcgaagaactggctgccagccatctcaccatcgtcggaaacggtggtcagggtgttgatgtccttatgaatgatgttaacgaatttcttgagctcgtcgtcgttcttcggtttgccgataaagcgctcggccagctcgctcatcgagaattcctcacccaggtgagcggagaggaacagcatcagacgcaggcgacgatccacctcgctgcccgtttggaaagcggggccgttcttcttgttctgggccttgatcgactcgggatcacccggctcacgaacatcgcgactaatcgacggggaaaccaccgaggcgcttacagggctggcggattcgtcagccagagtgaatcggctggcggcgtgcaggcggcgatgataggcgtccacagcctcctgcgggctgacaatcgtggcacccggatgctccagcacaaacatggccaaatcgtcggaatcggtgtaggccacgttcaggtgttcgccgtccacatcaacggtggcggcaaagcgacgcgaatcgataaccttgaccagcgagtccggaatgggctgcgtgcccaagccaggcgcaatcgaatccaaaccgagaccgggaataggggtctgcggcacacgcggcgtggtgcgcgacgcatgttgggcgagctgggactgatccggctcggaggaaatcgacatcgaacgagccagatagttggcggcggcaagcaccggcatatcttccggctcgaacatcagacggatgcgcggttcgtcgcccaactgcagacggtaggacgcgaagtcctggccttccgacttggacgaatactcaggctgccgtgattcgatggcgatgcccatagcggcgagcttggcgcgatcacgctggaactgcttggcgaacgcggccttggcggcctgatctgccagctctccatacgagtcggcgtaagccttgacgcgctgcgcaatttggcgggatgtgagccattgcgggaacgcggatgacaacacagccagtacgtccagctcgtgcttgccccatttgtcggaaaaacgccgacgtccgcttgtgccctctgccattagtcctcacgtatagttattgtttcgttataagtgcgtatgagtttcctcacactcactctatcttagaggctttttccgcacttgagcgccatttcacaaaaataatatcttttttatcgttcgaccgtgttgtaaatcacacccaatcgtccggttcgatgccttgcggaccaacgtattcgccgttcggcacatagcttggctcgcctttatcttcaagtttggcgtcggcgaacatcatgacgtcacgtccgaatgtccagtcgccctgaatggaaaccgagttggctgcggccaaagatggcacggcgtaggggaaccgttcgtcgaaatcgcggatgttcttgtagtatcgcggatcaagttcgacgttcgggaagatgtaattgccgtcttccatctcatacgtgtccgtcaggtggaagcgatcggaacgcataatgaacaaatcattggtggttttcaccggaaggaagcgcatacgatccacttggacgcagatggaaccgttgaacagaccgattgcggcacccatggcggtttccagctgaatcacctgttcggagttcgggtccgtgggattcacggtctttttgttacgaatcaccggcaacggcaacacaccatcgcattcggcgagcttgtctttcaaagcgtcgatgcgaatccagatcgagttggtgttgaagtaaggatgcttggcgatgtcttgggccgcttccttatcatccggatggacctggctcatttcacgcaggatcaggcgaccagtggccttgtctcgcacgatatggcctcccttgcgatcggccttggtgcggatggccacttcagccataaacggggcacctgtgttttcgaagtgctgggccaacgtacgcgaggggcgtgcaccgagattgtcggaattggagatgaacaggtacttgaagccgcgctcctccaatacgtcaagcaggccggactcccagatggtggagaacaggtcgccgtggccgggcgggcaccattccagctccgggttcatggggtagctcaccggttcgccggtggcggccacgagtttgggttcctgatgctggatgatttccatcggcacgtcatgctggctgaacttgcgatgatgcttgagcgccttcatcgtgtccgccgaagtgtggaaggagttcatgaacgtcagcggcagttcgacgttcaggcgggtgcgagcggtaagcacctgaccgatgatgatgtcgatgaagcgcatctgcttggccttgtgcctacgcaccggcaacagcgacttggccttgtctaatcccatggaggtgcccagaccgccattgagcttgaggaatgcggtcttggcgaaggcgtccacggccttgtcgtggttgatggtctcatagacgtcgtggaagctgggcacgtggccaagcggctcgatgtcgtcctcacgaatccagctggaggcttcttcatggcgccatacgtcatacaaatggtggaactggttgatggcggtttcgctcatgccgtgctcgcgcatcttggcggccgaaagctcgaaagtctcatccacttcggggtgtttacggtttcttcggggtgtccgaggtgacggcgtcggtgtcgtcagcggcggcgatatccagttgggccttatcgtttatttcggtcaattcgggtccctttcgtcaaatcaataggaaccagtctagcccctgtttggggcaaacgcatacgacgggggtgcggaggcggtgaattgtcggtgataattcattacgaatggcttacaaaggtaagtccgtcgtcatgttgtctcatattgtctgaaaacggaaaaaccccggaagacaaccactcaaaagtggcagaattccggggctaatcggtcgggccggcgggatttgaacccgcgaccccttgacccccagtcaagtgcgctaccaaactgcgctacggcccgatggtgcaaaagcaccgagtagataatttaccagatatttgaaatctggcaaattacgcgcgtgtcacttccgcttcttcttctcgcggatgttcacggagatctgaatcggcgtgccttcgaagccgaattcctcgcgcagggaacgctcgatgtagcggcggtagccgtgctcgaggaagccggtggcgaagatcacgaaacgcggcgggcgcgtggatgcctgcgtggcgaagaggattcgcggctgcttgccaccacgcaacgggtgcgggtgggcggcctgaattttgccgaggaaggcgttgagcttgcctgtaggaatacgctgatcccaggattccaaggccttatccatggctcgcgtcagacggttggtgtgccagccggtcttggcggacagattcacacgctcggcccacatcacacggtcgaattcggtgttccacaggcgttcgagacgctgcttgtcgaactcgtccatcgcatcccacttattgaacacgagcacgatcgcacggcccgcatccacggctgtggacatgaccttcaaatcctgatcggataccggctgcgaagcatcaaacaggatcagcgccaattcacagcgctcgatggcggcctgcgtgcgcagagaggaataatattccgcgcctgtgagcttgtgctggcgtcgcttgatgccggccgtgtcgatgaacagccagtcctcgccatcgatgttgacgatttcgtcgacggggtcgcgcgtagtgccggccaaatcgttgaccacggcacgttcttcgcgcgccagctgattgagcagagacgacttgcccacgttcgggcggcccaccagagccacgcggcgcaggccggaaggcgtgaggtagccggaagtcttctcggcctgcttgagcttgtcgagcgcgacgtccagcaggtcgcccactcccctgccgtgcatggcggaaatcgagtatggttcgccgaggccgagcttccagaattcggcggcaagatattcgctggcctggtcgtcgatcttgttgacggccagcacgaccggcttgccggcggcacgcagcatcttgacgatgcgctcatcggtggtggtcatgcccacttgaccatcgacaacgaataccacagcatcggccaaggtcacggcaacctgtgcctgtgaggcgatggcggattcaatgccttccacgtcggcttcccagccgcccgtgtccaccagcttgaagtcagtgccggcccattccgcgtcatagctcacacggtctcgcgtaacgcccggcgtgtcttccacaacggcggcacggcggccgaggatacggttgaccagggatgatttgcccacgttcggacggcctacaacagccagcacacccaccggcttggggccggccttgcgcgcgccttccgtgaaaccgcggccggaaatcagatcctcatcgccttcgtccagctcatagccttcgagattggcggcatactgctcgtactcctggttctcgatggcgtcctcgaccagaccgatgagcagatcgagcgtgtgggcgaagtccaaatcggaattgtcgatggtagtaacgccatcggcggcggtcaggaagctggtgaccttggaatcggccttgtcgcgcgcagccacatcctcagcacccacgcccttgacggcttggccggtgcgacgggcctgacggacctcctcacgggcggtcagcagcacgcgcacctcggcgtccggggacaccacggtggtgatatcgcggccctcggccacgatgcccaaacccccggagaaggagtcggccgacgcttcgcgggcgatgtaggcgcgctgggcggcgatgagcacgttgcgcaccgggatgacgttcgacaccttggagacatggctggagacttcggaggaacgaatggcctcggagatgtcctcgtcgtcggcgaatacgcgggggttgtccgggtccacggagatatcgaaatggtcgccggtgaagaactcgcccaccgcttcggtgatgacacgctcatccacggtttcggcgtccagatcgatgtcctgcttcagacaccaccaagcgcaggcacgatacatcgcgcccgtgtcaaggtaagcgtatccgaaatacttggccagcgccttggacgtggacgacttgcccacgccggcggggccgtcgatggcaacgcgaatcacagaccaacctccttggacagcgaacggacttccgtctgggacagcacgcggtaggaaccgggcttcaaatcaccgagcttgatcgggccgatctgggtgcgcaccaagcgcttgaccgggaagccgattgagccgaagatacgtcgcacgatgcggttcttgccggagtgcagcacgaccttgaccatcgtgtggtcacgcgaggagtcgatgatcgcgcagtggtcgagcttgatccagccgtcgtcgagctgcacgccggtggtcacgagtcgacggcacacggtgccggagatcttgccttccagcgtagcgacgtaggtcttctcgacctcgtacttggggtgcatgacgtgctgcgagagctcgccgtcgttcgtcatgaggataagaccctcggaatcgtagtcgagacggcccatgtggaagatgcgctcgtacttgtcgcccacgatgtcgcgcagcgtgtagcggcccttcgggtcgtccatggcggagagcaccttgcggggcttgttcagcgccagagtgacgtggttcggattgacgcgtacgcgcgaaccgtctacgcgcacctgctgcttatgagggtcaacgcgagttccgagctcggtgaccagttcaccgtcgacctcgacacggccttcggtgatcatgtcctcgcacttgcggcgggaaccgaatcccgcttgggcaagcagcttctggagtcgaatggaattggaatcgtcttgcgctttcgcagcgcgggaatatgcgtttggcatcgttctcccaacgtggccggacagattctgtcatcgcagagactgtcgatttgtatacatacttcagagttggcggactggaatcccagtcaattccaacctatatatcataccgcaacgtaggactgctgctagactggcaaccgtttgtgcgggttcgcccgtcttccaacagatgaaaaggaatgaacaatcatggaagaaaccaagcaacagccgctggctctgcgcgtgtgcgccgaattggccggcagcttcctgctgtgctttgccatttacgccttctccacatggggttcggccgtgtatggcatcaatatcgtgttcttcgcgttggctaccggcttggcatatgccgcagtcaccgccatcttctcccgcgtgtccggtggccagctgaatccggccatcaccgtagcctccgtgctggtttccaagacgaaaatcctggatggcatcctctatgtgatcgctcaggtcatcggtgccatcgccgccggcttcgccgtggtcaagctgctgcccacatccgagcaggtagctgccaaagtgtggctgactccggccgttaacggtttcgaaaacggctccgtgtcttactcgctgctgacccagtatggcattacgttctcgattacgctggcgattgtcgtcgaggtcgttgcctctctgattgtcgttgccaccgccatgtcttctctgggtgatcacggcgagtcctcggaccgtcatgtcattgccatgggtcttgcctatggtctggccaccgccatcagctacccggttaccggtgccggtctcaatcccgcccgttccaccggcatcgcactggccgcgatgaatgagggtcttacgcaaaatccgctgcagcagctgtgggtattctggattagcccggtcttggccgccgctgtggtggcgttggtcatgatcatcgcgcagatgatgaccactcccaaagtgccggctgccgccgatcttccgcagacggatgccgatgcaaacgcggacacgctcgacgatggcgaattcttcgatcaggccgcctcgtctgatggcgattcagcggaaaaagatgttgccgaagagtccaaagaagctgaagtaggtaatcagcaggccgattcccaaggcgatgccgatgaaggagtcgaacgccactgagcgcactttccatgggcttctgtcctgaagaatcaggcgaacaagcccggtgatgatggccgtcacggcaagtatgaccgtggcggccatcgtatatccgaaagcaaccagcagtgtgatgacggcgacgacgccgagtacgcaccattcaaaccatggcttgccctcatgtgcttcggatacatagggatggttgtgcatgttgcgattccttctgtcgaacggttacgtgaccacaatagcaggcgaatagcaaaggtgggattccgcttggacccgttgacgggtcaggcggaatcccacctttgtgcgttttggctgagctgctcccctcagagagtcccgatcagtggaagaagtggcgggtgccggtgaggtacatggtcacgccggccttcttggccgcttcgatgacctcctcatcgcggatggagccgccaggctgcacgatggccttgacgcccgcgtcgataagcacctgggcaccatcggcgaacgggaagaacgcatcggatgccgcgaccgcaccggtggcgcgatcggcaccatcggccagcgtgttggcgcgctcgacggccaaatggcaggagtccacgcggttgacttggcccatgccgatgccaaccgtggcctggtcgtgggccagcaggatggcgttggacttcacgcagcggattgcacgccatgcgaacacgaggtccttcagcgtgtcagcgtcggcggcctcgccggccacgagcttccaggcgtccggatcgtcgccgacggcgttgatcagatcagtgtcctgcacaagcaggccgccatcgatctggcggatggcctcgtggcccttcggcggctcggccacctcgaggatgcgcaggttcttcttcttggtctgcagcagttcgagcgcggccggctcatagtcgggggcgacgatgacttcggtgaaaatcgggcgcacgctttcggccatctcaagggtgaccttggagttgcaggcgatcacaccgccgtaggcgctcatcgggtcgcaggcgtgagccttcttgtgggcctcggccgcggtcgcgccgatggccagaccgcacggattgttgtgcttgactacggccacggcaatggcgggagccatatcccatacggtgcgccaggcggcgtccgcgtccacgtagttgttgtagctcatcggcttgccgccgagctgctcggcgtgggcgaaaccggtctggttgagcgggtcgatgtagagggcggcctgctggtgggagttctcgccgtagcgcagggtgtgcgcacgatcccaggtgcgggtgaactgggccgggaacttggcggaatcgacttcagtgccctgatcgtccttgtccacctcgacggcgtccagagaggccggcttgggccagtgcttggcggtccactcgttgatggtggcgtcataggcggcggtgtgcgcgaaggccttggcggcaagccacttgcgctcgtccaaggagaagccggtgccgtcggccacgcgggaggcgaccagtgcataatcggccgggtcggtgacgatggccacggtggcgtggttcttggccgcgccgcgcaccatggaggggccgccgatgtcgatcttctcgatggtatcggcctcgttggcgccggagcgcacggtgtcggcgaacgggtacaggttgacgaccaccaagtcgaacggcttgatgccgaactcctcgagctgcttggcatgctcggggttggtcatatcagccagaataccggcgtgaatgtacgggtgcagcgtcttgacgcggccgtcgaggcattcggggaatccggtgacatcggacacctcggctactttgacgcccagttcggcaagcttcttggcggtcgaaccagtggaaacgacttcggtgccggccttcacgaacgcttccgcgagtacttcgatgccttccttatgaaagaccgagaccagtgctcgacgtatcggtcggttcgtgtttgtcatcctgttcctccttggattcttgtggttgtgacgctaggaaccgcgcctgatgaacggtggcggtcttcgatgtcgcggcggtggtgcgggaatccttgattctctcaaccaaccagactatcggaaaaacgagcgctgtgccaatcagcgcgagcagccatgccgcggtaagtcccagtgcggtcgaatgaccgacgactctggtggaggccatgacgtcgacgcctatgtgagcaagacgatgatcgccaagcgatccattggacagagcgaacagcaatgtggatgccagtgagatcagcatcgcgctcaggcagaatgccccggcggagtagatcagcgaaaccagtaccgggccgcgggtggacgtatcccgtacattcaacggtctgcaggcgaatccttgcggtaggaatacagccagcaggcccacgagcgcagcgatggcgagaggcgcgttcaaggcaacggtacgccatagttcgctgctgaccggttcgggcagaataccgaataccggaattgcaggaagctctttggattggccgagccataatgtgaaactggccaaatcaccgatggcgaatccgccgccgaagagccaggaaacagcccagagcatgacgttgggtagccagatcagcatggcgacggtggtgagaattcgtgaacctgtttccatcccggacaattcgaacaacgatacgacagcggcatggttgcgtaccgaccatacgatgacggtaatcaatccaattgccagatatatgctcagtatcgcgacggccaaggcgacgccgattttcaggcagtggcgtatgtccgccggcacctgcttgcgagtccagtccctgaatgctcgcattttggctgattccggtacggctgcgcataggaaaccgatcgagaatacgatggctgctttcagcaacaccagccactggtcatcgacaagacctaggtgcacggattgccggaatgcctcgttcaacccgagccaaacaatcaatccggcaacatacgcatgcggcccgtatgccttgattcgcatggtgagtgcattgatcagccatatcagcagtatggtcaacagcaatggcgtgatggtgagggtgaacgaatcggttctaaagcccgatccctcactcagaagcacaacggcctgtgtcagcgaggttgtgccgacggtgagattgtcgccgccctcttccatagagacgaccaataacatcagcgctgtatagcagcctaatgcaacggcatagatggccatggatgcgagggcgactatggctccccgcacccattggcgaatcacggctttcatcacgattggttggaaccgatcagtcgatgttggccttggcgagtacgtcacgcatgatttcggcggcctggcccggggtcttgcccacggggatgcccgccgcctcgagcgcgttcttcttgtcctgggcggtgcccttgcctccggagacgatggcgccggcgtggcccatctgcttgccttcggggcggtgaaaccggcgatgtaggcgacaaccggcttggtcatgtgctccttggcccatgcggcggcgtcctgttcggcgaagccgccgatttcgccgatcatcatgacagccttggtgtcggggtcggcttcgaatgcctgcagggcttccagcagcgtcgtgccgacgatcgggtcgccgccggcgccgagacaggcggtgaagccgatatcggacaattcgcccatgagctggtaggtgagggtgccggatttggagaccagtccgagcgggccgcggccgacgatgccgtcggggatgatgcccagattgacgccggggttgccgagcgtgatgagaccagggcagttcggtccgatgatgcgcacgcccttcttgagcgccagttcgacgaagtatgcggaatcggccaccggaatgccttcagtgatgaccacgatgagttcgatgccggcttcgacggcttcgaccacggcggacttggcgaacttcggcggcacgaacaccacgctggccttggcgccggtggcttcacgtgcttcgccgcaggtggcgaacacggggatgtccgcgtcggcaccgttcttggcaccggggaaggtgacggatgtgccggccttgcgcgggttcacgccgccgacgatattggtgccggccttgagcatgcgagccgtatgggtcatgccctgatggccggtcatgccctggacgataacgggagcgccgtcttcgatgaacagcatcagcgaacctccttggactgggtcgcctcaccggcgagctgcgcggccttggctgccgcgccttccatggtttcggacacatggatattcgggttattggcggaggcgaggatatgcaggccctcggcggcggcgttgccatcgaagcgcacaacgatcggcttggaaccgccgagcttggcgaccgcttcgaggatgccgttggcgacttccacgcaggaggtgatgccgccatagacattgatgaacacggattcgacctgagggtcggacagtacgatctccaggctttcggccatgacggctgcggaggcgccgccgccgatgtccaggaagttggcgggcttgatgttggtgccctgttcctcgccagcgccggagacggcatccagggaactcatgacgagtcctgcaccgttgccgatcacaccgacctcgccgtgcaggtgcacgtagtgcaggccgtgttcgcgggcgcgctgttcgaaggggtcgggaacgatgggatccacgaaacgcgcccagccgtcatggcggaaggaggcgttgtcatccaaggagatcttggcgtccaaggcgctcagctgcttggtggattcgtcatccgggtcgccgatcttggcgagcggattgatttccacgagcgtggcgtcgttgtctttgaagcagcgccacatcttgagcagaatctgtgcggcctgatcgacgtccgcgtggtagaagccgatgctctgtgccatttcggtggcagcggccaggtcgaagtcaccgagcgcatcgatgtgcaggcgcttgacggcctccggatgttccttggcgatttcctcgacttcggtgccgccgttagcggtggccagcacgtcgaagtcgcgcgaggtgcggtccacggagatggacacgtagtattcgtgcaggatgttcttggcttcggctacaagcacgccggaaaccttgtgcccgtggatggtcatcggcaggatggactcggattcaagaatcgcctcgtcgcggttatgggcgatcttgacgccgccggcctgaccacgatgaccgatcttgacctgcgccttgattacgcagggatagccgattttgtccgccgcttctgcgacttcatgggagttctgggcaaagatggcgtccggggtgggaatgtcctgttcctcgagcagctgacgcgcctggtattcgtaaagatccatcgatccttccctgactatgtaattggtccggcatgtaactgtacacagtacatgccggaccttgaaaactgactgtacgttgggtgagacgaaatctcaggccggcatcgcgatcagcgagctgctgggcttgccgtcgagcttatccagaccgtcgaggccatcgagccgcatcacgaaactgaagcccaccacggtgccaccggccttttcgataaggtcggtggcggctttggcggtgccgcccgtggcgatgaggtcatcgacgatgagcactcgcttccctgcctgtacggcgtcggtttcgatttcgacactggccgtgccgtattcgaggtcataggattcaccgatggtttcaggcggcaacttgccggccttacgcacggcgatgaaacccttgcccaaatgggcggccatggccgggccgaacaggaacccgcgcgattcgagaccggcaatggagtcgaattcgctcggggacaccggcagggcctcttcaagtgctttgagcagaatcttcaagcccttggggtcggcgagcactggcatgaaatcacggaagatgatgccttccttgggaaaccccggtacggaacgcaccaaggacaccagatattcggcgtcctgttgccctaccttgctcaatgcgtcgatggtgatgtccgactgtgccatagtgctcgccccttttatgcctttgcgatgcgatacgcggatggtgctaccgaatcgaacagcttacttcgtcttggtttcgttgtcgtcaccggtctcgtcagcggtgtcttcctcggacacgacggacgcctcgatcggaacctgaccagcctcatcgttagccggagcctcggtgtcttcgtcgggcagcgggttgccgttctcgtcgacctcatcatcggacacataggccgggcgggtgtactcacgggcgatggcgttgaagccgaaacgcagcttggagccttcggagtcgatgacgatctcctcatactgctcgtcgacttcgacgaccttgccgatcacctggccgatggtgatgacctcggtgccgggctgcaggttgcgacggaagtcctgcttctcctgctgttgctgcttggccttcttggactgccaccacatcatgccgccgaacacgacgacgatcacgatgagcataatgtactgttgttccacgaaacaactccttcaaacgagcgacattgacgaaacgccgccaagtgtgcaaacaggagaaagtctagaagagcttgctgacatcatctttgggcgtaattcccaaatgctgccatgccttctcggtagccacgcggcctttgggcgtgcgaatcataaaaccttcgcgcacgagatacggctcgcacacggtttccacggtttccgattcctcgcccaccatggccgccagattgttcaggcccacgggtccaccgttgaagttgcgcacgatggcattgagcacggcgatgtccagccggtcgaggccttcggagtcgatctggtacagggccagcgcctccttgacgtcgtccggccgcaccacgatcaggtcgtggacgatggcccagtcgcgtacacggcgtagcaatcggttggcgatacgcggcgtgccgcgcgaacgcaacgcaagctcatgagcggaacccgcatcaaggtttacgcccagtacgttggccgaacgttcgatgagcttttccaactcctcatgcggatagaagtcgagatgtgcggtgaagccaaagcgtgcgcgcaacgggcttggcagcataccttcgcgcgtggtggcaccgatgacggtgaatcgcggcagggtcagcgggatggagcttgcgcccgggcctttgccgaccatcacatcgacgcggaagtcctccatcgcgatatacagcagctcttcggcggcgcgcggcagacgatggatctcgtcgatgaacagcacttcgccgacgtcgagggagctcagaatcgaagcaagatcaccggcatgttgaaccgcagggccggaagtcacgcgaatcggcacttcaagctcattggcaacgatcatggccaacgtggttttgcccaagccaggagggccggcaagcagaatatggtccggtggcacatcgcgtttgcgggccgcgtccaggaacagttgcagctgggccttgagccgtggctgtccgataaagccttcgagaacatgggggcgcagctcctcgtcgctgaccggctcgttgccgatcggctgggaggagaccatgcgcaacgactcttcgttggcaccggtgttggaggctccgtaatccgttgtctcgctcatcagcggcccctatccatcagcgccaaagccagacgtagcacacgcggcacatcgtcggtggcaagcggcgtgggaatatcgttttcggcgcaagcctcggcaacggcctgttgggcgtcctgctgacgccagccaagtgaaatcagtccttcgacaacctgttccgtaccggtatccaccggagacttggatattgccgcctgagcggaagcaccctcgatctgactcaaatcaatagagcccttaagctcgaggatgattttctgtgcgcccttcttgcccagccccggagccttggccagcgcggtggcgtcgttgtcggcgatggcgtgggccagctgactcggcgtcagtgtggagagtaacgattgggccactttaggtccaatgccggagaccttgatgagttgcagaaaggttttcttggcgtcccgatccaggaatccatgcagggtaatggcatcctgagagaggttcatataggtgaagacgcgggtgtcttgcccggcgtgcagacggctcaggtcggtggcggacatgcgcacttcgtagcccactcccccaacatcaatcaatgcggtatcggtttcgaccgattcaacccgcccggtcagcatgccgatcatacaggtactccttcagggctccaggattcaagactcgaacaactgttcgaaagtatactacatgcctcggtcgtggttgatgcggcggcgcgtggatttctgtgcggcctcagcccactggcgttgcgcggcggtcagatgttgttcgcgttcgccgccctgcaatgcgcctgccgggcgcagcgcatggcaaatggccaaagccaaggcatcggcggcatcggcgggagtcggcattttggtgaggttcaaaatacgtgtcaccatacgctccacctgaatcttctgcgcctgcccgttaccggtgatagccagcttggcttcggtaggcgtatgcaacgccacgggaatattgcgttgcgcggcggcgagcatggcgaggccggcggcctgtgcggtaccgagtacggtgttgcggttggattgtgcgaacactcgttcgatggatacggcatcgggtgcgaagcgatccattttctcggacaggccgttgtagatggccagtagacgcagatcctgggtgatatccggtgaggaccgcaccacgtccacgtgaataaacgaaagccggcggtgctcgccggcttcgatcacgccgaccccgcaacgtgtgagcccggggtcgacgccaaggataatcacgaggattactcctcgtcgagctgggccatcacctcgtcggaagcggtccagttggagtagatgttctgcacatcgtcgaggtcatcgaggttgtcgatgagcttggacaccttgcgggcatcctcaaggctcaactcgacctcgttcttcggctgcatgacctggtcggcggaatcgtagtcgaagccggcttcctgcagagccttgcgcacggtgaacaggtcggacggaccggtcacaacggtgaacacttcaccgtcatcggtaacgtcctcggcaccggcttcggcggcggtttcgaacagcttgtcgaagtccacgccctcggacggcaccacgatctggcccttgcgctcgaagttgaaggacacggagccggaggtggccagagagccgttgcccttggtcagggtggaacggacttcggcggccgcacggttgcggttgtcggtcaggcattcgatgatgaggccaacgccggcaggagcgtagccctcgtagacgatgtcttcgtagttggcggcaccatcttcagcaccggcaccacgcttgacggcgcgagcgatgttgtcggccggcatggaggccttcttggccttgtagatggcatcgtacagggacgggttgccgtccgggtcgccgccgccgaggcgggcggcgatttcgatgttcttgatgagcttggcgaagagcttgccgcgcttggcgtcgatggcggccttcttgtgcttggtggtcgcccacttggaatgacctgacataatgctcctagcaattattgaaacggatgatgtcaaacgaaacgattgtaggccgttaatcagacatacccgtaatgtttccgatgattgtcttattgcgcgtaccgataaaaccggttgcgcgggtgccgcacccggtcaggcaagcggcaaatgatactgcggggccagctgttcgaatgcctgggcataggcgtctcgctggtcggacagcagaatcggcatggtacgcgtctgggcgacgatgggcatgaagttcgcatcgccattccaacgcggcaccacatgctggtgcaggtgcgcggcgactccggcacccgcgacctcgccctgattgatgccgatgttgtatccgtccggacgggagacggtctccatcaccttcatggcgagggtggtggccttctcgaattcgaacagttcggcatcgtcgagttcggtgatgaatccgacgtgacggtacgggcaaatcatgagatgcccgacattgtatgggtagaggttcatgatggcgaacacgtgcgtgccacgccaggcgatgaggccgtcttcgtcggattttttgggtccggcgcagaacgggcattccttcgtcttgggcttggttgggcgatcctcgctgttgcgcagcacataggtcatgcgctgcggagtccacagtcgttcgaccgtgtcctcctgaggcggaaagtccgccggattatcgacacgcacgtcagtcattttcgcaccctttcttggctcccctcagagaggggagccagtaccattcacatcactcagccacagcagcgttgaagtcgtcggcggagttcacctggacgcgcttcttgatgacggtgagaatctgctcgcgagcagtgtccaccggcacaccgttgagctggctaccgtcgcggaagcggaagctgaccgcgttgttgttcatgtcttcctcaccgacgatgaggatgaacggcaccttggacttggaggcgttgcgaatcttcttgccgaagcgatcgtcggagtagtcgatctcgcaacggaccatctcatcttcaagggacttgacgaagccggccagatgcggggcaaactcgtcggcaaccggcacgccgagcacctgcacgggggccagccacgccgggaaggcacctgcgtagtgctcgagcagcacggcgaagaagcgttcgatggagccgaacagggcgcggtgaatcatcaccgggcgctggtgggtgccgtccttcgcgatgtactcgagctggaagcgctccggcaggttgaagtcgagctggatggtcgagacctgccaggtgcggccgatggcgtcgcgggcctgcacggagatcttcgggccgtagaaggcggcgccgcacggatcgtcgacgagctcgaggttggattccttggcgacctcggcgagcgtgttggtggcctcctcccagatctcgtcggagccgacgtacttgttcgggtccttggtggacagctcgaggtagaagtcggtcaggccaaagtccttgagcaggttcagcacgaaggtgagcaggctggtgagctcgtccttcatctgctcgcgggtgcagtagatgtgggagtcgtcctgggtgaggccgcgcacacgggtcaggccgtggacctcgccggacttctcgtagcggtacacggtgccgaactcgaagaggcgcagcggcagctcgcggtaggagcgctggcgcgacttgaagatgaggttgtgcatcgggcagttcatcggcttgaggtagtagtcggcgcccggcttggtgatgttgccgtccacgtccttctcctcgtcgaggtgcatgggcgggtacatgccgtccttgtaccagtgcaggtggccggaggtctcgtacaggccgcccttggtgatgtgcggggtctgcacgaagctgtagtggtgcttgcggtgcatctcacgggagtagtcctccatagcgttgatcacggcggcacccttcgggtggaacacggccaggccggggccaatttcatccgggaaggagaacaggtccatctcggcgccgagcttgcggtgatcgcgcttggcggcttcttccaggcgggtctggtaggccttgaggtcttccttggtggcccatgcggtgccgtagacgcgctgcatggtcgggttcttctcggaaccacgccagtaggcggcggcggaacgctcgatcttgaaggccttgatgtagcgggtgttcggcaggtgcgggccgcggcacaggtccttccaaaccacattgccatcacggtctacgttgtcgtagaagctgagctccttttcggagatctcggtggcggcggccgggtcgaggtgtgcttccttgtcttcgatcagttcgatcttaaagggctggtcggcctcttccttcagagcctcttcctcggtcacggaacggcggcggaaggactgggaggacttgatgatgcgctgcatgcgcttctcgatgtccttgaggtcgttcggggtgaagggctggtcgacctggaagtcgtagtagaagccgtccttgatgacggggccgacgccgagcttggcgttcgggtagacttcctgcacggcctgggccatgacgtgggtggccgagtgacgcatgattgcgaggccgtcttcggagtcgagggcgatggggtcgacggtgtcgccatcgttcagcggcgtgtacaggtcacggttctcgccgttgatcttgaccgcgatgatgttcttgtcttccgcgaacagttctacgccggtggtggttgcttccacctccttcgcttcgccgttgacggttatggagatggtagcttgcgccatgatttgtcctttgctatcggggcccgcggtactaatgtgcaggcctggactggttaatcaacgtaggacacgataggttgggcgtgcgacaaataccaccagcatctgaaccaatacgaaaaaacctcgccgaagcgaggttccgttgtggagcggacaacgggactcgaacccgcggtctcaaccttggcaaggttgcgctttaccaactaagctatgtccgcaaaggaatccgccgtgagaagcggaatccagtgggcgatgtaggaatcgaacctacgaccccttcggtgtgaacgaagtgcgctagccgctgcgccaatcgcccgaatattcggttctttagttatatccagtcgaattgcttcgactttcgtgggcgatacaagattcgaacttgtgaccccttccgtgtcagggaagtgcgctaccactgcgccaaccgcccgggtcatatttcattccattgaattgcttcgctggtctgagaggtgggtacgagagtcgaactcgtctatacggctttgcaggccgctgcctaaccgcttggctaacccaccgtaaggtctgtcaactcacggacctagagcggacaacgggactcgaacccgcggtctcaaccttggcaaggttgcgctttaccaactaagctatgtccgcgtgtgtttccttggcgaggtctccctgccgaagcacgagtgtttactatacacacatgcgtgtagttcgtccagctgcggcgtgtcgcctgtaattgcatactctcgcttatggctaaagcgtgcgcttcgggcaatgaactccagttactctagaggtatgagtgaagcagcgaaggacaccggcgcagtattgatcgccgcattcgagggatggaatgatgcctgtcaggcggcgacgaacgcggtgcgccatctggtcaagcgatatgagtcccgcgagattcgtcatattagatgtgatgatttctatgactatcaggttgcccgtcctatgctgtgccatgtttcgggacgcaccaatcttatctggccgcagaccacgttctacgacatcacgttggacgcaggcaagcatatctatgcgcagatcgcccccgaaccgaactatcggtggaaggaatactgtagccagagtctggccattgccgatgagctggatgtcaatcggatcattacgttaggttcgatgttctccgattgcccgcatacccgtccgttgcccatcgccgtcagcgacggagactgtcaatgcgaaggagaccggtcgtataacggcccggtaggcattcctaccgttttggatgtggccgccgcgcagcaaggttttgctcattcctcgatgtgggtgtccatcccccaatatttgggcagcgacgaatgttctgccggcactatgcgattgctggatgcgttgggcaagcatatcggcttcaccttcgatacggcagatctgaagcagaaagccgaacagtggaaggcgcaagcctcgatactggttcgttgtaatgaccagcttcacgattacgtggagcatttggagcacgactacgacttgcagcagaaagccgaggcggaggcttccttgggagcgccccaggccgaacaactagtcaaagaagcagaagcgtttctgcgccagatgggcaattagcccatatatggtgtgctcccgctggatgaacagccctgtgggctgttcatagcagtgcaccatgtgcacgtcgcacaaaatgtcgggagctggctcgcgtagcgagactgagggtggttctgctggcatattccagtgaccacccccagtcagcttcgctgacggctcccgccagcgggagcaccattatattggagtcgtctatcgacccgtcttatgccgcagccgccacggagggatcgatggccggcagcacgcccacaatcagcagcaaggcgacgaccacagccaaaccgatgcggtagatggcgaaggccttataggagaagttcgatacgaacttcaggaatccgatgatcacgatgtagccgagtacgaagctgatgaccatggctacgagggtcggcccccagccggggaacatcgcatcggttttgtagttcttcacggccttgatggcttcgagcaaacctgagccgaacaccgcggggatggccatcaggaagctcagacgtacagcggcctcacgcgtgtagcccagtgcgcgaccgacggtgatggtgccgccggagcgggacacaccaggaatcagcgccatggactggcccaaaccgaagaggaacgcatcacgatacgtcatatcattcatggttttgttctggcgagccttggcatccaccatccacagcagaatgccgaataccaacagcacggttaccgtaatccacaggttgcgcaacgaggtctcgatgacgttctgcagagtgaagccgaggatgataatcggaatcgagccgacgataatgttccagccgagtgtggcgtaattgtcgccgcggcccatgcgggccttccaatccttgccgttcttgccgaacaggcagctgaaccagtgagtaaggatattgatgatgtcgtgacggaaatacagaatcaccgcaagttcggtgccgatttggatgatggcggtaaacgccgcaccgggatcagagcccagcatcaaatcgccgaaaatacggatatgcgcgctggaggataccgggagatactcggtcagcgcctgaacgatgccgagaatgatcgcttggaaaaaattcatgacccctcgtgatttctaagtatttgatgtgttatgacgatgaacaccctatccaaggggtgtagaacaacactaagaatcggtaacatccacggcttctacaatgaaagtggatatagtacgtaagcgacgaagggagcattatggccacgtatcgcaaaagcagggcattcgcaccggaaggattcttcgaatgcgagggtcgaggactcgaatggttgggagcggctcatgcgcagggcggcccgcgcgtggtgcaggtatacggctggggcaaggattatctggatatcgaacgtgtgggcagcgcgtcccccacgcctcaggcggcacgagcttttggtgcggctctggcccatatgcatgatgtgggtgccgaatatttcgggtctgcgcctgacggatataacggcacatgctatttcggaccattgcaggacccagtgaaaatggataccggcgagtggaccgacccgatcagctatttcgctgatggacgtctgcgcccgatggtcaaccttggtgtgaggcgtggcgagctggataagcgcgatgtcgaactgaccgagcgcgtgattgaagcgttgccggatctgatgggccgagccgcgtccgacaagccggcgcgcatccacggtgatctgtggagcggcaatgtgatgtggaccgccgattccgggcagcccgaggctgtgctcatcgacccggcggcacatggcggtcatcgcgaggaggatctggctatgctgcacctgttcggcatgagctatctgagcgaaatcaccgagggctaccagtccgtgcatccgttgaaggccggatggcaggagcgtatcacgctctggcagctctaccccatcgccggccactgtgtcttcttcggcggcggctacgtcaacgaataccgctccatgtgccgctccatgctgaagtaacagacttggctcccctctctgaggggagccaagaacgcatccactctcagctcagcgcgtccttcaacttgctgaagaagcctttcttttggccagcctgtggacgggatgcctgggagacgtgcgtggcgcctgaatcgtgcgaggcggcgaactgttcgatgaggccgcgctcggtttcgttgagcttggtgggaatcagcacattgacgtgggcgatgaggttgccgcgctcgtccttgttgcggatgttcgtgacgcccagtcccttaagcgtcacagtgtcctcaggctggcagccggccgggatggacacggtcttctcaccatcgaacgtgtcaatggacagatcgtggccgagcacggcccagctcatcggcacctgaatccagcagtgcaggtcgtcgccatcgcgggtgaactgcttatccgccttgatgcgaatgtcgatgtacaggtcgccggcagcgccgccgccctcacccacttcgccctggttggccaaacgtagacgcgcgttgtcgttgatgccggcgggcacggtgacgcccacggtacgtgtggtacgcacacggccgtggcccatgcagctggggcacgggttcttgatgatggtaccgtggccctcgcaacgttcgcagggggcggaggtcatcatctggccgagcatggtgcgcacgaccttctgcatgaatccctggccgtggcagtcggggcaggtgaccggctgtgcgccgccctgggcgccggagccgccgcactcctggcacagggagaacgtgctgatcttgacgtgcgcggtgccgccgaacacggcggtcttcaggtcgatggacgcggaggccagggcgtcgcggccgggctgggtacgcggcaccgggccctgtgagccaccaccgaacgcggaaccgaagaacgtggagaacacgtcgctcatatcgccgaagcccgccccggagaagccgccggcaccggcgttcggatcgttcgggtcgacgcccgaatcatacatacggcgcttgtccggattggacagcacatcgtaggcgttgttcacttccttgaacttgtcctcgaattcagggcccgcgatgtcggggtggtacttacggctgagcttgcggtatgccttcttgatctcgtcgtcactggcgccgcgttccacacccagcgtctcgtaataatctgccacttgattgatcctttgtgttcgtttggtctgcgggtcattgtgccacagacggcggtcagtcttgggtccggccctcggagaggaaggcggtcaaatatctggctacggccctgacggcggccatagtggccgcatagtccatgtgggtcggccctatggagccgacgaaggcgatgggttccgtgtcgttcgtctggctctccgtctcggattcggtttcgggttcgcctacgggatcgttccccgccggttcgcccgccgcaccgctgcgcccatagccactgctgaccacggaggcatgcagtaggccgggagtgtgcatttcggagccgatggccacgcccacgccggatgcattcgtctcctcactcaggttgctcatgagcttcatcagcacgacctgttcttccagcgcgtcgaagagcggggccagatcggccagggaccgggagtgggccaggtgcgaggtgccggacatgtacagttcgtccgcgcgttcgtccaatgccatcgattcgaaggcgtcggccagcgcgtcggccacgccgcgcaccgactcgtagccggcgctggcggcgatggatcgcacggtctccgcggatttcgatagggacagtccgacacattgttcgttgacggtgttggagagccggttgatctcgtccacggcgggcatggatgcgatggtcaggccgtgctgggccacgcggccggtgtcagtaatcaccaccgcgagcaacgtggtcatggcaacgggcaccatctccacgtgccgcaatgtggccttggccagcgatggcgaggtgactatggccacttgaccggtgatttcggacaacagtcgtgccgaacgctgcagcgcgtccttgagactcaccgatccggacaggaagctgttgatgccgcggcgctgcgcctcgctgagcggcaccacggtagcaagtcggtccacaaagtatcgatagcccttttcggtgggcacacgaccggccgaagtgtgcggctgaatcagatatccttcatcctccagagcggacatgtcgttacggatggtggccgaactgacgccgagatcatggtcgcgcgtcagcgaagtggagcccacgggctcctgagaacggatgtaatcctccaccacggcgcgcagcaccagcatgcgtcttgattgcgtcatgcgcgcctccttatatatgcatacatattcatatcagtcacggttcactcagggcgtaccccgacggtcggttcgccacgccgcgacacgcgggaacccagaaatattgcctctttcttggctccgccacgtgcaggtggcgcacttcaccttagaacattgtattagcactccttaggcttgagtgctaatgcgttcgtttgcagcgtagcaatgttcactgtgaacgctaacagaacacaaactaccaaaacacgccaaaattgcaccgcaacgtcgcaaaccgacgctagcatggtaatcgcaatgtgagggcgtcaagcgcccggcacaagccggatacgcggcccgaccaattggaaggaaagtaatccatgaccgaattcaaggagaccgagctcgacgagcgcgccatcaagatggcgaaggtcctttcggctgacgcggttgagaaggcaggctccggccaccccggctcccccgtctccctggcgcccgtcgcctacacgctgtaccagcacttcatcaagcacgatccgaatgatcccaactgggaaggccgcgatcgcttcatcctttccggtggccatgcctccctcacccagtacgtccagctgtacttctccggctacggcgtgaccctggacgaccttaagaacttccgtggcggcgctgccacccgcaccccgggccacccggagtacggcctgaccccgggcatcgaaatgaccaccggccctctgggccagggcttcgcctccgccatcggctttgcctacggcgagcgtttccagcgcggtctgcttgacccggagaccccgaaggaagattccccgttctaccacaagatttgggccatctgtggtgaaggcgacatcgaggagggcatctccggcgaggccgcttccctggccgccaaccagaagctcggcaacctgaccgtgatcttcgacgccaaccgcatccagatcgaaggcgacaccaacctggtgctggccgaggacgtgctcaagcgcttccaggcctacggctggtacaccgacgagttcagcttcatccagcccgacggctcctacaaggaggacatcgagggtctggccgacgtcatcgccaaggccgaagccgccgccccggaccagccgaagctcatcaaggtccactccctgatcgcctggccgaccccgggcaagaccaacgacccgtcctcccacggctccaagctgggcgccgaggccgtcgccggcctcaagaaactcctcggctacgatccggaggagtccttccacgtcgacgaagaagccctggcccacgcccgcaaggtcgccgatcgcggcctggaggcccacaaggcctgggacgagaagttcgacgcctggcgcaaggccaacccggacaaggccgccctgtacgaccgtctgaaggccggtgaactgccggaaggcttcgacaaggcccttgacgaccttgaggccaccttcgaagtcggcaagggtgtcgccactcgtggcgcctccggctccgtgctcaacgccatcgccgccgtcatgccggaactctggggcggctccgccgacctcggtggctccaacaagaccgacctcaagggcgctgccaccttcgccccggccgagtgcgccaccaagcagtggccgaactgcaacgagttcggtcgccagctgcacttcggcgtgcgcgagttcaccatgggctgcatcaccaacggcatcctgctgggttcccacacccgtccgttcggcggcaccttcttcatgttctccgactacgagcgttccgccgttcgtctggccgccctcatgcagatcccgaacctgtacatctggtcccacgactccgtcgccgtcggcgaggacggcccgacccaccagccggttgagcaccttgcttccttccgcgcgattcctcagcttgaggtcattcgcccggccgatgccttcgagaccgccgaggcttaccgttacttcttcgagaagaagaacaccctgcctggcgccatggttctgacccgtcagggtgtcccggttcttgccgagaccgctgccaaggccaaggacggtgtcaagaagggcgcttacatcctggtcgacaccgagggtactccggacgtcatcctcatggcttccggttccgaggtccagtgggctgtggctgccgccaagaccctggccggcgagggcgtcaaggctcgcgtcgtgtccgtgccgtccatggaatggttcgaggagcaggacgccgagtacaaggaggctgtgcttccggccgctgtcaaggctcgtgtctccgtcgaggccggcgttgccatgccgtggtacaagtacctcggttcctacggcaagcctgtctccatcgagcagttcggcctgcagggtgacggcgctcagaacatgatcgacctcggcatcaccgccgagcacgtggtggaagccgccaaggcctccatcgccgaagtcgaagccgccaagtgagcaactaagcaataattcaataattgttggctcccctccctgaggggagctgtcaggcgaaagcttgactgaggggagcaatgcttgagcccactcccctcagtccgcgttgcggacagctcccctctcccaggagaggggagcctagggcttgaatccaaggagaaaataaatgactgaagcaactcagcgtacgtctgacaacggcgtttccatctggctggacgacctgtcccgctcccgcatcgagtccggctccctgcaggacctcatcgccaacaagaacgtcgtcggcgttaccaccaacccgtccatcttccagaaggccctgagccaggtcggcccgtacgacgctcagctcaaggagctcggcaaggttgacgttgagaccgctgtccgcgagctcaccaccaccgacgtgcgcaacgccaccgacatcttccgcgagatcgctgaggctaccgacttcgtcgacggccgcgtctccatcgaggtcgacccgcgtctggcccacgacaccgagaacaccgccaagcaggctgtggaactctgggagaaggtcaaccgtccgaacgccatgatcaagattccggcaaccctcgaaggcctgccggccatcaccgccaccctggccaagggtatctccgtcaacgtcaccctgatcttctcgctcgagcgctacgagcaggtcatcgacgcttacatcgagggcatcgctcaggctgccgccaacggccacgacctgaagcacatcggctccgtcgcttccttcttcgtgtcccgcgtggacagcgctgtcgacaagctgctggaagccaacggctccgacgaggccaaggctctggagggcaaggccgctgtggccaacgctcgcctggcttacgaactcttcgagaagaagttcgccgaggatccgcgttgggccgacctggctgccaagggcgccaaggttcagcgtccgctgtgggcttccaccggcaccaagaacgccgcctactccgactgcaagtacgttgacgagctcgttgccaagcacatcgtcaacaccatgccggagaagaccctgaacgctctggccgaccacggcaacggcgctccgtccatcgagggcacctacgaagagtcccacgccatcatcaacaagctggctgagctcggcatcaacctcaaggacgtcaccgacaagctggaggccgacggtgtcgctgccttcatcaagtcctgggattccgtgctggctgacgtccagtccggcatcgaccgcgtgaacgcctgagatttgacgactgatgcgtgtttagcgcactagttgattagatcacagaagccccgaccccaaccggtcggggcttctttcgtttgttgctacagtggtacgagcatatgagagaaaggccgaaccgtaatgaacaaacttgtcgcacgccagcggttggtgatgaccttcaccttcttttcgatgttcttcggagcgggcaatctgatttttccgccgttcgtcggcgctcaggccggttccgcgaccataccggcggccatcggtttcatcgtctccgcagtcggcctgccgattctcggcgtgctggcggtcaccttcgccggcggtttcgacaaactcgccagccgggtctcccccaaattcgccttgttcctcggcgtggcgatcatgctcaccatcggcccgtgctttgcgattccacgtacggcgaccacctcattcgaaatgatggtggctcctttcgtaccgtcctcctatggctggctggcccaactcatctactcgctcgtgttcttcacactggcgttcctgttcgcccagcatcccgagaaactctccaaagtgctcggccgattcatggggccgttgctgctggtgctcattgctgtcctgttcatcgcctgcctgatccacggcatcggcatcccggccaacccgatgggcgactactccacaaaccagatcgcacgcggcttcctcgacggctaccagaccatggacctgctcgccgcgctctacttcggcatcgtgatctccgcgaatatccgcgcccaacaagtcgatgacgaatcgcaagtgcagaaggagaccgcgtatgccgggctcggcaccggcgtactgctgatcgtgatctacggcgcgctaagctacgtgggcgtggtgtccggagccatcgccaccatcgaccccaccaaagacacgggcgcgaccgtgctcaccaacctcacctcctccctgttcggcacgttcggtaccgcgttccttggcgtcgtgttcgtcatcgcctgcctcaacgtatgcaccggactgatcggcacctgcgccacctacttccatactcggttccggaccgtcgccggccgaacgttgagctaccgcacctggcaggtcatcttcaccgtgttcagtttcatcgtgtccaatgccgggctgagcgcgatcatcaaggtttccgtgccggtgttgtccgcactgtatccgatcgccatcgtgctggtactgctgacgctgacccacaagtcgctcggcgcgcgattcccgcgcgtctatttctggactgtgctgctggtgggcatcgcatccttcgccacctgcatctccagtttggtcgccgtcttcggcggttccatcggctggctggacgcggcgctggctatgctgcctttgcagcaataccagctcggctgggtggtcccggctatcctcggtgttgccattggtatcgccgatgctccgcgacggtagttttcccggtctgtgccggagtctggcggtcggtcggtgatggcggctgccgcagtatccctcctataaagcggcatacagaattcctgtatgccgctggtctccgcccatctgccatagttatactggcatcatcgacgacggcgataacagcataaggtggggcgagtcatggacaccagtgatagacaggtagcggaaaccggccggaatcgcgagcttgggctgattccggccatggtgatggcggttgttgcgacgctcagtggtgccggtgtatcgttcgcgccattatatgagcgcatttggggcggcatgatgttgcatccgaattgtccggcgattggcagaatgacctactatctctcgggccaagcaactgacgattatggagcctgcgtcacctcaccactgtggtttatgacggtgactgcgctgagtgttgtcgcgattctctgtctgactgttgcgggagtacagggcttttcgcgccatcggctctgttcggtgtttagtgttcttattgcggcagtggctgttgcaatcatattggtgttgagtgcgaataccaagattgtaacgttgtgggcgatgtatgcggtgacgtggctggtgcacgccatagtcacctcatatctgagcaacggttggatacgaatcgcgcgactgttgttcgtatggcagattggcgtgatgccggtattcgtcaccgaatattcagtatccgacgaggtcaacttcagcggcggcgcaaccatcgcttgcggacttggacttgcggcatatgcgctggtgcaatacgcctctcttaccatcgactcgcaaaacaacagtaatcgaatcacgccagaacgcagtggtatacgggctacctccttgcacgacctgttccacaccatcagcatcaacgcatccgccatacgcaattgctctgttcccgttgccctgttctggtcaggtatcacgttctttacctacagctacaacactggtagacacaccgatttctgcccagcgctatcggcaactgacaatgcaggtcttgtcgcttattgcatcggccatgaagctttgggactgctgaccgtcgtgttgtgcgtgctgccattgttctccctgctttcggcgattacggccatcacgttggctgcacgcaacgcaaataacggcggtaacgctgccaatgccgatggctctcgaaattcagccgccgtgtgctatctgctcctggcaaccgcactgtccgccacggccttcgtcatcgccttcaccttggcatagcgcggaccaccatgccgcagttcgcgcgatcgctgggatacagcgcttcctgcgcacgacgcgacaccaccggcataagatctcctttatatcacgaaacaatcgagcgtgttcgtttgcgccaaggatcagctctgccagtagtagctgaagaagtcggagatctccccatggtttcgcgcagcatgcccatgcgcggcaggtacaccacgcggaagtggtcggggcgatgccagttgaacgcgccgccgtggctgatgaggatgtgcttgtcatgcagcaggtcgagcgcgaactgctcgtccgagtggatgttgaagcgtttgacgtcgatcttcgggaagatgtagaacgcggccttcggcttgacggcggtgatgccggggatctggttgagcatgtcgtagacgaggtcgcgctggtcgtgcacgcggccgcccggcacgatgtagtcgttgacgctctggtggccgccgagcgcggtctgcaccacggactgggcgggcacgttcgaacacatgcgcatgttggcgagcatgttgaggccctcgatgtagtccttggcaatgcgcttgttgccggacaggatcatccagccgatgcggtagccggcgatcatgtgcgatttcgacaggccggagaaggtcacgcagaacaggtccggggccatcgaggcgatggagatgtgctgcaggccgtccatgacgaggcgatcgtagatttcgtcggagaagatgatgagctggtgttcgcgcgcgatgtcgacgatctgctggagcacttcctttgggtaaagtgcgccggtggggttgttcgggttgatgatgacaatcgccttggtgttgctggtgatcttggagcggatgtcgtcgatgtccggataccattcggactgttcgtcgcacaggtagtgcacggcggtgccgccggccaggttcacgcaggcggtccacagcgggtagtccggggatggcacgagcacttcgtcgccggtgtcgagtagcgcggacatggacaggttgatgagctcgctgacgccgttgccggtgtagatgtcgtcgatggtgacgttcgggatgttcttcagctgcgcgtactgcatgatggccttgcgcgcggagaacaggcccttggacggcgagtagccttcggtgtcggtgagctggtgggccatgtcgtagacgacttcgtccggcgtgcggaagccgaagggtgccgggttgccgatgttcaatttcaggatgtgggtgccgttggcctccatgcgcatcgcctcgtcggcgaccgggccgcgcacgtcgtagagcacgttgtcgagcttgtgcgatttgccgaaggtgcggcggcggcccacgggaatctcgctgtccgtctggggcttggaggcacccgtggcaagcggtgtggcggcgtgttcgccgtccgtgacgctgttggaggcgtccgagttcaattgcgtggtggattcctctccgcgcagccagttcatgtcgacgtccagttcgctggccaggaattcgagcacgtcctcgcggggcatggtcttgccggccacgtattggctgatgtggctcttgcccatctttacaccacgatgttcggcggcgtgcaccaaatcgacctgcttcagtcccctgctgttcatcgcattgcgcagacgttccgcaaacaccgatacgctcatatccttatgcctccaaccgggagttcaatttatcttttgaacaacggttcaaagcatacccccggttcaacacaagttcaattttggcgtgttctcgagtctcgaccggttcagcccaactgcgcttcaatccattgggcgacgccgtcctcgttgttggacgggcagatctcgtcggcgatggacaacaccttggggttcgcgttggccacggccacgccccggccggattcgctcatcatgttgatatcgatgaggtcgtcgccgaaggcggctgtctgttcaagcggcacgtccagtcgctcgcacagcaggtgcagcgcgtgctccttgttggcctgcgggttcatgagcatccacatcacgccttcgctgatggagatgtcgaagtccggcggaatcagcgcacgcagctcgttccactgttcaggctcggggaagatggtgatcttgtccgccacgccttcgggcacgtcgtggaagttcgtgtattggaaggcctgagttttccaatacacgcgcacatcgaagttggtgtagcgcacgtcgttcatcacgatgccgagcttcaggccgggcatgcgatcgagcaggaacagacagacttcgcaggcacgccgtgaggagaagccaatcttgatcaaatggttctcatcggccggcgtggcacctgaggtgagcaggtcgaagtcggagtgggccgggtcgaaatcgatgagggcgccgttcagatagattacggcgtccaccggcagtttttcggcgaactggagaccggtactcaccggccgcgcggtggcgatggcgaattgcattccggcatcgtgcgcgcggttgatggtgtcgatgctgcgctgggtgatgaaccggtcctcgaatacctcggcgtcgtgcagcaacgtgccgtcgaggtcggcgaccagcagtcggggttgtttcggcgtgatggcgtcgagaatcacagcagcccctcgcagtgttcacgcacgagttcggcggaatggtgcagtttggcccgctcgtcctcgctcagatcgagttcgacgatctcgttggcaccattggcgcgcagttcagtggggacgccgaggaacacgtcatgttcgccgtattcgccgtccaacagggtggagacgggcacgatgcggcgttcgtcccacaggatggtctgtacgatgccggccacggtggaggcgatgccgaagttggtgccgcccttggccgcgacgatctcattgccacgggtgcgggtcttctcttcgatttcggtggtggacacagaggcgaaacggtcttggttgtcggccaggaagcgggcgaatggcttgccgccgagcgagacggtggaccatgcggtgaactgggagtcgccgtgctcgcccatcacgaagccgcccacgttgcgcgggtcgaggccggtctcttcgccgatgatggtcttgagacgcgaggtgtcgagcgcggtgccggtaccgagcacctgggtgcgaggcagaccggaacgtttccaggcataccaagccatcacgtcgaccgggttggagaccatgacgatcacgccgtcaaaaccggaggccatgacgttgtcgaccacttcgcccacaagacccacggtgaagccgagttcggccatgcggttggagttggccggcggcttgcggcccacggtgatgacgacgatgtccgcatccttgcagtcggcgtagtcgccggcgcgcaccttgacgtggcggtcctggaattcgctgccatcatcgaggtcgcgggcctcccccagggccttggcggcggaacagtcgatgagcacaagctcattgcacaggccgtgcgtgacgatgccgaaggcggcggtggcaccgacctggccggtgccgacgataacgactttgttgcggttcatagtgaccatggtgatgtcctttcgtaatactcgatagaacgcatacgacccatgaccgacggtaacggtcatgggtcgcgagcgacaagtctatatggcgtgcaagccgatcagccgaggttgaacttggtcatcatgtcgaggccgataatcaaggccacccacaccagagcgatgataacggtccaacggttcaggttcttttcggcgacaccggaagtaccggcgttctgggtcagaccgccgccgaacatgtcggacaaaccgccgcccttgcccttgtgcataaggatgagcagggtcagcacgaagctgagcagcacgacgatgacttgcagcgtgatcttaagagcggtcacagggtacctccggattgattggactgttgaccagcatagcgcacacacgggaaaaccgtggtattagttccgtgatttcgtggatttcagtgccagtcgagcgattttggcgagttcctcaacgtccagggccgcccctccgatcaggaagccgtcaacgtcgggctgggaaatgagttccgccgcatttttcgaggtgaccgatccgccgtacaggatacgtatgctatcggataccttcgtgccaaaagtggtcttcaaatcgttgcggatggcgtttgcggcatcctgggcggattgcggagtggccaccatgccggtgccaatggcccagacaggttcgtaggccacgatgagtttggcggcttgttcttcgttgagatcgcgggtgacgtctcgtacctggcccacggcgaaatcgagttcaatgccttgacgtcgttcctcgaagctttcgccgacgcacaaaatcggctgcatgccggcggcgagcacggcacgtacctgatcgacgatattggcgtcatcttcaggatggtatttgcggcgttcggagtggccgacgatgacgtatgagcagccgagatgggcgatcatgtccgcggacacatcgccggtgaaggcaccttgggtggtcacggaaacggattgtgcgccgtaggcgacatggagcttgtcggcttcgaccagcacctgcacgctgcgcaatgacgtgaacgaggggaaaagcgcgacttcgcagcgtttaaagtcgaagtgagcgtcacgcaacagccataccagcttctgcacgaagtaagtggcttcaagatggtcgaaattcatcttccagttgccggccaccaacggaatgcgtttggacgccatatgtttcccttctaaaaaacgtagctcccctcaaggaggggagctagaaaatggattactcaagcaccttcaggccagggagctccttgccttcgaggaactcgagggaagcgccaccaccggtggagatgtgggagaagccgtcctccgggaagccgaggttgcgcacggcggaggcggagtcgccgccaccgacgatggtgaacgcaccggctgcggtggcgtcgaccagaccctgggccacggccttggtgccggcggcgaactcaggaacctcgaacacgcccatcgggccgttccacacgacggtcttggagtcgacgatcttgtcgtggaagagcttctgggactccgggccgatgtccagacccatcttgtcggccgggatggcgtcggcggcaacgacttccggagcaaccggggtgtcaccggccgggaagccggcgttcacgacgacgtcggtcggcagcacgagctcaacgccgttcttctcggcggtctcgatgtagcccttgaccttctcaagctggtcctcttcaagcagggaggtgccgacctcgtagcccttggccttgaggaaggtgaacaccatgccgccgccgatgaccagacggttggccttgtcgagcaggttctcgatgacgccgagcttgtcggagaccttggaaccgccgagcaccacggtgaacggacgctccgggttctcggtggccttggacagggccttgacttccttctcgaccagcaggcctgcggcggccgacagatcggcggcaacgtcgtagttggagccctgagcgcggtggaccacgccgaagccatcggaaacgaaggcctcgccgagggcggcgatcttcttggcgtaagcggcgcgttcgtcggcgtccttagaggtctcctccgggttgaaacgaacgttctcaagcagcacaacgtcgccatcgttcatggcggcgaccttggcctgagcgtcctcgccgtaggtgtccttggccagcggcacgttggtgccgagcagctcgccgaggcgggcggcaaccggggccaggctcagctcaggaacgaccttgcctttcgggcggccaaggtgggccatgaggatgaccttggcgccttcttcgcgcagggtcttgatggtcggcagagcagccttgattcgaccgtcatcggtgatggtggtgccgtccagcggaacattgaaatcagcgcgaaccagaacgcgcttgcccttgagatctccaaggtccttgagtgtcttcatgaatatcctttccttgacgaatcgcacgtcaaagtggccaattttgccactttgcatattacaggcattccggaacaaaacaccgcattcgtctactgactgaatgcggtgttttgtcacatcgttgtcgcgttttgccgaataggcacggcaaatcggattgtcgggttacttgccttcggctgcgcgagccttctccgtcttctcggcaagttgaagcagtcggcgaattcggccggcaatcgcatccttggtgatttgcggttcggcgatcttgccgagctcctcgaggctcttgtccacgtgatcgatgcgcagctggccggcctgacggaggttgtccggaatgttatcgccgagtacttcgaaagcatgctgcactttttcgctggcttcggcggcggccttggcggaacggcgcatattggcgtcatcgaagttggccagacggttggccttgccgcgggcctcgccgtcggagcgcttgccggtccattcgcgggccgaacgggtggcgcccatgagcttgagcatgcgttcgatggcgtcgggatccttgagtgtcacgcgctcggagctacgcagcgtgcgatgcttggcctggatgcctagacgacgggccacgccacacagggccatggcggcctcttccgtggggcaagcgatttccaggaagctggccttaccgggatcggacaggaagccacgggccatgaaggcgccgcgccatgccgctttgatttgggcgatggatccgttgaccacttcagacggcagtccacggacctgctgcttgcggcggtcgaccagtccggtctgcaaagccaaggccactacgttgcgggtgacgagcaccacataggtctcgacagggccgttcggggtctgacgtgtgaggtgattgacctcggcttcgtgcccgaacgtgttcctcaacgtgttcttcagccattctgcaacgtcaagcgaggtgaatacggcttggataacgtatgtattctgtaccggtcgaagaccgccgccaaaacggatcatggccgcagcttgggccttgatcgcggctggcgaatcgccttcaaaggctgccaactcgcttttgacatcgtccagaagagccaagatctacctcctacagtcccgttcttctcaatgcttcaggcgcttcgtgccgttatctgctgtcacacggtcggaagccatcggctttctgtgatacctaatctggtggacaagcgaacccgtttgatacgtattatgggctctgctttctcgcagtgtggtcaccgaacgcttgcccgatgaccgctcgacgcctgcttacgatgagtgacgcttgtgctgttctctcgcggaaacggttacgttgagcccatgtgcgcgtaagcggcgagccagctcttcgctcatcgccaccgaccggtgctgaccaccggtgcagccgacggcgatggttacgtagtgcttgtcttcctgggcgtatccttccaacgcaatctcgatagctttctcataagcgtcgagaaattccttggctcccttgctggaaagcacgtagtcggcgaccggcttgtcgtgcccggtaagctcgcgcaggctgggcacccagaacgggttgggcagaaaacgcacgtcggccacgaaatcggcgtcgatgggcataccgtatttgaagccgaagctgaagatgtgtactgccacggtggtggggccggagccgagcatcgcctcgtagagtttggtggacagctggtggatgctcagggagctggtgtcgatgacccagtcggctcgttccttgaggtcttccagcaggtgacgttcctcaaggatgccgtcgaccagtcggttgccgtgctgcagcgggtgcgggcggcgcacggattcgtagcgcttgatgagcacttcgttgctggcgtcgaggaacagaatacgggttttgacgccgagatcatccagatggccgagcacggcggccagctcgtcgaaatagctggagcgcacgtcgatgacggcggcaagcttgtggacgcctgactccgatccggaaccggaggtggtcatcatgtcgacaagcgggataagcagtttgggaggcaggttgtcgaccacataccatcccatgtcttccacgcagtcagcggcatgagagcggcctgcgccggacataccggtgatgagcagcacttcgaaggcatcaagcggggtcggctggttgtccggagtcgatgtggatgtcgcggaattcgccggcgcattcgtggcggccgcctcgccggtatcgcggttcgttgtctgttgattcattacagcgcctcctcaagagctttgcgcatcgcgatctccagctggtcgtcttcggtggtggtgtcctgcagacgctggtcggcatcgctgggcgggtcgtcatcccagataccggtcatcagcaatacctgtacgagagcttggtacagcagcatttcttcgccgccgatggcgtgaccgccatgagcgcgccaggcttccatgagcttggtggggcgtggatcgtagatcacgtccaacagcagtccggagaatggctcggttccggcatcggcgagggcatccgcgacgttgtcggccgcgtgtccgggaatcgtgttgatgacataggtggcgttgcgggctgcctcgagcagggcctgatcgtcgcctaattcgatttcgttgtacgggttatgcacgttgacgaacttttcggccactggtttaagcccggtgttttttccggggtggcgggcggcgacgacgatatggccgatttcgggcatcatgcagcatgcggccaacgccgaagtggcggtgttgccattgccgatgatcagcgcggtgccgcttctcgacgcggtgtggtgttcgccgagttcgcgattggcatggtcgaaggcgagttggatgccgatgacatcggtgttgtatagcttgatgcccggcttgccgttcggccaagcgggatcatcggcagccacgctccagtcgaataccgcggtattcgccaccttcagttccttggcccacaaattttccggaacaccgtacggttggatggtcttcttcaacggcatggtcaggctcaggccagcccacgtcgagtcaaggcctttgaggaaagcgtcgaggtcgtcttcccccacctcgtgcttgtcgtacagccaatcgtcgagtttcagcgaacggtaggccgcgttgtggagcacgggtgacaatgagtgtgcgacgggtttgccgagtacagcgcaacgatgattggccatatcccctccttgatgtctgttcccatgctagccgacactttgcttcgaatatgtcaaccacaggccccgcaaccgaaaatttactctgggctgctggaccgggccggctcactgctcgtgcagcgcggtgtacagcgcttcggctttggcgtggccgatgcctttgaccttctcgaagtcctcgacactggcttcgcgcatggctttgaccgagccgaagtggttgagcagccgcttctggtagctttcgccgatgccgggaatctcgtcgagcgcgctgcgcagggcgcctttgcgccgctgctggcggtggtaggtgatggcgaagcggtgggattcgtcgcgcacacgctgcagcagatacatgccttcggactggcgtttgaggatgatcggatagtcgtcgtccggcacccacacctcttccaagcgtttggccagtccgcagacggccacgtcgttcacgccacagtcctcaagcgccttggcggcggccatgacctgcggcttgccgccatcgaccaccaccaggttcggcttgtaggcaaagtgatgccggtttgtgttctgctggacgatgtcgggcggggactcccgcgcatcgttctgcactccgaccggcaccgcgtgccccttgccactgatgccggaaccgccctcaccattgtcgttaccgttcgcagcgattgtctccgccgccacggcagtggtcatcttgccggcggccgaggccacacgctgttccgcgtcgatgctttcgccggagtcgccggcgatgttgccgtgcttgaagcggcgggtgagcgtctcgtaaagcgcggacagatcatccaccgcgcctttgccgtccttgcctcggatggcgaagcgtcggtattcggatttcttggcgatcgcgtcttcgaacaccaccatggaggccacctggaaggcaccgcccacagtgttcgaaatgtcgtagcattcgatgcgcagcggggcttccgcgagtcccaatgccttggccacatcgttcatggcctgggtgcgtgcgcccatgtcggagatgcggctcatcttgctgcgttgcagtgcttggctggcgttctcgttggcgcggtccataagctgcttcttgtcgcctcgcgaggccacacggatggtcaccgctccccgcgcagattggtcagccagccttcgagttcctcacggcgggccggttcgacgggcacgatgatttcgcgcggtaccggtgcgatgggtgccagcaggtccgcgcgcccggtggtctcctgacgggtgttgcgttctcgggtggcctgggcgcgtgccacagcgtccgtggccgtgatggtttgcgtggagccgatggcctcgcgattagtggagatggtcgcggccgactgggggtgattgtccccggcggcgtccgaatacacctgcaccagaaggtcggccatcaagtcggcgtcatcgatgtcctcaactcgttcgacgctccagttgcgttcgccgcgaatcgagccggcgcgcacataaaaagcgtgcacggaggcttcgagctcgtcgctggcgaagccgaacacgtccgcgtccacatcctggtcgaagacgacggcgttctgttgcaccacggtttccagcatttggatctggtcgcgcagtcgggcggctttctcgaattcgagttcggcgctggcctctttcatgtcgcgggtcaactgggcgatgtatggccgtccgagtcgtccggtcatcacaccgaccagctgttcgcacagcctccggtgttcgtccgcttcaatgcggttcacgcagggtgcggagcatttgccgatggaagcgaacaggcatggccgtccggtcagttgcgccttatggaacacgttggtggtgcaggtgcgtaccgggaacgtgcgcagcaaccggtcaagactgtgccgcaattcccacactttggcataggggccgaaataccgggtatcccgccgtttgcgcgaccgcgtgacccacacgcgcggaattcgctcccccgtgctgaccgcgagatacggataggtcttgtcgtcgcggaactgcacgttgaaccgtgggtcgaattccttgatccacgtgtattccaacgtcagtgattccagttcggtggcgacgaccgtccactccaggctgcgtgcggtcagcaccatggtctgcgtgcgcggatgcagcagatacagcggctggaaataattggtgagcctgttgcgcaggttctttgccttgcccacataaatgacgcgcccttccccgtcgcgccatttgtacacaccgggtttggcgggaatatccgaggtcttgggtcggaacaggtcgcgagaatcccccagcaaaggtgccccattcgcattcaccttcgccgtcgtttccccggcacccacagctatgctttccgacattaacgccgccgcagtcttccgccactcatccggactatgccgctcaatatcgttcgtcataatcctcctcgctattaagcaaaaccaatcatcagggattgggtgggttggggtgtgtgttgctggaccgtaaagacttgacctgagcggcccggagcatgtccagcaacaaacaccccaacccacccgaggtcagctgcaatggaaggctaaagcatgggtttcaggaacttgccggtccatgaggcttcgcattcggcaacctgttcgggcgtgccctgcgtgacgatggtgccgcctccgtcgccgccctccggaccgagatcgatcagccagtcggcctccttgatcacatccagattatgttcgatgacgatgaccgtattgcccttgtccaccagggactgcagcaccttgagcagcttgttcacgtcttcgaagtgcaggccggtggtcggctcgtcgaggatgtacacggttttgccgtcggatcggcgctgcagctcggtggcaagcttgacgcgctgcgattcaccgccggacagggtgggtgcgggctggccgagtcggatgtagccgaggccgacgtccacgagggtcttcaggtatcgggagatgccggtgtacgccttgaagaagtcggcggcctcctcgatgggcatgttgaggatgtcggccacggtcttgccgttgtacgtgacttcgagggtctcgcggttgtatcgtttgccgtggcagacctcgcagtccacgtagacgtcgggcaggaagttcatttcgatcttcagcgtgccgtcaccgtggcaggcctcacatcggccgcctttgacgttgaaactgaagcggccggggccgtagccgcgcacctgggcttcgggagtcttggcgaacagggtgcggatcttgtcccacacaccggtgtaggtggcggggttggatcgcggcgtgcggccgatcgggttctggtcgacgtggatcaccttgcgcacctggtccacgccttccacgcgcgtgtggcggccgggtacgatgcgtgcaccgttgagcttgtcggcgagcaccgggtagaggatcgtgttgaccagcgaggatttgccggagccggagacgccggtgaccacggtgagcacgccgagcgggaagctcacgtcgatgttcttgaggttgttctcgcgggcacccacgactttgagcacctgggtcttgtggatcttgcggcgcttggcgggcacggcgatctctcgccggtgggcgatgtagtcgccggtgatggagcgcttggcttctatgaggtgcttggcggggccggagtagatgacttcgccgccgtgttcgccggcgccggggccgatgtcgaccacccagtcggcgcggcgtatcgtgtcctcgtcgtgttcgacgacaatcagcgtgttgccgagatcgcgcaggtggtgcagggtttcgatgaggcgttcgttgtcacgctggtgcaggccgatggacggctcgtcgagcacgtacatgacgccgaccagaccggagccgatctgcgtggcgagtcggatgcgctgcgcttctccgccggacagggtggcggccgcgcgcgagagggtcaggtagtcgaggccgacgtcgttcaggaagccgagtcgggccttgatctccttgagcacttcgccggcgatcagctgtgccgagccttcgagttccaggccgttgatccaggcgagttcgcgtacgacgggcatgtcgcacacgtcgaagatggattttccgtccacagtgacagcgagcacttcgggcttcagacggcgtccgtggcagacctggcagggcacttcgcgcatgtacgactcgtagtattcgcgcatggactgcgaatcggtttcgtcgtggcgtcgcatgagcgtgcggatcacgccttcgaagccggtggagtattcgcgcaggcgtccccagcgattgcggtaggagacgttgaccttgaagtcgtggccgtagaggatgtcgtgcttgacgtcgtccggcaggcccttccaaggggtcttcatggagaagcccatttccttggccagaccttcgaggatgtggccgtagtactgggaggtcatcttggtgccgctccacggttcgatgacgccgtcggccagtgacttgtccgggtcggagatgatgaggtccgggtcgatttccagtttgaagccgagaccggtgcaggcggggcaggcaccgtagggggcgttgaaggagaaggtgcgcggctcgacctcgtcgagttcgagcgtgtgcccgttcgggcagctgcggtgttcggagaacggctggcggcgggccgggctgccttcctcctcgtccacgaagtcgatgacgatgctgccgttggcgagcttgagggcggtttccaccgagtcggtcaggcgttggcggatgccgtccttgaccacgagtcggtcgaccacgacctcgatggtgtgcttcttctgcttggtgagtttgatgtcgtcggacagctgcgtcatctcgccgtcgatgagcgcgcgggcgtagccgtcggagcgcagcagctcgatcatatccacgaactcgcccttgcggcccttgaccacgggcgcgagaatctggaatcgcgtgcgctccgggtagccgagcagtgtgtcgacgatctgctgcggggtctgggaggcgacgggctcgccgcattcagggcagtgagggatgccggtgcgggcgaagagcagtcgcaggtaatcgtagatttcggtgatggtgccgacggtagaacgcgggttgcggttggtggtcttctggtcgatggagacggccgggctcaggccctcgatgaagtcaacgtcgggcttgtccatctgacccaggaactggcgggcgtaggcggatagggattcgacgtagcgtcgctggccttcggcgaacagggtgtcaaacgcgagcgaggatttgcccgaaccggacaggcctgtgaacacgaccatgcgattgcgcggaatcgccaggtcgacgttcttgaggttgtgttcgcgcgcaccctgaatcgtgatcttgagatcgttcgggatgtgcgagatatcagctaccagcgaaccatcgtgttcaatcagcggcgcctttttgatctcccggctcaggaaggagtcgctggtcatcaccttttcgacgatgacctcaccgttcttgcccttgccggttttcgcgcccgttgcgcttgttgcgcgccttgcgccagtctgcattgccgccacagccacaccccaccttccatctcaccgttcccgcgcgcacggtcatgcgcgcgccaaatctgtcccaaggatacccgaacacacgaccaaattcgaacgcttgttcgatggcgtgtcaggccggaaaactgaaccagagtatgcaaaattccggaccatcagtggaccgaaacgcaagagccggcccccaagatactcggggcgtccggctctcacttccatttccccagcggggttggcttaccatgaagtatacacggttttaggacatcaatcactgtcgatgaacactgttcgaacatggccgaggaattcatcgtatcttccagtaccggcctgggcatcaccgtacgctcctagcagctgatcagggagccatagccttgcatcagtctcccctgcacagagttcgacacgaattggcccgataaatctgcggcttctcaatccatcgatgaaacggatatcgttcctgtcctgtgaaatctcgcgccgttcaagcacaagcgtgtccacgttgtattctgtttccagcagaggcagaagacgttccaaacatttacggcgagcgcgttcggcggtattccactggctcattggtaccgcagccacaatgacatgatcaatgtccattgcagccatggcatcaacgactttgccacgcaatgatggccgcatgtctcgccagtgcaatttccttgctcctttgggcttaagcaacgccaatctttgccttgtttcggtttccgtatcatcacatacgcatgcgcccatcaagtacataggcgagggaactccggttttccgcacactctcgtcaccccaagcggttgccatgtttgtcccttctcgcgcaacgcaaaacaacagttcgatagtatcggatagcagtgccggaccttgcagctatgcaatgccgttgcattattaatcggaaggcataatgtgagacgagaaaaagctaagccgttctagctcttggcaacatccccaatcactcagcctaaatcggcaaatcctgattttcaatggactccacggggatgccaagcttgcgtaattcgtcaactgcatcacgcatgggaatgcgttcctgttcgatgcgccgataagcgatggttttgtcagcacacagtcgttcataaagacgtcgctccgccgattgaaggccgggcgtcggcttaggctcccgcatagcaatcttcgcgctgcgttcagtacgatcggtaccaaatctgtggtaccgatcgtatgcatcgcaatccatcaggatggagtcgcattcgatacctgattcacgtaatgtcgaaagtatttccagtccatccgcatccatatcaccccaatacacgatacgcatgtcacgcagtgcaggaaccgcaggtacagcatcgcttacagcgcgaccagaaccccatatgcagatgccctgcgcaatcggcggcatagtctgatacgtgtctttgttctcaacgatgacagcatatttaatgccggataacgcttcgccttcccacggacaccatatgatgcgttcgagctcagcatcgtcgcggaccggatcgagataacggaaccgcagttcggtcggccgttttgacagacccaacgtttcgacaccgagcagtcggcaaatggccttacgacgattggtttttgactcattcagccatttgccgctgaatcctgtcagtggaatctgtcgcggcgtcataccggtcacgtcatgatgcctgaaatatcgaactgcgctgacaagcagatcgaagtcgtcaggctgttcatggcctgtcatgcgagcggccgattcgattgtttccggagcaacgtcacaagcagcaaccagacatgctatgcggcggcgcgcttcgcgacattccgccgccagcgtacgaccaaccacacgcatggctattgattcgtcaggaacgacgactttggagatcagctcgacagaggtgcctatggtgcgatgcttggttatgatttcgcaaccattcttgcttgcccattgccgtatctcattgttgttgtcatgcaccgcaatcgcattggtttccaaaaatgcttggtccggcaatcccaccggcacgggaaatggccatgccggttcgatgtcgtacatatgtgaacgcatatgtttcttcacgcatgtggtgatcgcagcgatgtctttcatgccggccatagttcccatcacctgctttcgaacatcgtcgagtcgaaccgaatcgtcttaataccggcgacgccaggactgctcattcggcaaccccgtcatccttcaatatatccgacgatgattcatcgtccatgtcattctgatgcagcacggcctcgcgcagggaggtgaggccggtgtcggggtccttgtaggtcacgtaggccttggtggagacctcgaggatttcgccggtcttgctttccggggcggagacgatgacctggaatccgaggcgcggcagcaccgtgagggcgcgctgcgtgtaacggccgtcggccttgatgagcgcctcgtcgaggaacagcgtggtgtacgagggctcgctggtcaggccgccgccgagcaggtagatgagcgccgcgccgtatacgaatgaggtaagctcctgcaaggcgccgcccgaacggccgccggtggaggtgatgcgttcatccgggccgtcggcatgatgcacgatggcgtagaaggacgagcggcaacgcgggtcgaggttgcgggcgccgtagcttttcacgccgttcgcgtccttgacctgcgcgagttcggcgcgcagcagcccgaccatcggcgcgcaggccgcgaaagccttgcgcgaggcgtcggaatcgttgacgtcggcggatttccaatcgttcagggtgccgatgacgcggatgaactgcgcccagaaggtgcgctcgggacggcgcacgtccgcgtgcagggacaggctgccgtgcttgggaccgaactgctggcctttgagcatggcgttgatgcggtcaagctggtcgtggatgtcgctggcatccgtgtcgatggcgcgtttgatggtcaggaagctcctgagcagctgttcgaggcagcgccggtattcggcgtcggtggcggcaaccgcggccagctgggtgaggctggcgagttcgtcgagatagtaccggtagtcctccacgctggcggtcagcgaatcatcgtcggccgcgtagagcgcgatgtaggtgctcattttcgattcgacgccggtgcgtgcggcatcggcctggccgttcagcaggttgatgcgggaggccatgtccttgccgatgccggcgatggtgcgttcggggaagctctcccccggagcctgcgttcctgccgcgcccgcgccgatgatcatgtgcgcgcgcatggcggcgtccgccagtccggcgaatcggttgtcgtaggattcggcgagcgccgccgtgacttcgtccggcagcgggccggacgcggcgtcatcgtcattgtcggcggtggcaccggcggcgtccgtcgtgccggtgtcggcatggtcgcgcagccagatgagcgccgcttcgacggcgctgccggcgcgggccgcggcctggtcggattcgatgcgctggcgttccacacggtcgagttcggcgttcagttcgtcgcgctgtttggcgagttcggcgagcttgggatcgtttttgatggatgcgatggcgtcctgcgtgtccgtgatggtccgttgcgcgccggcgatgtcgatgcgctcccaggacgtgtaggcgagctggttggccagttcgagttcgcggtggaggttatcggactgtgttttggcggccgtgtagtcggtgtcggcttggctgagcgcgttgcgggcggcgtcgacctgcgctgcgagcgcgttgaggtaggtttcgttgacgaatccgatgacctgggcgcggtctttggtgccgtgctggccgcgtgcgccggatttgatctgaccgtcggcctgcacctgacggttggtgcggtcggtgtcgtcgatggcggtgacgcatagggcgtcgaatcgttcgtcctgggtctgcgagcgcagccagtcggcgaagggcgagtcgtcgcggtagcgcagtttgccggacagccagtcgccgtcctgttctccggtgagtatgttcgcgtgcgcgccggtgtcgtcgtagtggcgtgcggtgtccacgaactgccaggtgcgtcggggcatggtgcgcgggtcgatggtgctgactttggcggcgaagccctgttcgtggcgcttgtcgacgaggatggtctgggcgatgggcgcgtaggcgacgttcatggcgagacgccagtcttcctcgtgttcgttcacgtccatgagttcggccacgtacggcagttcggcgggggtgagtccggtggcgcgacagagcatggcgcgggtttcgtccatctgctgggagatgcgggtgcgctgggagcgttgccggtcgaagtcgcgttgcagtcgttcgaggtcgccgcgtgcgccggcccgcgcgttgatggcggcggtgagggcttcctcgcattcgccgtctcgtttgttgtattcgcgtttgaagttcacggcgttgatgcggcgttcgttccaggcctgttcgtcgccgggcagcgtctcgccgatggatgcgaacgtttgttcgattcgtgttcggttggcttgcacgtcttcgagggtgcggcgggcctggtcgagttcgagttcgagtcgggtcaggtcgccgccgtccagaccctgcatctggcctcggatcatgtcgagacgggtgcgcaggtcttcggttcggcggcgcagcagcttggcttccgcctcgctgttctgttgttcggcgcgatcggcgggcagttggacggcgacttcgccgcgcatgcgggccaatgcccagtcgcgcagcacggccggcaccgtgccgtcgacggccggcttgaccggttcgaaggcgcgggccttgccgcgtgcggcggcgtattcgccgtaggcctgttggatgccgcgcagcgtgtccatgcggcgggtcttctcgtccatggcgtggaagttctcgtcgtaacgttcgtagtcctcgaccgtggtgcgggccaggtccagggcttcgggcacgccgagcacgccttgtttgaagatgtcgtcgagccgggagggcgcgtcggcggactggatcttgtgcagcagtcggcaggcggcctcgctcaggcccattgcgctccagatgtgtgtgtggaacgcttcggcgctggggaatgtgaggcagtcggggtaggtggctttgagctgggccggcgtgaacggggcgtcacggtattggtccatgcgcctggggtccacgggcttgccccagaccacgtactgtcggcgcacgtcgccgcggccgtcgccgggcatcaggtagaggaatttggcgcaggagagcacctggccggtggtctggttgcgataggtgtccacgatggcgccccacacgggttgcggtgcgccgttctcgtcgcggccgcgcaggtagagcggctcgtcgccggtttcggtgctgcccacgccgaccatgccgcgcaggtaggtgtagtcgctgcgttcggagcggccggagttcgaggccttgttgaacggcgtgccggttgggtacagcagggagatctgcgcgtcgaccagcgtggatttgccggattcgctggcgccggcgagcagggtcaccggcagcttgtggtccgtggaggggcggaattcgtggtagccctcataggagccccagttgatgagtcggcgggattccagcatccaccggtccgcgatcatctgcacgtctgtcgcctgcatcattcggctcccttctcgtcgtcatcgtcatcttccgtgtcgccgtcgccgtgttccgcgacgtcgagccaggtgtcggccagttcgcggtcgagcaccacgggcacgagcggcgtgatctggtacatggcttcgtcgtccaggcgcaccaaatacccgtaggtgatcatcgcggagacgatggcgccgatctgctttgccacgccttcctcgtcgttgcgggcggccagatagccggcgccggtggcgagcgcggcgcggatctcctcaaagctgacgagccagtcggcggggtcggcgtgcacgttctcgtattcgaggacgcggatgcgcaggaaggcgagcagcgcggcctcctcgcgtttgaggctgacacgggttttgagcgagcgcagggtcacgtcgtcgccggccacgggcgtggcgtacatgatgcggtagcgttcgttgatcaccaagtcgagcaggtcgttgttcagggagcgtacgacggcgtcgcggttgtcgagcacggtgtcgtaggtgggcccgctgatatagcggtcacgtttgagggcgatggcggccatgcgtgcctcggccggcatgtcgccggtgtcgccttcgaacagggcgtacgggttggcgttgtccatatgctcctcgtgttcctcgtgttcctcggccacggtcatccttcctccacaatgatgctcagctcgtccatgtcggccagcaccggtctagtgatccagttccggggctcgccgtcgatcgatacgcaatgccaggtcgcggtatcgccgcgctgcgccggggccggctcggtggcgatgtcgctgtcgaccccgacgccgacgccgtcagtggacggctcgtcggcgatggcgttgccgcttacggctcccagcccgcccaggaagccgacgatctcgctttcgcggcgttcgctttcgggcagccggttgaagctggcggcgatgtccacgagggttgcgccgggcctgtcatcggacctgtcaacggtcaccgggttgcgccggatgaggctgaccatgcgcaggagtcgggggccgccgctgttgaccatgtcccgcagatcggccaccggagtcgactgcggggcttcggcggcgaggtcgctcaggccgggtgcggtggcgcgggtcatggatttggccgggcgcatcggcaatggcgcgaacagcgcgtccgaggtggccgtgtcgtacgggcgcgaggcgtctcccatatgggttttcgcatccgcgttgaggcgcgcgtacagtcggttcaagcgggtgagcatcgtgcggtagcgagtgtcggtttgctggcgcacgagccggctgatcgcctcgtcggagacgcgcatctggcggcgcacggcttcgatgccgtcgtagatgcgggccagttcgtcgcgtatctggccgagcagcacgccggattcgccggccagatacggggttttggcgatggcgcgcagggcttcgtcgatttgctggcggccctcgtcggtgatgatcacctggaaggcgtcctcgaagcggcggccgctgtctgattcgctgaacgagcggcggtattcatcgtggtagcgggtcaggttctcgtccacgctgatgtcgccggcctgcatgcgccggcgcaaggcgtcgccgttgtcccgctcgtcgagcacgagttcgcgcaggtcgatgggcacgccgcgcagcgtgttgtggatcacggcgatcacgtcctccacctgggcttcgctcagcgtggcatgctgcttgccctgttggatgcgtttgatctcgtgcttgcgttccttgatttcacggttgaggagtttgatgcgctcgccggggtcggcggtcagctgcatgcgcgcgtgctcgatttccatgatgatgctgttggcctgcgcgccggacagggcgcgtgattcgtcttcgagcctgctcagcgcctcgatggcgcggtgggcgcgggccgtcaaacggtagaggaatcggtgtgaggccgcatcatgcgagttggcgagccaggcgtagtcgccttcgccttcacgggtcaggtcggcgaggatctgatgagcggcctcggcgaaggtctggtcctcgcgcggcgcatattcgccggcgtcggccagagcgttcagactttgcgcgaaccgctcctccacggtctcgcgcggcagctcgccggtgagcgggtcgaacgtggaacgcagcagcgacacgtacagcatcgcgttctggcgcaacagcaaccgcaggacgcccgtctcatacaccggtcgcagccgttccagctcccgcatcacatcggccacagcatgcctccctctgtcgtgaccgcaccatactagccgatagccgcgaaccacaccccgcccgcgccacgcccttcgccccccccacagggaggggcgccaagccatgctaaaaatcacagacaggctattgcctttgcgggaaatcatcgttagattggcgagaggaatattgtcaatgcatacgaaacggaaaacatcgtgaccgcaccgaacacgcccgccgaaacctctgaccagctcaacaagcccgccaaatccggcaaactggaggtctccgacctcatcaccatcggcgtgtttgcggccctgtacttcgtgatggtgtgcatcgccacactggtgagcaccctgttcaccggcggcttcggctccatcttcctgcccgccatcacggccctcatctccggctgcgtgtacatgctgctggccgcacgcctcggcaaattcggcggcatcaccgtcatgggcgtgatcatcggactgttcctgttcatctccgggcatttcgtgctttcgttcatcgccagcatcgtgttcccggtggcggccgacctcatcgcgcgcgccggcaagtataagagcaaggcgctactgctcgtcagctacgtggtgttctcctacggcctgaccggcccgatcctgcccctatggttcatgaaggacgcctacgtggcgagcctgcaggcgcgcggcaaggacgcagcctacatcgacggcgtattcgccaacatcaacaccggcacgttcttcatctcgatgatcgcgattctggtgtgcgcggttctcggcggctggttcggccagcgcatgatgaagaagcacttcatcaaggccggtatcgcctgatgaatcctgcccgccggacgctcgatccgcgcgcgaaactctaccttctgctggtggcgaacctcatgctgttcttccacgtagggctcgccacgcaaatcgtcatggtcgtgctgttcctgctacccctgctggcggccgcccgatggcgaaccgcgttgaacttcggcgtgacctatgccgtactcaccgcgctgggaatgctcgaccccgatgccctgggactgccgtggctgcatgtggtctccgcgctggccgtgggcgtcacgatgatgctgccctgtttcatcaccggcgcgtatacgttcaccaccacgtccgcgagcgcgttcatctgcgcgatgcggcgtatgcgcgtgcctgaggccgtggtgattccctgtgtggtggtcatccgcttcttcccgaccatcgccgaggattaccggcagattcgcaatgcgatggcgttgcgcggcatcgcctccggcggctgggggctggttcgtcacccggcccaatcgttggaatacattctgattccgctgctgatgaacgccaccaatgtggcacaggacctgtcggtggcggcactgaccaaggggctcgggcgtgagggcgagcacacctcgcgcacgctgatccgtatgaccgtggtcgactggctggtcatgattgtggtcactttgccgctcgcgctcgatatcgcgggggtgatctgatgggtggaaaccaatcgcagccgaatgcaactgccattattgggaccggcaagggtggcccactcgacacgtctgcgggaaccatcgcctcccgtggcatctcctttacctatgaccatgccgcagagccggcattgcgcgacatcacgttgaccgtgcccgcaggcgagtgcatcgtgctgtgcggggcgagcggctgcggcaaaaccagctatacgcgcgttgccaacgggctcatcccctcattcttccatggtgcgttcgccggcaaccagaccacgtgcgggctggatgtggagaccgtgccgatcgaccggctcaccccgctggtcggcagcgtgttccaaaacccgaaaacccagtatttcaacgcgaacgtcaccgacgagctcgccttcccggccgaaaacatagggctgccggccgaggacatcaatcgtcgtatcacggccgtggctgagcgctttggcattgggcatctgctgcatcgcagcatcttccacctgtcaggcggccaaaagcagcgcatcgccgtggcggcggccaccatgctggggcccaggctcgtggtattggatgagccgaccagcaatctcgacgcgaacgccatcgcggacatgcgcgccatgatcgagcagatgaaggacgaagggctcaccatcgtaatcgccgaacaccgactcgcatggctcaacggcgtggccgaccggtacgtggtattcgacggcgggcatatcgtgcaggattacgaggccgatgaattcctgtccctctcccccggctgcgtggccgccatgggattgcgggcgttggacctgcaaccgtatcggcgccggattgcggcgctggcttcaagcccagccgcggatgagtgcacttcagtattgctcggcacccataacctcaccatcggatacaaaggcaaggacggcttcacccgcgccatcccggacctgcggttccgtgccggcgaaatcaccgggctcatgggcaacaacggctgcggcaagaccacgctcgtgcgcacgttgaccggactcatcaagcctgtttcgggccgcatcgagctcaacggcgtgcccgcaaaaccgcgcgacctgacccgcgccggattcctgatcatgcaagatgtcaactaccaactgttctccgacagcgtgcgcgaggaactgctcatcggactcgacgagacggatgccggcatcaccgctcaagccaatcaggtcatggccgatcttgaccttgcagcgttcgccgaacggcatccgatgagcctgtccggcgggcagaagcagcgggttgccatcggctcggcattgatgtgcggcaaggacctcatcatccttgacgagcccaccagcggactcgaccgctaccacatggagcaggtcggcgaactgctgcggcaactggcgagccaaggcaaggcgattctcgtggtcacccacgatgaggagctcgccgccggctggtgcgaccgcattgtcaatcttggcgccgacgattccgggaacaacggctcgcatgccagtaacccagatgccagcagccccaaccctaatgcctctaccaatttcgccaccgcatccacccatgaaaggaacgcgcaatgaccgccagcaacaccacggattccacggccttcgacatcaccgactggctcggtgaatgggaaagcttcgagcattacattgattcggatgacgccgccatccagcagacctgggaagccgccgagcaggcggtgctcgccaacccgaagatggccccgatggccgcgcgcggcatcaggacgttctggtcgatggcttgctccaccaccagcccggagaacatcatccatatcggctactggcgtgtgaacgagccggccgccgaatccggctccacggacgatgccgcgctcgccatcgaatggttcgccgaggacgacaccagcctcgacacctacgaatacaccatcgaccatgtcatcgagcacggtctcgaaggctcccccaccttcgtgttccacaccaccgatccggccgccgaagacagcccgttccgctggctacttgccatcaatccgctgccttcgcgcaaggcgttcgccgagggcgggctgctcagccacctgcatttccagtacgccaacgatctgcacacgctcgtcgccacggatgaggccaccggcgtcgagaccttgcgcaatccgcgttggtacgccaccatgtgcgccaacgagggaaccgtcgaggaccgttgcgccatcatccgcgcgttgcaccacttgcagtagacctggcaacatacggcagtgacggctccccactagtgaaactagcatcgcttcagtagccgtgcgagtgcagatactcgtcatcgaagccgaaaaaatggccgatctcgtgcaacacggttttgcggatccgttggcgcagctcggcctgcgttgagcatacgcgttcatgcggcccttgaacagggtgatgacgtccggcatcacgccgctgtagcccgtagttcgcttcgtgacgggtatgccctcatacagtccgagcagctcaccgcacggattgctcattgtagccagttcgcgctcattgggttcgtccgcaacgacgatgccgacattctccagcacccgcgcaaaccgttcaggcaaatcatccaacacctgttcaatggcccgttcaaactcatcgtcactgatgtgcattcgctctccacacgcgaaatgccttggcaccaagtatgtaccaaggcgctgaaatctcagactagcaggctcagctgttgcggttgatctcgatgtcggtgacggtgaggttggcctcgttgatcaggttgaagaggatgacttcggccagcgggccgggctgcatgaaggtgtgctgcttggcctcggagacgtagtcgcgactgtcacggtagaaagcggtatcaatgccgcccggatagacggcgaccaccttgacactggtgcccttgtatgcggcctgcaggctcttggtgtagcctttctcaccccacttggtggcgcagtacacgctttcgttcgcgttgccgcgtgtggcggcggtgctcataatctgggcgattttcacgttctgctcgccgcaggccttgagggtttccaccgtccacagaatcatgcctttgagtcccttgagacatttgtcgacgtcggcggcctcgtaggcggtgggcaccttgaacgaaggctggccggcgttgttgatgagcaaatcgatgtggccgagcgtggcgatatccgccacggattccttcacgaacgcttcgtcggtgatgtcgccgacgtaggcgcggtaggagtcatcgggccactgcgcggtcagttcggcctgacgttcggcattgaagtcgacaccggccaccagccagccgttggcgatgagctggctggcgagctcgtagcccaagcccagcgcgctgccggtgacgatggcgattttcttacctgttgtggttggcatggcagacctctcctactactattcttcggctacgagtttactactattcttcagctacgagttcgagatacgaatcattccagaggtcttcgtcgccgtcgggcatgaggagcacgcgctcggggttgagcgcctcgacggcgccctcatcgtgggtgacgagcacgatggcgccctcatacttggcaatggccttcagaatctcctcacgggaagcggggtcgaggttgttggtgggctcgtcgagcagcagcacgttggctcgcgaggtgaccagcgtggccagagccagacgggtcttctcaccgccggaaagcacgtgagccggtttcatcgcgtcgtcaccggagaacaggaacgagccgagaatcgaacgggcctgcgtgttatcgagctcgggcgccacatgctgcaggttctccaacacggtggcgttcagatccaaggtgtcgtgctcctgcgcgaagtagccgatcttgcagccgtgaccgtattccacggaaccggtgtccggctcctcgatgtgggccagcaggcgcagcgtggtggtcttgccggcaccgttgtagccgaggatcaccacacgcgagcccttgtcgatggccaggttcacgccggcgaacacgatgttggaaccgtaggccttggaaatatccttggccatgatcggcgtgcggccgcagggcgcgggctcggggaaacggatgtccgccaccttctcggccttctgcgcctcggaggtgttttccagcagcttttcggcacggcgcatcatgttctgcgccgccacggccttggtggccttggcgtgcagtcgaatgccttgcttcatgagacggtcggccttcttctcggccacttcgcgttcgcggcggcggcgctcctcgtccaccacgcgctggtgcaggtaggccttccagccaagcgaatacatgtcgatctggccgagctgcgcgtccagatgccagaccttgttcaccacttcgtccagcagttcggtggagtgggagatgaccaggaagccgccctcgtacttcttcaagtagccgcgcagccattcgatggaatcggcatccaagtggttggtcggctcgtcgaggatcagggtgtcggcattggagaacaggatgcgcgccagctcgatgcggcggcgctggccaccggagagcgtgccgagctgctgctccatgacctcctgcggcaggccgagcgaggcggccatggaaatcgcctcggactgggccgcgtagccgccggccttgtcgaagtcctgcatggccttgtcgtaccgggtcatggccttgctcatcacgtccggatccgggtcggtcatatccttttcggccttgcggatgcggttgatgatggtggcgatgtcgcgcgcgctcatcatgcggtcgagcgcggtctgtgtgggatcggaggcatgcgtgtcctgcggcaggtagccgagcttgccggagacgcgcaccttgccggcggtgggcagcatgtcgccggtgatcacgcgggtcagcgtggtcttgccggcgccgttgcggcccaccagaccgatcttgtctcccttggccacatggaagttggtggggtgaagcagcgtgcgcgcgccgatctgaatttcaagtccctgcacctcaatagccatgaataacctacttgcctgttacgaatactgtctcttaccaaagtccgactgtccatcatagcgaacaccatgccgaccgggctcagccgacgctcatgcgtccatacgcagccgcgcaactgatcggcaaggtgaagaatgcgacgcccggtatggtgatcgcgaccatggcgcacggtatcgaagctgccatcgaagccgctgtgagcaccgaaaccgacgccaccgacatcatgggcgaaacccactaacgtacagacagcgatgcccccgccgacaacttctgtcagcgggggcatcgctatgcgttgaacgttacagttcgcgcaactgggcggcgatctggatggattcgacgctggcctcggccttgttgcgcgtctcctgccattcggtggcgggcacggagtcgagcacaatgccggcaccggcctgcacgctcgcctcatggtcgcgcaggaacgcggtgcggatggcgatggccatgtccatgttgccggagaaatcgaagtagccgacggtgccgccgtagatgccgcggtcggccggttccaactcgtcgatgatttcgactgcgcgcggcttaggcgcgccagacagcgtgccggccgggaacgcggacttgaacacatcgaatgcggtcagcgaggggtcgaccttgccggtgaccgtcgagcagatgtgcatgatgtggctgaaacgcttgatgtccatgagctgcacgacttccacggactgcggcacgcacaccttactcaggtcgttgcgagacaggtcgacgagcatgatgtgctcgctgcattccttcggatcggcaagcagctccttggcgaatttctcgtcttcctcaggggtggcgccgcgagggcgggatccagcaatcgggaaggtcatcgcgtggccgttgtccaccttgatgagggtttccgggctggagccgatcacgttgaagtcgcggccctgagcgtcggtcaacgccatgaaatacatgtacgggctcgggttcagcgtgcgcaacacacggtacacgtcgaacgggtcagcaggcgaatcgatgtcgaggcgctgggagatgaccacctggaacacgtcgccgtcgacgatgtactgcttggctcgttcgacggcctgctcgtagtggctcttctcggtgcggaagcgcagctcgggttgggcgaccgtttcgtccaggatgttgacgcgagactcgtccggagccggggtggcggcatcgcgctgcatctggtcgagtcgagcgacggcctcgttgtaggcagcgtcggcgcgagtggatttatcatccacattcaccgcattggcgatgagccataccgaaccggatacgtggtcgaccacggcgatatcggtggccagggcaagcacggtctcaggctggccggtctcgtccggagcttcggcgcgcagggtcggttcccagtggcggatggcatcccagccgaccgtgccgaccagaccgctggtcaggttcggcaggccttccacatgcggggccttcagagtcttcaacgtggcgtgagcgacttcgactacgtcaccggtgacgggcacgccgaccgggaccttgcccagccagtcggcctgaccgttgttggagcgcagctgggccatcgagttgacgccgataaaactgtaacggctccacgtgccgccgtattccgccgattcgaggatgaaggtgccggatcggccgccggcgagacgctcgtagaagccgaccggggtgagcgagtcggcgagcagacggcgcacaatcggaatcacacggtatccggcgtcggccagttcgtggaactgttcgcgactgggccaggtggcgccccacttcaggtgtttgacgctgcattcgctcatattcgctcctttgcttacaactcgatgtcttgtttcatagtacgcggtcgctcggcttcccccagtcaggaaagcccgttctactgctcggccgggcgatggccttcgaccacgggcagggggccgccttcgaggaagcagctgcgcttgccggtgtggcaggcggcaccgacttggtcgacttcgacgagcagtgcgtcgccgtcgcaatccagggacacgcccttgacgtattgcacatggccggaggtatcacccttgcgccagtattcctgacgggaccgggaccagaaggtcacgcggccggtggtcagcgtacggcgtaatgcctcgtcgttcatgtagccgaccatcagcacctcgcgtgtgtcgtactgctggatgacggcggcgaccagccccttggcatcacgcttcaggcgtgcggcaatacggggatcgagttcagtggaattgtcgtatgtagtgtctgtcatacctatcttctttttgtggaccaccctcagtcagcttcgctgacagctcccggattatgtgcgacgtgcgcatagcgcattgccacgaacaattcactggattgttcgcccagcgggagcaaggtgtattcgtttagcgaacggtgtagccgtgcttcttgagttccgccttgacatcggcgatagtcaggatgccgtaatggaacacggatgcagccagcaccgcgtcggcacctgcttcgatggcgggcgggaagtcctcgaccttgccggcaccgccggaggcgatgatcggaatcttgacttccttgcgcacggcgcgaatcatctcgaggtcaaagccttccttggtgccgtcggcgtccatcgagttaagcagaatctcgccggcgccaagctgctcggcgcgcttgacccaccagatggcatcaataccggtggatttgcggccacccatcgtggtgacctcaaaaccggactgcgtatgctgctcacccttttcgcggcgggcatccacggagagcaccagcacctggttgccgaaacgatcggccacacggctgataagcgacgggtcgttgatggccgccgtgttgacaccgaccttgtctgcaccgcagcgcagcagtgagtcgacgtcctcgggcgtgcgtacgccgccgcccacagtcattgggatgaacacctgttcggcggtgcgggagaccacgtcaatcatcgtgttgcggtgggagctggatgcggtcacatccaggaaggtgatctcgtcggctccctgacggtagtattcggccgccagctccaccgggtcacccgcgtccttgaggttatcgaaatgcacacccttcaccacgcgaccggcgtcaacgtccaggcacgggatgactcgtaccgccaacgacatgcttcactcccctgttcggctttgcattacagtccttcagactacctaccgcccgttacatgcgccgcacctgtttctggaatatgagaatcatcatattgagcaccgacatggcagccgctcggcgtgagagaatggctcgtggaagttgtccgccgaatcaaggagattggcatggctgtcgaaaacagcaaggtactgatcatcgtcaacaactggggtatcgaggagaccgagctgacgcgcccgctgcgcgatctcaaggccgccggcgccaaggtgacgcttgccgccactaccttggacccgtgtgagacggtgcagcacgaccgctacgaaggtgaaacgctgaccccggacgcgcgcctgtccgacgtgcaggctgccgactacgacctgctggtggtgcccggcggcacctgcaatgtggatcgtatccgcgtcaatgaggatgcgatcacgctggcgcaggagttcgcgcacgaaggtaagccgatcgccgcgatctgccatggcgcgtggctgctggtcaacgcgggtctggtggctggcaagaccgccgcgccctgccgctatatcgccgctgatatcgagaacgcgggcggccattacgtcgacgagcagctgcacgtggacgacgccaacggcttcaagctcatcacgtcccgcaagcccgacgatctggactacttcgtgggcgcaatcaaggatgcgctgaagtagctaccgctccttggcagcgagctggccgcaggcgccgtcaatatcctgaccgcgggtgtcacgcagtgtggcggtgatgcccgcgcggtgcaggatctccaggaaccgctgttcgtcttccggcttggaggcggtccacttcgagccctcgatggggttgagcggaatcgggttgacgtgggcccagttgtcgccgtaatggttaagcctcttggccagcaactgcgcatgctcggcctggtcgttgatgccgcgcatcaacgcgtattcgatactgacgcggcgcttggaggccagccaataatcgtgcgcggcatccaacacctgcttggtattgaaacgcttgttcatcggcaccagctcgtcacgcagttcgtcgctgggggcatgcagggaaacggccagacgcacgggaatgccttcggcagtgagcttcttgatgccggggaccacgcccaccgtggatacggtgatgttgcgcgcggaaatgccgaagccttcgggaggcatggcggaaatctgtcgtacggcggacagcacggagttgtagttgcccatcggctcgcccatgcccatgaacacgatgttgctcaggcggccctctcccccggccacttcgccgtcgcgcatcatcttggcggccacacgcacctgttcgattatttcaccggtggacatgttacgggtcaggccaagcttgccggtggcgcagaacgggcagtccatgccgcagccgacctgcgaggagatgcacagcgtggtgcgggtcgggtatcgcataagcaccgattcgatgagggagccgtcgaacagcttccacaaggtcttgatggtggtgccttcgtccgccacttggcgggtcacctcggtgatgagccgcgggaaaaacgcggcggcggcctcgctgcgcttggctgccggaaaatcagtgaattcggcggcattcacatcgaaatggccaaagtaatggttggcgagctgcttgactcggaacttcggcaatccgagttcggccgctttctcgacgcgctgctcgggcgtcatatccacaaagtgcagcggcggcttaccacggcgggcatggtccttggatagcacgtcacggaaggcacctgatgtgccgccgggagtaatgccggtttccggagtgtcaggatgctgtgtggtcatgatgggttcgcttcgctctcaatatcagaaaatagtcaaacatgcaatagtaatatcagaatccaccatacggcgtgccgcatacgaatcagatggcccatgtcttagcccatagcgaacgcatattgaacgatgatttccccatatatggcatgtggcaccgtgcgatatacacacgatgccacattgttcatgcacgagacatgcgaatcacagtccggtgatccacagcaaggcgcaggtgaacggtgcactcatcaaaatggaatccacacgatccatcacaccgccgtgccccttgagcagatggcccatgtctttgataccgatatcgcgcttgagcatggaagcacacaaatcaccgaacgtgcccacggcaccgatgagaatacccgccacgatcggcacccaccaacgagtggcccatttcgaggcatcatacgtgcatgcgaatacggcaaatgcgccagccatggcgaagagcatcgagccgacaaggccctcaacggacttcttcggcgagatgcgcgggctgagcttgtgtttgccgagccaggcaccggcaaacaaaccgcccgtatcggatagggcgggtaggaacaccagcatgatggcgtgtgcaatcggatgcccattaaaagtcagtgagatgatgacgcagctggccaacaacggaatatacaacacggtaagcacggacacagccacatggctgagccgggaatgatgctgttccccgccctcatgattaaacgaggattcgaggcgcgcgctggcatccgtgttggacagtttgccggcaaccgccagagataggcggttgccgacgctgatttttgcgctggccgcgatggcgaccagaataatcgacacgatgatactcagcgacatcgtgatgagatggtacggggaatagtaggtggcaatgagggtgaaggacgagcacagccacagcataaacaccgggaggtgcaggcccacggtggcgaagtccaccctgagctcccacagcgccagaatcatgaacacgactaccagcagcacgaagaggtcgacgctgagcagcaggcacgcgacaataaggatgaccagtgccgcgcctgtggcgatggcctgcggcatgttgcggccggtcttcttgttgatctggtcgagcgtctcctcggcctcttcatggggttgttcgttgcgttccataattctccggacctggtctgaatcagacctccatgatctccttctgcttggtctccagcagagtatcgatctcgtcggtaacggacttggtgaccttgtcaagatccttcagcaggcgatcgccttcgtcctcacccatctcgccgtccttgacggccttgtcgatggtttccttggtcttacggcgaatgttgcgcacggcgaccttgccatcctcggccttgcccttggcgagcttgacgtattccttacgacgatcctcggtgagttccggcatggtcagacggatgacgttgccatcacggttcgggctgatgccgaggtcggagttgcgcagggccttttcgacggcaccggcctgggaagcgtcaaacggggtgacggacagggtgcgcggttcgggaacgccgatggaggcgacggccttaatcggggtgggggcaccatagtagtccacggtgatgccgttgagcagggccgggtttgcgcgaccggtgcggatgccggagaagttttccttggtgttttccacggtcttggccatctgttccttggcctggtcgataagagacatattcactccttgtgtgttggtgttcgtcagtgttgttcgtctatgaacgcttgattcgattgtgggcgtttgcggcttactcggccacgcgcgattcggcggtggagaccagcgtgccgatttcatcgccgacgagggcgcgggtcacgttgcccggctcttcgaggccgaagacgcggatgcgcttcttgttgtcgcgggccatggacagtgcggaggcgtccatgacggccagattgtccacgagggcgcgattgtagctcagggtttcaaaacgcttggcgttctcgtccttgcgcgggtcggcggtgtagacgccgtcgacgccgttcttacccataagtacctcgtcgcagtggatttcgagggaacgctggatggaaaccgtgtcggtggagaagtacggcatgccggcaccggcgccgaaaatcaccacgcgacccttttcaaggtgacggatggccttgagcggaatatacggctcggcgacctgtcccatggtgatggcggtctgcacgcgggtggcctgcccctcctgctccagaaagtcctgtagagcgaggcagttcatcaccgtgccgagcatacccatgtagtcgccacgggaacgatcgataccggcctgctgcagttcggcaccgcggaagaagttgccgccgccgaccacgatggccacctgcacaccctgttgtacggccggaacgatctcctcggcaatgcgacgaatcacctgggtatcgatgccgaccttgccaccaccgaatgcttcgccggacagcttgagcagaactctgcgcggattgtcgctatcagtcatattgtgcctttctcaaaaccgaaagtgcgaaattatccgtagacaagcgtatcggtttacgacgacacccctagcaacgacacccttggaatagcgaaacgccatccgattattgaataaccggatggcgtttcgttgaaattacgctaagcgcgtggagtaagccttaggctcactcctcttcgcccttgccgacctcgacacgagcgaatgcggtggcgttgccaccgacttccttgaacaggtcgccgacggtcttggacgggtccttgacgaacggctgctcaagcagcacgacttccttgaagaaagcgttgagacggccttcgacgatcttcggaacgatcttctccggcttgccctcggccagggacttctcggtggccacgcgacgctcggactcgaccacatcggccggaacgtcctcgcgggtcagccacttggcgcccatggcggagatctgcagagcagcttcgtgagccacggcggcgccggccttgtcggtggcgatcatggcgacgatgctcggcggcatctcggcggacttcttgtgagcgtagacttcgacgtgctcgccggagatcttggcgaactggccgaccttgacgtgctcaccgaacagggcggcggcctcttcgacagccagcttgacggtggtgtcgccagccttggcctcgagcagctcgtcagcggagttggcgtcggcgtccacggcgtagccgagaacttcctcggtgaactcgacgaacttcggggtcttggccacgaagtcggtctcggagttcagctcgacggcgtagccggtctcgccattggcggtctcgacgaccttggaggcgatggtgccttcctgagccttgcggccttcacgcttgccggctgcggcgatacccttggcgcggatgatttccttggcgcgggcgacgtcgccttcggcttcggtcagagccttcttgacgtcgagcatgccggcgccggtgtcttcacgaacctgcttgatcagtgcggcggtaattgctgccattgattattctccttgagaaattttgcttacccatgaacgatgggaagcgctcattcaggcacttcccatcgtagagcatcactcggccttgggggcctcggcggtttcgccctcggcggcagccggagcggcggcttcagcggaagcctcggcaggagcctcgttggtcaggagttccttctcccaagcggccatcggctgctcggcggcttcaccctcggccttgttggcgccggagcgctccagcagaccttcggcgacggcgtcagccatcaggctggtcagcagttcgatgccgcggatggcgtcatcgttggccgggatcgggtactcaacggtgtccgggtcggcgttggtgtcgacgatggcgacaaccgggatacccagcttgtgagcttcctcaacagccagggcttccttggtgatgtcgacgacgaacatcgcggacggggtgcggttcatgttgcggataccgcccagctgcttgttgagcttgtccttctcgcgctcgagcaggaggagctccttcttggtcaggccggaaccgtgcacgtcggtgaagtccatttcctcaagttccttgaggcggttgacgcgcttggagacggtctggaagttggtcagcatgccgccgagccaacgctcggagacgtagggcatgttcacgcgggtggcctggttggcgatagcttcctgagcctgcttcttggtgccgacgaagagcacggtgccgttgtgggccacggtggtcttgatgaagtcgtacgccttgtcgatcatgtcgagcgacttgaacaggttgatgatgtggatgccgttgcgctgggtgaggatgaactgcttcatcttcgggttccaacgacgggtctggtggccgaagtgcaggccagccttcagcatatcgctcatagtgatctgagccatggtattactacctttcattgtcggttcttgcctggccatgcgcacctgcgtgcagctgctccccggtttcacgagttgtgcagccgaccgacacaagccgtcgcgagcatgacgcgaatttgttgtgtgccggttgacaatattgggtggctctggacgccagcgactgcgtccgttgccgggtggcacacgagtttcgagaatagcacggagccggtactaaaaaaacaggctcccctctctgaggggagctgtcgccgtaagcgactgaggggagtcacgggcggtaccggcagaaccaccctcagtctcactacgttcgacggctcccgccagcgggagccgagtatggactacttcgcctgacgattacgcatgtagcgcagggcttcgcggcgttcttccttttccaggcgatccaaatacacgtggccgtcgaggtggtcgcattcgtgctgaagcatacggcccatcagcccggagccctcgagcacgacctcgttgccgtccaagtcgatgccacgcacgcgagcgtagtcggcacgacgggtcttataccacaagccgggcacggacagacaaccttcatcgccatactgctcgccggacttctcctcgagtacggggttcagaacgtagccgactttgccgtcgatgttgtaggagaaggccctcaggctcacgccgatctggttggcggacaggcccgctcggcccggatcgtccacggtttccaacaggtcgtcaaccaggcggcgcacggccggggtgatttccttgatctcatcgcagggggtgcgcaggactgggtcgggcacgaccctgatctcacggatggccacttctcgttactcctcgttcttctcgtcagccggccggtccggcttgctgccggtgtcagcggcattgtcggcattgtcggcggaatcgccggtctcgccctcttcgggttcggccttcgacttcttgatcttctccgacacgctagcaatcgaatcagacacgctggttttcatctgttccgaggcctgtttgacctgttcggacgcctgcttgaccgattcggaggatttcttgacggtctccagcgtgctgtcgatgatcttggcagtggcgggcagcggcttgttggatggcttgggcgcgtacagatcctcctcgatgacggtggcgtagcgctgcaataccttgggacgcaccactttcatgctcggggtgagcgtgccgtgctcctgactgaattcctcatccagcaccgcgaatttgcgcacggactcagcgcgggagacattggcgttggcctggtcgatgtactgctggataaaggcgcgcaccgcgtcgttgtcgctggcctcggcgagtgtcatgtcggcattgaggccctgaccttccagccaggaatgcagcatttcggggtcgagctcgataagtgcggacacgaacggcttgccgtcgccgactactactgcatgagccacgatcgggcaggtgtcgatgacatcctccatcggggcggggctgatgttcttgccgccggcggtgatgatgatgtccttcttgcgtccggtaatgaaggtgaagccgcggtcgtcgatacgacccagatcgccggttttgatccagccgtcggcagtcatcgtctgtgcggtgagttcgggctgcttgtagtagccaaggaacacgttcgggccggtcagctcaatttcatcgtcttcgccaagacgcacgcccatgccaggcccaggcttgccgaccgaaccgatctcgttgtcgtcctcccaattgacgagcatcggagcggcggtttcggtcatgccataaccctggatgaaggtgatgtcattcatgccgttgaaaaagtgggccaaatccacgttgagcggcgcaccaccgcaggccagccatttgaggttcggtccgagagcggaacgaatggatttgcctaccgtggccatgtagaacgaatggcgcatgcgctcgatgaacgaatggccgcgaccggcctgctcatccttgctccacttgacgaagtgcttgaccgactgggcgaagatatgcccctggatgccggcaccagccttctgcgaggccgcgttatacaccttctcgaacacacgtggcacgcccagcaggtaggtgggcttgaagctgcggatatcggcgagcagtcgcttggcgtcgggaatgtatccgaccacgccgcagccaccgatgcacacgtactggatgtagcgggcgaagcagtgcgccagcggcaggaacagcagcagacggttgtcgtcgtacagcatgccacgcagaatctcgtagccgttaagcacgatgtgcgtgtaattgcggttggagagcatcgcgcccttgggcttgccggtggaaccggaggtgtagaccacggtgagcagatcatcggctttgatacgagcgatagccgcatccaacgtctcatcggatacgccatgcccgaagtcaacgacagcgtcaaggccatcggccttgaaattgaacacgtatttcatgcccggatgattgacacggatctgctcaagcgtctgtgcgcgctggaagtcgccggcaaaggcgatggcgggatcgacttcctcgacgatgcccgcggtctgacgggcggaatcggtctcatagacgggcacaaccacagcgccgattgccgcgcaagcgaaatcagccacaccccactcatagcaggtaggcgagtaaatcagcaccatggtgccggctttgacgccaagtcccaacaggcccttggccacctcgcgtacgcgggacagcatttcagtagctgtggcgctgcgccattggtgggtgttgtcatcctgccattccgcgatgatgtcatccggcgtgcgagctgctcgtttggacagcagcgagtagacggtgtcgtcatcggtggtgacatatctgggttcttctacatgttcacgcatggtcactactataggcgaaccagcctatgacacggcagaaccgtcttccgctaccagcgtaggaatcggtgtgcgggcggggccgtctggtcagcccagatcggcatagatgcacatccatcgagaaccgatgtacttcagtttgaggttgactcgcagattttcctggccgatggtcatgaataccgccatttccagcgtgtccttgccggtgatcatgccgtcgatcaatgtggggacagtgggcagatagcagaatttcgctttgagctccggatgagtgaccatgtgggtgccgagcaggtattgcatggtttgcagccggtccaggcatggttttgtcatggctctgttgagatgtgcgacgctgagtttgccacgtatcgcgtccgccgatgtgcaggcgatgcggcatgcagccatggccatggaatgacattccttcgcattcagcccgcctatgaatgtgggttggatgtgataccgcaccgggcgatccgacagctccacaacgatgaatccgtcataactcggcaacggcccgtactgatatgtgccgtggaaaaatcccgaatactccatgatgaccccttcaagcccccttgcaactcaccatcatcggcgagcgtctgtactacaacatcacgaaaggcgcgccaagtcaaactacttgagcgcgccttcgggcaagttaagcctcctgcatggagggcaaaccccattttcagggggcaatcgggattatcgtgcggaatacgggttgaccaccatgccgcaacgctggaagttcttcacgtcgacgtagccggtggaggccatcgcgcgcttgagggcgccgatgaagttggtcttgccgtccgcctggtggctcggtccgaacagcacctgttcgagcgggccgaccgtgccgaccgtggtgcggtagccacgcggcagcgtctggtggcgggcttcggaaccccagtgggtgcccttgccgggggcctcggtggcgcgggccagcggcgcgccgagcatgaccgcgtcggcgccgagggccagggccttgacgaagctgccggagtcgcccatgccgccgtcggcgatgacctgcacgtagcggccgccggattcgtccatgtagtcgcggcgggcctcggccacgtcggcgatggcggtggccatcggggcctgcacgccgatggtctggcgggtggcggagaccgcgccgccgccgaagccgacgagcacgccggccgcgccggtgcgcatcaggtgcagggcagcggtgtagttggatgcgccgccgacgatgacaggcacgtcaaggtcgtagatgaacttcttgaggttcagcggttcctggccggaggagacgtgctcggcggagaccacagtgccgcggatcacgaacaggtccacgcccgcgtccaccacggtggagtagaactgctgggtgcgctgcggggagagcgcgccggccacggtgacaccggcggcgcgaatctcgtgcagacgttgcgtgatgagctccggcttgaccggctcggcatagatctgctggatacgctcggtggcctgatcggccggcagtccggcgatttcgtccaacagcggggtcggatcctcgtaacgggtccacagaccttccagatcgagcacgccgagcgcacccatcttgcccatggcgatggcggtggccgggctggtcaccgaatccatgggggcgccgatcaccggcacatcgaactcataggcgtcgatctgccaagaggtggagacgtcctcggggtcgcgggtgcgacgggaggggacgattgccacatcgtcgagtgcgtagccgagacggccttttttgcccaaaccgatttcaatttcctgagacatggtttccagcctattgcccgggtgggacgccaacaaggccgtttcccacggaccggacgattgcttcaagtcgttacaaacatgcgctatgactaaatcatcttcacaccatctatcaggaggaagcatggccaaaatcaaggtcgaaggcactgtcgtcgaactcgacggcgacgagatgacccgcgtgatctggaaggacatcaaggatcgtctgatcctgccgtacctcgacgtgaacctcgactactacgatctgggcatcgagcaccgcgacgagaccgatgaccaggtgaccatcgacgccgcccacgccatccagaagcaccatgtcggtgtcaagtgcgccaccatcacccccgatgaggcccgagtcaaggaattcggtctcaagaagatgtggaagtccccaacggcaccatccgcaacatcctgggcggcacgatcttccgcgagccgattgtgatgagcaacgtgcctcgtctggtgcccggctggaccaagccgatcgtcgtagcccgtcacgcattcggcgaccagtacaaggccaccgatttcaaggttccgggagccggccagctgaccgtcaccttcactccggacgatggctccgagccgattcagcacgtggtctacaactacggcgaagacggcggcgtggcccaggtgcagtacaacgtcaacgattcgatccgcggtttcgctcgcgcctgcttcaactacggcctgatgcgtcattacccggtgtacttgtccaccaagaacacgattttgaaggcctacgacggccagttcaaggacatctttgccgaggtgttcgagaccgaatacaaggacaggtacgccgaggccggcctgacttacgagcaccgcctgatcgacgacatggtggccagctccctgaagtggcacggcggttacatctgggcctgcaagaactacgatggcgatgtgcagtccgactccgtggcccagggcttcggttcgctgggcctcatgacctccgtgctcatgaccccggacggccagaccgtcgaggccgaagcggcgcacggcaccgtgacccgtcactaccgccgctggcagaagggcgagaagacctccaccaacccaatcgcatccatcttcgcgtggaccggcggccttaagcaccgcgccgatctggacggcacgcccgaagtccgtcacttcgccaagacgctggagaaggtcatcgtcgacaccgttgaaggcggtcagatgaccaaggatctggccatgctcatcggcccggacgaaccgtggctcgacaccgacggcttcatgaacgcgctggacgagaacctggccaaggctctggccgagtaaatcatcgaacacatcgtgcggacctacatgggtcatgtcatgtcgcaaactgtcatgattgtcgtgcttcatctggaatgttcctcagcacgataatcatgacagttgttcgatgcacgcacgtaatacctctaattgttcccggatatgtggcgatttgtccactggtccgggactttttcgtatacggcctactagaatcgtgattcagcttgttttcacgcccgcttgaggaggtttcgccgcttatggtgttcgcacgccgctcaaccaccctgctcgccgccattatcgcatcctgcgcgatggtgctgtcactgaccgcgtgcacctcagacaataagaccgttgtagatggtcaaaccacggtgacgtccaattctgccggcggcgtggccgtgttcacaccttcggacggcattacgctgaaccagcagacgccactgaacaaatgggcgaagctggtgcctgacctagccaaggctctggccgacgccggtttcaagaaaggcgatatcgatcatacgacgtccgactcgttggccaagcaaagccgcgccatccaagactttgtggtcgatcatctttcgaataacaccacggacgattccggcattgccatcgcgcccgacaacatgacattgctcgtggctccagtagtcgaggccgacgcttccactcgccaatacggcgattacatcagccagaacctgagcaccaacgatgccacggatggggaagctacttctgacggtgaatcttccgaagacgactcgtccaaagacgattcgtccaacactgagagcgacagcactgcatcggacgagcaggcgcaggccgtggaccggctggtctcatcgctcaagctggccaaggaatccggcatgcatgtggtattgctcggcaacagtatcgagggatataagccggacgccttcgtcaagttctcggacgcccagaccatcggcaagctacaggcggaaaagatggtgtccaaactcaagttggataaggccagtaaagacaaccccaaatacattgaggtgctgctgccatacaccgccgtggacgaaaaaggcaacgccaacgattccacgttcgcccaagaggcgttccgtggtatctggcaggtactgggcttctactatcagaagggcgttgtggaaagcccttcaggcaccttggacggcaaatccacggaaaacgattggcaagccgtggcctacgatgccgctaaggaaggctccactgcgaaagtgcttgacaagcgtctggcaaaaaccgatggacagtccacactcacccgtattgacggcatcatcacgatgaacgactacatcgcctccgaggtcgtcaaggaattggacgatctgggatacaccggctctgccgccgatatcaatccgcagatcaccatctcgggcattgtcggcaatatcaccggcaagaaggatctcagccgcgacgccgtgccggacccgatcaaatcccctgaaaacgacaacgcaaacgactcatccagttccgatgacgatgcggacgaggacacctccgcttccgacaaggaccgtgactcgcagtggcctctagtaaccggatacggcgcgtatgtctcgaacatcccatccatcgtcaatggcaagcaatggatgaccggcatggaagacagacagaccatcgccacggatatcgctcaggcctgcgccaagctcaacaaggacgaagcgctgaattccatgccttcaatcaggaactccgaggtaggcggcgtgaagaagatcccgaccatcagcgaaccgttgctggctgtcagcgccagcaatctcaagtccgcgctgatcgaccccggatatatttccttggccgatgccggtctgtgattcatactcgtcacgccgctagccgcctgcgatgtctcttccgtacggccctgttccggccgacaatcaccgttaaatcatgacggtttcagtacgatttttcgactccccgcatattgctgtggatcaagataatcggccgttcctcgcttgaggccccaatgcaggcaacggtcttcgcaatggtccgagctgccttcaacgatgcctacgggctgtctgcgggagatcgtatccccactgagagctcggtaacggccggttcgaatgtcgacgtgacacctccacgatgccgtacactcaccacatctttgccagctactttgccagcaaaactcacggtccctgcctgtggtgacagaattacggtaccttgctccgcaacaagatccactccacgatgacctggtgcccacgggttgatcggccgctcgaactgttgttcgacctgtggatcgtcgaccggccagtcgaatcgggattcgcactgattgccattgcgccacgccaaatcagacatatcggtgaaatcctccaccgtgtatgccgcatctccggtcaccgcagtatccgcatgcgcaacatgctgaggcgtggatgccagccctactcccaaggcaagcagcaggccgataacggcggccaacgcgattatggcatccatacgccgttgccgttcctgagcccgctgacgcgcctgctgacgccgccggctggcacgtcgggcttcgtcgcgacgccaatcaaacaacagtggtgcattcatgagattcctccccatagtgtgagtgtgatgtgattccggcttctttgccggtgatacccaccttgaggggtccgaaacaggatgtccagccaaaacgacctatgtggttctagcttccgaagttatccacaatgaaatttcgcgtgacagtatcgccgcatcgtcatgttgttcgaccttcagccgcggccgatccatgtcacaaccgctgccatgcagtgacagcggaacatcagaactcttgtgattgttcccactgggttcgcatactcagacggttgttccgtttcaccgattccagtatttgccaagcagacaccagctcctctaccgttagtcgctagtgtatatccgcgttcggtttttggctgtatgagatagtatccgatgagtccgattctgcggaattcagcgcgacatgccctacacgcatgtaatttgctttttcgtggcaggcatgtaagatacgtgacttgtgcgcgagagaaatctcaaacacagcagacattcctgcgtagctcagttggcagagcatccgactgttaatcggacggtcactggttcaagcccagtcgcaggagctcacctgaacgggtaactccggccgggatgaaaattgaatattcctgcgtagctcagttggcagagcatccgactgttaatcggacggtcactggttcaagcccagtcgcaggagctcacctgaacgggtaactccggccgggatgaaaattgaatattcctgcgtagctcagttggcagagcatccgactgttaatcggacggtcactggttcaagcccagtcgcaggagccatcgaaagcctcggttctccgaggcttttttattttcatcgtattggtggccagacacgacaccccatcatcaaccgggaaatccatggcgaagacctcaccactactcacatcaggcagacaggtcactgtcaattcaccgatgagaggcacggtattcccagtatcagtttgggaataccgcgcaaatcttacatcgagaccttggtcaggggcatggcggagtcaatcgggaagtcgggggcgctgggggccacgccggcttcgaccaggttcacgccgagcatggcgaccatggcaccgttgtcggtgcagagcttgatttgcgggatacggacgtcgacgccgtagttctcgccgaattcgagcagtttggcgcgcagctgcgagttggcggagaagccgccgcccacgatcagcgtgttggaatcgtactgccggcagccgcgcatggccttacgggccagcacggtggccacggaatcggccagggatgcgcacacgtcgtccaccggaatctcatggccggcggcctgctcgctttccacccaacgggccacggcggtcttgacaccggagaaactgaaatcatacgggtgcgcggcaccggccttgccttgggtcagacccatcggcaccttgatggcgtgcgggtcgccgttctgaccatggcggtcgatgtgcgggccgcccggatacgggaagccgagcaggcgggcgaccttgtcgaagcactcccccgccgcgtcatccagcgtggtgcccaccacatcgattttgcgcggcatgtcttccacgtgcagcagcgaggtgtggccgccggagacgatcagagccagcgtgtccttggggaacgggccgaactgcagctgagtgacggcgatgtgcccgatcacatggttgatgccgtaaatcggcttgttcgcagcccaggccagcgccttggcgccggacacgcccacggccaggcaaccggccagtccgggaccggcggacacggcgatggcgtccacatccgccaacgtcatgttcgcgtcgacgagcgccttggacacgcatggcacgaaggcctcggcgtgcgcgcgggaggcgatttcggggatcacgccgccgtatcgcgcgtgttcctccatggatgaggccacgacgttggagagcagttcgcggccgcgtacgatggcggctgcggtttcgtcgcaggtggattcaatacccagtacaaccggttcgctcatcgtgcttctccgttcttctccgtttgcttgctggtgatgtcttcaatgtccgccgatgccgtctgcggggcggcaaagcccacgaccctaggtttcaggtccaagctcatggtgtatgcgtcgatgccttcgggctggtagtagcgtttgcgcaatcccatgcgttcgaatccgaaccgctgatacagggccagcgcagggtcgttatccacacgcacttcgagcagcatgcgcgaggcgccctgacgtttcgcctcgtcgaccagtacctgaagcaacgcagcggcgatgccttgccgctggtatgccttgcccacgccgatggtcatgagctcggcgtcctcgccgtcgtaccagaagccggcgtagccgcggacaacagcctgttccgcctctcccagcacatccagcagatacgtgcgggccggtgcgtccagttcctctcgcaccatgttcgcattccatgcgccgcggccgaacagttcgccttccaactgtgcgatggaacgaaccgcaagatcacgacttacggcagtgatgtcaacaatcatcggaccacaacccacttcacgccttatcggcaccggcatggccgagcacgtgcttcagtgggttcggtacttcggcgtccggccggcgcaggtacaacggttcgatcggcacgacctggtcgccgcgcagttcgcggctcaacgcggtggtcgcaaagacggcgagcccggctttcccggcatccaataccgatccgtccaccacggagcccagcgcacgcagtccctgccagacggatgcgtatttggccgcgccgtggccggtcacatccaccacatagctgacgccgtcgcgttcgccgtgttccgcgagcgccgcgttcacccgttcgacgatatgctccgggtagtcgatatccatctcgatccagcgtcgttcggcggcgtcctcgtccggcaggctgatgctgccgtggttgagcgagaagtacagctgcttgcggcgcgcatcgttgacgcacagcgtgacgtggcggtcgagttcgtgttccttggcctcggcgtccgggacgtcaccatccgattggcgcgaactcaagcgcggcacgtcggccaggaaatcgatgccgtcgaacatggcgctgtcacccagcacgaagttcatcatctcgccttgcgggtcgagtacgttctgtccgacgagcttggccccggtggcgaaggccaacgccttggcggccacgatgccggcgcgcaggccggtgaatggcgccgggccgatgcccacgacgatctcctcgatatcggcaggagtcaggccggcctcctcgaccgcgcgcgcgatattgacctgcagtttctccacatgggtgcgcgaatcggtctctacaatgggctcgcgccccacaatgccgaccgtcgagccgaatgaggtgtcaatcaccaacgtgcaacccatgaatcctcctagtcgtaaagcctctagagagtgtacatcgaggagtctatgggagcatggcttattgcaggtcgaacgcggcccatcgcttgccgactgggacgaatgcgacggtacgagtgccgttgctggtgagttcgccgtctgatccagcggatgcgacatcggaggaatcgagaggtcgatcgatatggatttcaagtcgttctggtgccaaggcggtggccatttgttcgccccactccataagcaccaccgtgttctcgccggggtcttcaagttcttcgtccaatcccagcgattccagctcgtccaacaaacgcccgatggcgtcctgccccggcgcataggctgagccgcccagacggtaggcatccacatgcaccagatgagccggagtgccgtcggcgaaatgcccgtcaagttcgcgggcaatggtgaatgtaggagacacgatgggttcggtaatgtccagccccgcgccgaagccttgggcgaatgtggttttgccggcaccaagagggcctgagagcagcaatacatcgccgccgtgtaccattccggccacgcggcggccgagctcctgcatggcctcgctggtgggagccgcaatagtgtgttcgctcataaatacccctttatcgacttttaccgacctttatgactgatgtcttcaatgcagcgttccagcgcatataccgggtcgccgccgttcgttttgctttgctcatccgcccaggcgagcatacggatgcaatgcgcgagtcctgccgaagtccagccgccaagttggcgcatcgcattcttcagcacccacggattggttttcgcttcggcctgtgaaatcgtgccggcccggaccgccgaggctttggcaatggtacggagcttcatggccaacgcgccgatcagcgcgatgggatcggtcccttgttccacagctgcacgcatcatgacgatggcttctgcggttttgccttccacggccttgtctgccacggcaaaaccggtgacctgcggattggcggtcaaatactggttgacacggtcgagccccatcggattatcgtcaaagtcgaaacacaattgctcgcacatggcggcgagttcgccggttttgccgccgagcacggataccagctgctgcgcggccatcggttcgactctacgaccgcgtttctcgaattctccgagtacgaaattgagttgggcatccggtttcttcaaatccggcacgtcctctttgcgagcgccggctttcaccagttggtcgatgatcttgcgccctttgacgccgccctcgtgctggcagatcaccacgctggagccgttcggatccttggcggcctgcttggtgtacgtcaccagagcttcggcgagcttttcgtcggcattctgcaggttgacgagtttgaccacggcaacgtcggaaagcaacgatgggctgacggcttcatcgaaggcatattggtcggccgatgtggcgtcgagctcgatgagttcggcgtcgggtcgcgccttcaacgcttgtgcgcacagtgccttggtgcgcgcgtcgttcaaatacgagtcgcctccgggcaccacggttaccggtacgttcgctgctgttttcgccatgccccatctcgccacacaggttggacaatgacctgccggcataacggcccggcagcactccgcgattaggcgtatgcctcatccaacagggcgtcgatatccgcgaaacgcttgggagcgggacgccataccgggtgaccggccgcgatgaccagtgccgggtgttccaacgcgcgcaggtcgtccagcggattggcattcagcacaagcaaatcagcggatttgccgacttccaaagaaccggtctcggcatcgacgccgagaatggaggcgttgacggcagtggctgcgtgcagggcctcagccgggctgaaaccggcgtatgcgaccagcagctccagctcacgccatgtggcgtactgcggcacgaatgtcatgcctgtatcggtgccgacgcctatcatcaatccggcctcgtgcgcttgacgggcacctgaaaccatgccgccgaccacgtttttggaattctccaattggatgtcggtgatgccggtcgcgtcctgtccaagcaaggtcaggggaaggccggcggaaagtgtcggaatcaatgccgagtatccgcgcaacgcattcggattgtgccggaacatgccgatcaattcgtcgtcgagcacgctgccgtgttcgatggtatcgacgccggccagcagcgaacgccgcacgccttccgggctttgcgcgtgcgcgccgacaataacaccgtactgatgcgcctcatcgcaaatcgcccgcatctgttccacgctcatctgcgggctgccggcctcgccgatttcctgtgcatcggttacgccgccggtcgcggcgattttgatggcgttgacgccagccttgagattctgcgcgactgcggtacgcgcctcttccggggtgccgctggtcagtgcgataagcggggcgccatggccttcgggaatcgccatcagcggtccggatgccaagatacgcggtccgaggatttggcctgcatcaatctgatcgcgtaatgtcacgacttcatatcccacgtcgccaagcgtgcggatcgtcgtaacgccggattccagcaatgttgtggcgttgtgttttacggttgcggccatgtacggcttgcccaatggcgaatgcgcgaatgtggcgaccatacgttggcctttgggcgtcgccagcttcggattgagcggcttgccttgggagaacagatgggtatgcgcattgatcagccccggcatcacgattttgccggtgccgtcaagatagtggtattcggctgggatactggtttcgatgctgggtgcaacctgttcgatacgtccgtcggctccgaccacgatcgtcatgttacgcagtatggttccggctttatctccggtgacgatggtggcgtgggccaatgcgaatggttcgactatcggattatgagacaacatcatcgccggcactccttcatgcagctggttgaactggtctcaactgtatcgcagttttgccggctgatggtttatgccgcgcggcctatcgcataggttcggctggctattgcgatggttgctgcaccgaataccgcattggctattcggcttgccgccgcgtaaagagacgtctcgtctcctcgcaccagagactgaggcggacatgccaagcggaaccgaagcgcacgccaggcattccggcctcataacgacggacatgctggaggcaacggctgacgaacaccagtagcatgccgataccgatttccaccgccacaatcagcacggcacccgtaacgccgtctttccatgggatgacggccatcgtgctgccacccagccacaacgccacccgttccatcaccagcgtgccccatgacgatatccacgcgaatacgccggccagccatggctcgcaccatgcgcaggccaatgccatcaatcccgccatcgtggccaatcccacaaacggcgacaccaacaggttcgccggcacggacagcaacggcaactccggttccatcaacacctgaatcggcagggtgaacaactgcgcggccacggtcatcgccatcatttcggcgatgccgtgcggcatcgctcgctcaaaggcaccggccagccgccccgcaaacagcacgatacccagtacggcggccgaagacaaggcgaatccgtagctggccgacatatccggattcaccgccaatacaccgattaccgtccagcacagggcgctcaacgcttgcgtacgccgccccatcgcatacgtcaacgcacctatcaatcccatgatgaacgcgcgggtgaccgaatcactggggaacatcgccaatgccagcagcacatatactccagagaccagcaacgccgtcagccgccgatcaagcagcatccacatgcataaccggcgcaccaatcccgccaccagtacaaagtggccgccggatacggccatgaggtgcatgatgccggactggcggaactgattctccaacgtttgcgcatacgtgctgttgaccggcatcggaccggtctcgccgccgatataatcctggccaagcacacccatcgtcaatcccggcaccaacacacgcccctgatcggacaattgttcggtcacggtgaaaaacgcctcctgcacatgcgcaatcgcggcgagatgccacggcggagcccgcacctgtgctaccggctgttttccttccaagagcagccatagtggtatgcgtccatatcgcgcttgctgcaatacgcctgtcagcagatggaccgcgcctcgacgcaactgcccacaatacgattcgtcggcgtatacacgcacagcgaccgtggaacgtacatccgtaccatccacagtgatgccgctcagccgtatgtccgtctgacaatcgtatgtgcgttggtccgaagcgatcacgggcgtcgtcaccgtggccatgacttcgtggtatgaactggattggcgagcttgtgcggaggcaggatcatgccaggcaatggtgtccgacgcgattgccgtcatactgccgatgcacgccaccgcaacgcatacggtcaatgttcccgtccaccggatccgcaggcggaaagacaccacaatcatcgccgccacggcagcacatgacgccactgttataggcaatattcgtgtgacaggccattccatgccgattatggtgacgtcaatgccagctccggcatcggcctttgcctgaccggtgccgagtccatcagacatcctccatgcgaataatgcgtgcgctcccagactcgccgcccacatcactatggcgatcggcagcatcctccaatcgcggctcccctgctcgcgcagtatccaatccctgctcatccgaccgtcacctgccctcgcatggtctccaacgtcttggagccgatgcctttgacatccagcagctgatcgactgatgtatacccgccaatcgccgtgcgatgatcaatgatccgctgagcggtaaccggcccaatacctttgatggattgcaattcctcagcggtagccgtgttgaggttgataagaccatgcgtggaagcgccggcatcgctgccgtccgtctgcatgtgcggagattgcgtggtatccgattcggggttcgctgtggcatcggaatgctccgactgctgcggatccgtgcgtttctcgtccgtggtgttctgcgatggcatcgtctgatctccagcggagccgcccgtggtctgcatggcggtcggttgagacagcatggccatattcatcgactgttggaccagcaatgccaagctgatgccaagggcgacgatcagcagcaatatcacggccaaggcatgcccaatggtgaacgacaatcgcggctgatcccgggtgagtctggctgattcgccgacggcatcggcggaacgtacgccaatcagatccgataacgcacgtttgtcacgggtcgcctgccgcaggccgctctgcgccctttggggcgggtggccagccggacggatccgtgcatggccaggaggcggcggaggcgtcgtgggccgttccactcgcggttggggcatggctgcgctctgcctgctgaatgcgcgcaaacggttggcggcatggtctgcgcgatggttatgagaaacgcccatgcatccacgctgatggattcatgggcgtttgtccagctgaaacggggtatgtggttctagcttatgaagttatccacaattgaggtgggcggttgacgctccctcagtctcgctacgcgagccagctccctcaaagaggggagctggctcgcaacaagtcactccgcgggaacgatggagacgatcttcggggccttgacgatcaccttgcgcggctccttgccgccaagacggtcggcgacggcggccagcgcctgcttctcgagatcggccggatcgatgtcgaccggcacttcgagcttggcgcgcaccttgcccttgatctgcaccacggcggtcacggtgtcgtggcccacgtagcgttcgtcggccaccggccacggctcggcggacagggattcggcgtgaccgagcttgctccacatctcctcgcagatgtgcggggcaatcggcgcgagcatcaggatcagcggctccacggcggcacgcggcacagccttcagaccggtcaggtggttgttgagcacgatgagcttggcgatggcggtgttcgggcgcatgccttccatttccgcggtcacttcggcaatcgtgttgttgagcagcttcagggtcttttcgtccggcgtgtcctcagtcacatgggcctggccggtggtctcatcgaccacattgcgccacagacgctgcaggaagcgcatgccaccgaccacgttgcgggtgttccacgggcgagactcgtccagcgggcccatgctcatttcgtacaggcggaaggtgtcggcaccgtagttctcgtacatgtagtccggggtcacgatgttcttgagggacttgcccatcttgccgaactcgcggttggcatgttcgccgttccaggtgaaggtcggctcgccggaggcgtcggccgggccttccacgacctcgtcggccggcacgtactggccgcggtcgtcggtgtaggcgtaggcctggatcatgccctggttgaacagcttgtggaacggttcggccgagtccacgtagccgaggtcgaagagcaccttgtgccagaagcgggagtagagcaggtggagcacagcgtgttcgacgccgccgatgtacaggtccacaccgccttcatcacccgagtacttgttgtggttcgggcccatccagtagtcgaactcgtccttctccaccatgtgcttggtgtcggtcgggtcgatgtaacgcatgtagtaccagcaggagccggcccagttcggcatggtgttggtgtcgcggtagtaggtcttcttgccgtcgcccaagtcgagctcgaccttgacccagtcctcgttgcggctcaacggtgcctccgggttggactcggcgtccatcggatcgaaggtgcgcggctcatagtcgggcacgtcgggcaggttgatcggcaatgcggaatccggcagcaggtgcggggtgccgtcttcgccgtagacgatcgggaagggctcgccccagtagcgctggcgggagaacagccagtcgcgcagacggtagcttacggtgcccttgcccacgccggcggattcgagccaggcgttgaccttggcgatggcgtcgtccacgcgcaggccgttaaggctcagcgcgtcgcccttggcttcggtggcctcgacggaggagttgatcacgatgccgtcatgggagacgaacggcgccttgccctcgtagttggccaagtcgtcgccggaatccggcagaggcgtgacggtgtagatgacaggcagaccgaacttcacggcaaagtcgtaatcgcgctggtcgccaccaggcacggccataatggcaccggtgccgtagtccatcagcacgtagtcggcagtaaacagcgggagcttcgcgccggtgatcgggttggtggcgtacaggccggtgaacagaccggtcttctcaccggcctcgttcacgcggtccttggcggtcttggcttcggcggccagacggtaggccttcaccgcctcgaccgggttggcatagccgcccttccagtcttcgggtacatcggccggccattcggcgggcacgttctccagcaggtgatgttccggggaaaccacggcgaacgtggtgccgaacagcgtgtcgggacgggtggtgtagatttccatgtccttgtcaccgtcggcagtggccacggtgaagtgcacggaggcaccatgggattcaccgatccagttgcgctgcatgagcttgaccttctcaggccagttgatgccgtcaagatcggcgatgaggcggtggccgtacttggtgatgcgcatggaccactggcgtagctcacgctggaagaccgggaagttgccacgctcggacttaccttcggcggtgacctcctcgttggccagcacggtgcccagacccgggcaccagttgaccggggacttggagatgtaggccaggcggaagtcgttcaagatatcctgctgctcggcgtcagtgaggtcggaccactgcttgccgtcggactcgtggcccggaatggccttttcgccggattcgaacttggccacgagctcggcgatcgggcgtgcggagcccttggagccggacgggttggtggcgtcctcgtcgtaccaggaatcgtagatgcgcgagaagatccattgggtccagcgcacgtagccggggtcgatggtggcgaacgtacgacggttgtcgaagctcaggcccatacggtgcagctggcggctcatgttggcgatgttcgcctcagtggtcacgcgcgggtgctggccggtctggactgcgtactgttcggcaggcaggccgaaggcgtcgtaacccatggcgtgcaggacgttctcgcccttcatgcggtggtagcggctcaccacgtcggaggccaggtagcccagcgggtggccgacgtgcaggcccttgccggacgggtagggaaacatgtccatggcgaagtaggcggtgcggccttcggcgttacggcccttgccgtccttcaaatcgccgttgacgttggcggcccagaaggtgccttgctcgtcccaaatcttctgccacttgttttcgatgtcctgcgccagtgcggcgttgtagcggaagttgggctcttcggtttgcgtgctcttctcgttgtcactcataaatcagcaaggtagcctcgcaactggacacgtcgtcaatcgttattcagcatccgagacgatggctttggggtcgccgttcagcgaaaccgtgagctttgtttggcttgtgaacgtatccttggcggccgtccagctgccatcctcaaccatgtcttccaatgcttccgcgattttctgcgccaattggctggtgccttgactcacggcgatgccataaccgacctcgcccttgtccgcaatcacgtccatatactggggcccgttggccgcttgaagaccggaaagcaccgccatatcggaggctatggcatccgccgaccctacttgcacggccgtgacgcactgcgcataactgctgcgctcctgaatccgggcctgcgggtggttgccgcggaagatgccgactgtctcgtcacctttcactgcgcacaccgtgccgtcgcctacgtcacccaccgaacctgcgtcattggtgaatcggccacgctcatccgacctgaccagcaaaccgacgctggtcgtgaggtatggtccggcaaaatcaacgatcgcgctggactcatcggtgataggccaagaggcgacgaccatgtcgacctgtccattgtccagcatggagcgccggttttcggggcgaacctgtttgaagacgatctgcttgttcgcatagccgagtttggcggccacgtatttggcgatggtgatgtcgaagccctggtatgtgccgtcatgccatgctcccaccgatggctcgtcggctgcgaccccaatggcgatggtgggcccctccggcgctccggagacggtggtgacttgaatttggccgcaaccggccagaccggataatggcaatatcacgccaaaggccgcggcgaatcctgccatcagtcgggagcgaaatccgcgccgcatcggacggcgagcgcggagcatgctacggctggcgaacgatgaccagtggtgcataaccgtcaaacgccttacttgaacatgcgcgaacgcgtgaggaaccaggcaaccgcaccggagagcaccatggaaatcacgataatgagcatgaaaccccacggcttgtcagtgaacggcatacccatcatgccgccatcgaagttcatgccgtacatcgagaagatcagggtcgggatggacagtgtgatggagatgatggtgaagatgcgcatcacgttgttcaggttgttggacacgatcgaggcgaaagcgtcggtcatgttcgcaagaacgccgctgtaaatgttggccatctcgatagcctgcttgttttcggtgatgacgtcgtcgagcaggtcctcgtcgtccgggtattgcttgatgcgttgcagggtggtgagcttctccatcacgatttcgttcgatttcagcgatgtggtgaaatacaccaaagtcttgctcagctccatgagcatcacgatctcgcggttctgcatggagtggcgcagcttcagttcaagcttgtcgctttcgcggtcgatgatgcgcaggtaacgcaggtacatcgtggcgttgcggtacaggatctgcaggatgaagcgcgaacgcatgaaggtgttgaagcctcggatcgtgccttccatgaatgggtggagcacgggcgtgtcctgcatgcagacggtgatgatgaggttttcggtgacgatgatcgacagcgggatggtctcgtaccagtcgcgtccgccacgctcttccacggtgggaatgtcgacgatgatcatcgtgtaatcgtcttcgacgtctacacgtgaacgttcctcgtcatccaaaggggcacgcaggtcggccaggtcgatgccggtttgcgaggcgacggtggcgagctccacatcagtgggttcgctcaaacataaccaggagccgttttccggtttctcgatctgctccacttggccattgattgagctgaagattctcagcatgtcgtctcacccgccttccgcgctttcttactgttctatcgctgtacggttccaaaccgagattagtctagacccaccgttcgaatttgcgagcggggtttcgcatagcgaccatcaccagacgattggctgccaacttggcatgtgcggtcctcgcagatcggtcggcccgttctcccagtcggcgctgtcggcgatggcgggagccttgttgtattcctccaactcccacaggggctgttcgatgggggtgccgttgacgctgtggcgcactttgagccggcaccaacaggcgttgcgcatgccgccgagtgcgttcatgccgtccgggtcaagttcgagcaggttggagatggtggcggtaatccatgagccatgggtgacgagcatcagcgtggtgggcgtgctgtctgaataggcggagtcgatgaccagtgcgcgcacggcatcggcacctcgctgccccacggcggcacggctttccacaccatgcttggtttcgcccccagtgtgctgtttccaagaggcgtagtcgtcggctgccacggctttgatttcggcgcgggtcatgccttcccactcgccgaagctgcgttcacgcagtcgttggtcacaggtgactggcaatcccaaaatatcggcgaaggcgtgtgcggtctgttgggcacggaacaggtcggaggtcatcaccaccatgcgccggccagcggcgggagcctcctcgaactggcgcgtatcagtgcgttcggcggcgtcaggaccgggctgggcgatggcttcgggatgctcggcaagtcggttcaccttggcccagtaataccgtgaagcgagcgcgaatccggtctggtcaacctgccattggcctacgatgtcgagcggcacatcgatctggccttgcaagcgatgttcgagattgtattgcgtacggccatgacgcagcatcatcacttcatcgatcatcggttttcaccacctcgttctcttgcggtttgccatactcatctcagcacaacccctagaatggcggcatggagatttctgagtcgacttgggcgttcatcgccaaacaccgccgtgaagatgtgcgtgatgtggccttgcacgccaagcatgatggcgacgtggatgtgccgttcgcgctggagcaaattgccggctggcagcgcgcttcactcaagctacctgactgggcgtcccatgatgggctgattttcccgccgcaagtcccaatggaacaatgttccagccaattcaccgcacagtacaaggctcggctggtacagcgattgttggccgaagaagcagtcgacgacgactccccgacatccctagtcgatctgaccggcggtttcggcgtcgacttttcttacatgtcccgagtgttcaatcgtgccatatatgtggaacaacaatccattttatgtgatatcgctcgccataatttcccgatactcggccttgaccacgccgaagtcatcaatgatgattcaacagcagtgcttgacacgcttggccgagtctccatgatcttcctcgatccggcccgccgtgacgatcatggctcgcgtacctacgcgattgccgattgcatgccggatgtgctgaccctgaaggatatgctgctggccaaggcaccgacggtcatggtcaagctctcccccatgctcgactggcataagaccgtcgccgatttcgccggcgcggtacatgaggtgcatatcgtctccaccgggaatgagtgcaaggaattgttgctggtgttggggcgcggccgttacgcctcaccgctcgtggtatgtgctaatgacgagcaggtgctgtcgtacaaggccggcgataacagcgacaatcacaccactatcagcgattctgccttggctgcacgcaatacttgcaataccgaagattccctgtctgaggaaagcgcgaacgacttcgattcctcgcattggaagtacctttacgagcccaacgcctcaatcatgaaggccggatgctttgatgttctcgaacagcgcttcgccgtgcatcacatcagcccgaatagccacctgttcgtggcggccgaacctattgccgattttccaggcaggtcattcgccatcgaatccatcgccaccatgaacaagaaagaactgaaacagctattggccggcctcacgcacgccaacatcgccgtacgcaatttccccctaaccgtggcccagctgcgcaaaaaactcaaactcaaggacggtggtagcacctacctcttcgccaccaccgacgcccaaggccgtcacctagtactgcgcactaaaaagcgaaaaagtggctccctctgacgaggaagccatcaatacgtcagctaatcagtccttggcgatggtcttgccggcggtcggaccggaggcaaggtcctggatctcggtgacttcgagaaccggaatcacggccggcttcttggtgcccttttcctcggcgaccttgacctgctcgttgtagatgtcgtcgtcaacgtgcagcaccacgttgccgcggaagcggtagccctgcttcttctcgaggttggcgaaagcgatgaccagcggggaaccgttcttgaggttctcatagtgctggccggcggtgcgctcgtggtaggcgatgtgcgtgtcgtccagcacgaacagggacatcttcgggccgaggtccagttcgccgtccttggagacggtggtgatccagccaaggttgttcttgatgaattccttgatttccggagtaatgactgccatgtcgaatcctttcatgattgatacggataacgtatccttactctttccagagtaccggtttcgaacgcgactagcccggatgttcgctgtgagtaacctcaccttcgcacagctttcatccggtttttgcctgcttggcgatgccatgccccggtcgcgcaccagccacacacctgtcacacacccgacacccatcgaccggtcgattttggccggtagttcccgtaatctgtgagccgagagagccacaagttttcctaactgtcctgaggtgcaccatgggtttggtcgaacgtttcagcaagctgcgcagccgctggtcccgcaactttcccccgaatctcgcccgactcatgttgctgggctgcgctgcattatggggtggcagctatctgctcgccaaattcgccatggaggcgattccgccccaatggctgatgggtctgcgcatgatcggcgcctgcctgtgcatgctggccttgttccataagcacatcgtgccgtatctgacgccgaaaatcattgtgccggcgctcgtggtgggcctgacctactggggcacgatggtcacccagaccatcggcctgcagaccattgaaccgggccgcagcgcgttcctgacggccgcctactgcgtactcaccccgttcgccacgtggattatttcaaaaaaccgcccgaaggccatcaatctggtcgccggcgtgatctgtctgatcggcgtcggcttcgtctcgctgaagccgggcggttcgctgtcgctgagtgccggcgactggctgaccatcgccaccgcggtcatcttctcgttcaatctgacctgccttggtgtctacaccaaacgcttcgaccctatcgccgtcacttttgtgcagttcggcgttgccggcgtattgttcatcatcggcgcgttgttcaccgaacccatgccgaacgccagctggctggcaccctcagtagtggccagcgtgctctatctgttcctcggcgccacgatgagtgcccagatcatgcagaacatcggtctggctcacgtgcctgcctcgcaggcgtcaatcatcatgtgtacggaaagtctgttcgctgtcacgttctccgcgctgttctggggcgagacaatcatgtggagttcactggtgggctttgcgctgatcttcgtcgccgtgctgatgtcggtaatcaagccgaccaaacagtcgctgcaccggaactgacgattcagtttcggccatggatggtcatgggttctccattgccctgaaccgttacggtgaaggccgaggctcttgaaggcgtgcaatcggaaatcggacttggcatcgccaaactgcatttcgagttgggtgccggcaacggcagcttcgcttgggctgcatgacgttctgctgaacgtcgttttcgctccaagcgaaccaatttcggttgttctttgcgctactttgcgccactttgcgctgattcccactgctcatcggcaccatatttttgagtcattccacattccgctggctaggttttgaaggtctcgtgtaggcatcctctcggtatcaccgagccttaagcaaccttccagcccgacactttacggtcgtgtcttgtgaagaagtttttcgaaggtctttccctctcatccatcgtggcgggcacccttgccgccgtcacctcattcttactggcatcgaaaatcggtatcgccggctcggtaatcggcgcggcagccagctacatcgtctccgcggtggccaccaaaatctatcaaaacatactcaccgcctccggtgagaaactacagtcggcctcgtcttccggcaatgacgatgacactacggataataagtccgataaggcagccgaatccgagtccgatacgacgatgaccggcatggtcaataccgtttccaccgcgcgcaagccgcgcgaagtcgtgtccaatcgagcgaacggacgaacctattcggtcaatgaactgcgcaaggcccgctcccataattcgaagcgcaccgccattatcgtcacgctggtatccggcctgctcgccgtggcagtaaccgccggcatcgtcatgctagtcacgcagggccgtggcacggaccatatcatcactccgtccaccacgcccacgcaaaccgacaccaaaacgcagaccgacacgtccaatcagaataacggactgccgcagccgggcattaccgacggttcgaatgattccaacaccaaggactccacatccggctcgtccaacgacggcaccgattcaagcacgtccggctcaaccggcaccgactcctcaaccgattccaacaccaatggatccaccgatggttcgaccggcaccgattcctccactaattcgggcacgactggcggttccaccggttccggcaccaccggaggcaccaccggcaccggcaacggttcaaccggatcgggttcaggatcagccaatggctccggttcctcttccagctccacgggcggatcatccagttcaaactccggtaatagcggttcgagcggctcctcaaccggtagcagcagcggaaccggcatcaaattcattggctgacaatcgccgactcgatagcagcgatggcggcaatgccagtcaatgacgtggggcaatgagaacatggaacgtatgactaccatcattatgaatacctctgagggcagcatcaccatcaacctgttcgacgacaaggctccgaacaccgtggccaacttcctgggcctcgccactggcgagaaggaatgggcggacccgtacaccggccagccttcccacggcaagttctacaacggcctgatcttccaccgtatcatcaagcagttcatgattcagggcggttgcccgctgggcaccggtaccggcggccctggctacgagttcgacgatgagatcgacccgagcctgaagttcgacaagccgtacctgttggctatggccaacgccggtctgcgtcgcggcatggacggtaaggtccatggcaccaacggctcccagttcttcatcaccaccgtgccgaccccgtggctggacggtcaccacaccatcttcggtgaggtcgccgatgacgactccaagaaggtcgtcgataagctcgaagcactggacaccgatccgatggatcgcccgctcgagccggccgtgattctgtccgtggacgtggcggagtaagaccgacaacatatacgaaaaggtcctgattctgaaccgcaccccgattgttggactgaagtaattcagattcgatgatcggaggtgcggtttctcatgtgtagggatcgcaggcgtcattacgatgacggtttcatgcgggtcgtcgccgacctgatccggggcggggccgggaggcgttctctcgcccgccggcttggcgcgcccgtcagtaccgcgggaaaatgggtgttgtcataccggtttggcggggaggcggcgctcatgggagaacgcgaaggcaacaggagatacgactacgagacgaagctcgcggcggtgcgcgaccatgtggagcatgggctgacgaaggccgaagtcatggagaagtacaggatcgcgggtcccgccccgttggagcgctggtgccgcgagtaccggtccggcggcccggacgcgctgcgtccgaaaccgaagggcaggcccaggggcgcgaaatccaagccgaggccggctcccacaagggaacagctccttgaggaggagaacgcgtacctcaaggcgagggtcgcgtacctggaaaaagtcgacgccctgctggcgcggagatcggcaaccgggacagaacggtgatcgtctccatgctggcggggccgggacatcggctccggcacctgctcagggcggccggactggcgaaaagcacgtattaccatcttctgtcgcatccggccgccgtgacccggccggacatcgagccgatggtcgccgagatattcgcgcgcacgcccaacgggtgcggccaccggcagatacgcatgtgcctcgtgcacgagttcggggtgcgggtgagccacaagagcgtgctgaaggtcatgaggcgcatgggcctggaatgccggatacgcaggccgaacccgtaccggaaatacagctcgtaccgggacgagacgggcgcgagggcggagaacctgctgaaccgcgacttcacggccgaccggccgtgggtgaagctgggcacggacgtcaccgagttcagggtcgccgacggcaaggcgtatccggctcccgtatacgatatgggatccaaggagatcgtggcctgggacgtcagccggcatcccgacatggcccagcagcggcgcctgctcgccatgctcgaggagaagctgcccgaagacgccgacccgatcccgcactccgattaagccgggtttgttgttaagccggggaacggttcggggtcttggtggctggccgtgtcccatgtggtttcccggcttaacgttccgggttatgttcgtcttgtcccatttgattcgaacgaaggagtttgccatgggtgagacgacggttggccatgtcgcgggcgaggtggtccgcgcgctttacggggccggttatatggaatccaccataggccagtaccgcaagtccatcagggcgttggaacggtacgccggaggcccggatgcggtgtacacgcgtgggttgggcgcggggttcgccgcgtcgaccttcagtgagcggacgggcggtttcagcaggcagcggtggttcgattacggcaggctggcgcgtttgtgcgactcgtatctgcggtccggttcggtggacctgggcaagtggcgcaggagcaggcttgcggagccggtggttccgggtttggccgtggtcatggagcgttgggaggcgtatctcgccggttcgggactggcttcggcgacggtggggcattaccgtcggatggcgggcttgttcctcacgtggctggaatctcatggggtcgtgtcgttggacggttcggatggctcgcatgtgctggggttcctggccgggctgcgttcacgctggtcggagtcgtcgatgcggcacgccgcgtcggacctgcgcccgttgttcagatggctcgggcgggatgacctggcggacgcgatcggcctggccggcatacgcaggacccacgcgatcgcgggaacgttgcccgacgacgagcaccgccgcttgctggaggcgtgcgcctcgcggtcggtgccgtcgagggacgcggcgatcaccctgctgtcgctgacgtgcgggctgagggcatgcgatgtgatcggtctgaggatcgccgacgtggattgggattccatgagcataggtctggtgcagcgaaagacgggcaatccgttgaccgtgccgatgacgggaccgctggccgcgaggctggcgtcctggctgttggacgaaaggcccgccaccgacgacgaccgtgtgttcgtgcggtacaaggcgccccatgtcgcgcttcggggtcattcatcggtgtacgaggcgatcagccgtgtcatgcggcacgccgggctcggacgccggggcggttccaggctgttgcggcgcaacgcggcgacgaggatgctggaggcggccacgccgttgccgacgatcagcgcggtgcttggccacgccgaccccgattccacacgcgtctacatggccacgcaccgcgggggaatgctcgcgtgcgtgctgcccgtgccggaaggcggatcgtcatgagacccacggaacacggattcgtcggcccgctcgccggcgaattggaggagtacatccgtttcaaggcgtccatgggcaggcatggcgccacccgcgtccaggtcctgcgctcgttcgaccggcattgcctcgaacacggggccgtgcgtctggagcggggcgtcgtggagcgatggatcgcccataggatcgacgcgaatcccgggggttgccgctcgtggttctcgtacatcagggacttcggcaggtggatgcgactggcccacgatcccgacgcgtacgtgctctccgaccagtggaaggccggatccccgcgtccgacgccgtacctgctgacggaccgcgaggccgccctgttcctgcgggccgcgggaacgttggagtctccgtcgccgtgggcgtggcagtctcgcgcgttcttcatgctcatggcctgctgcgggctgcgcacccgagaggtcaggagactcgccgtcgggcacgtcgaccacaaggcccgttccatcgacgtggtcgattccaaggccggtcgcagccgcaggctgcccgtgggcgacgaggtcgccgccgaactgctggaatgcgaccaacggtcccgcgaacgcttcggagacgaccgtcccgcgttcttcgtcacctccaccggcaatccggtctccccgggcatgcccggcgtggtgttccgccgcgtctggacgcgggccgggctcgagtggccacaagccggcaaacggcccaggccctatgatttccggcaccggttcgcgttcgcgaacatcgagcggtggactcgcgacggcgtggacgtgatggcgatgctgccctatctggcggcctacatgggacacgccggcatcgacagcaccctctactacgtgcacgccagcctcgatttcatggacggatacgcggacctcgtcgccgacgccgaacgcgtggtcccggaaacggaggaaccatgagcaaggcaaggaaaacggccgccagctccggtgaaccggacttctggcgagtcgcgcgcgactggctgcaccactggctgcccaaggtgcggggcagctcgccgaagaccgtcgaggcgtaccgcatcggcctggaatcctacgtccgatggctcgaaaccacggaaggcacgcagcgcagccacatcggtttcgggcatttcgaccgggcgcgcctgggccggtgggtcgaatggatgcggaccgagcgcgggtactcggaccgcaccatcatgctgaggatgacgacgatgcgcgtgttcctcgaccacgcgggcctcgaacacccggcattgaccgcgctgggcaacgacgcggccggcatacgtgtcaaaccacccgcgcgcaaacccgtcgaccacctcggggaggagcacaccaaagcgttgctgaccgcatggggcaccggcgacgccaaatcgcgcaggaaccgcatgctcctgatcctcatgtacgacaccgccgccaggatcggcgaactcgccgcactgaccatcgcggacgtgggtatggataagccggccagggtcacgctcaccggcaaacgcggcaagagccgggtcgtgcccctgggagaaaggacacgaacccacctggccgcctacctcgaggaattccatcccggaccgtccatgcgcgacggcgacgggccgttgttccactcgacgaggaacggcgccatccagccgctctccgtggaccggatcgacgagatcctcaaaaccgcggcggccagagcacgccgcgggacgtgcccgtccatgcccgaacgcgtccactgccacctgatccgccggacccgcgccatggacctctaccaacagggcgtgccgctaccgctcatcatgcaactgctcggccacgaaagcatgagcacaaccagcgcgttctacgcgttcgcgaccctcgacatgatgcgcaaagccgtcgatgcggccaaccccggccccgacccctccaaggagacatggctcagcgagcaacgactccgacaactacacaccctcaaataacccggaacgttaagccgggaaaccacatgggacacggccagccaccaagaccccgaaccgttccccggcttaacaacaaacccggcttaatcactgttaaaccgatgtcggtttaacagtgacatgggctggcagtaccggcaccggtggtggcgcgaccggctcgcgggactgaacatccgccagtccatgagcaggaagggcaactgcatcgacaacgccgcgaccgagcaggtgttcggccacctcaaggacgagttccacgccggacgcgagttcgcctcatacgaacagttcaagaacgaactggacgcgtacatcatccactggaacaccaaacgccgccagatacgactggagggacacaccccggaggaattccggaacatgtcccccacagcctaatcaggtacccttaataaaccacgtccaacaatcggggcgcagttcaggtattccagtcaggaccttttcgtgttcttggctcccctctctgagagggagccagagtaaggtaacggcctacttcatcttgcgcagtcgaggttcggcggattccttggcaccagtgatgcggtacacgtcgaacacgccatcaatcttgcacacggctgccagcaacgagttgagatgctgcggatcggccatttcgaagctgaactggctggtggccacgcgatcggaaccggtggcgatcgtaccggaaatgatgttcacgccatggtcggaaagcacacgtgtcacgtccgaaagcaggtttcgtcgatccagcgcctcgacctgaatcttgaccatgaacaggcccttggtgctggtccattcgacttcgaccacacgctcaggctgcttgtttttcagatcgatcatgttctggcagtcggtgcggtgcacggatacgccctgattacgggtgatgaagccgatgatattgtcaccgggcaccggcatgcagcaacgggccagcttgatccacacatcgcccacgcccttgacggacacgccggtggagctgctggaggccttgcgttccatgggcttcagcggcaggacttcctgctcgacttcctcatcgacctcgtcggcacccgcatccttgaccagatgcgagatgacgttctgcgtggagacctgtccgtcaccaatggcggcgaacacggcgtccgcgttcgggaagttaaggtcgtcggccacacccaccagtgcttcgggcgtaagcaatgtgttgaccggcagattgcgcttgcgcatcgcgcgggtcagctcgtcacggccctcctcgatggcttcagtacgacgctccttggagaaccactgacgaatcttgttgcgggccttcgggctcttgacgaagctcagccaatcgcgtgacgggccggctgtatcggatttggacgtcagaatttcgacggtatcgccattatcgagcgtggtgtcgagcggcaccaaacgaccgttgacgcgcgcgcccatcgtacggtggcccacttcggtgtgcacggcgtacgcgaagtcgaccggcgtggcgtgagcgggcagggatacgattttgcctttcggcgtgaacacgtagacttcggacgagccaaggtcttccttgagcgagcccaagaattcgttggaatcaggggtttcgctggtccagtcggcgagctgctgaatccatttgaggttatcgacctcggaaagctcctgattgttttcatcacgctttcgatcggacttgtccggcgagctcagggcgcggccggcctggccgttttccttgtatttccagtgcgcggcgatgccgaattcggcgcggcggtgcatgtcccaagtgcgaatctggatttcgaccggcttgccaccggggcccaccaccgtggtgtgcagcgactggtacatgttgagcttcggcatggcgatgtagtccttgaatcggccgggaaccgggttccaccgcgcatgcacggcaccaagcgccgcatagcagtcctgaatggtgtcgacgatgatgcgcacaccgaccaaatcgtagatgttcgcgaaatcatggccgcgcacgatcatcttctggtagatggagaagtaatccttcgggcgtccggtgacgtatgccttgatgttctgctcgtcgagatcctcgttgatctccgccagaatctgcttcaggtacacatcgcgctggccggctcggcgagccaccagtaccacgatctcgttgtagatcttcgggtagagcaccttgaagctcagttcctcgagctccgtcttgatggcgttcataccgagtcggttggccaaaggtgcgtacacgtcaagggtttcacgcgccttcttctgggcggacgtggtcttcacatagcgccaggtgcgagcgttgtgtacgcggtcggcgagcttgaccaccaaggtacgcacgtcgcggctcatggccaccacgagtttgcgaatggtttcggcttgggcggaatcacccacttcaagctgactcagcttggtaacgccatcgaccagaccggccacggtgtcgccgaattcggcgcggcattgatccaacgtatagtcggtgtcttccaccgtgtcgtgcaacaggccggctgccaccacgatcgggcccatgcccagatccgcgagaatctgggaaacggccagcgggtggatgatgtacggctcgccagacttgcggcgctgggcggagtgctggatgacagcacgccggtaggcacggtcaagaatggacaaatcctcatcggggtgatgggacttgcacaccttcttgattggatccagcggattgagcggatcggcactgatctcacaacccaacttacgggcggcgtactgctcgccatcaatctctgccatgccagtcacctccctcgtcatgaagttcattgtagccgcgaaccggagccttgtgcattcacctgttcgccatcattggttccacaaccgttgttgccgtcatcaccttagtcattcaaccggcctaatccggtcaggacgccactcccgtcgaaccgaacccgcgttcggcgcgatcggatccgggcagtgtctcggccgggatgaaccgagcctcaacataccgctgaatcaccaattgagcgatgcgatcgcccggatggaagacggcggtgtgcttcggatcgaggttgatcagaggcaccttgatctcgccacggtagccggcatcaacggtgccaggcgcgttgagcacggtgacgccctgcttggcggccagcccggaacgcggatgcaccaacgccacgtagcccgcaggtagggcgatggccacgccggtgggaaccagtgcccgttcaaaaggcttcagcgtcacatcgacggtggtgatgaggtcggcaccggcatcgcccgcgtgggcatagtgcagctgggccggatgttcggggtcgaggctcttgaccaggacctcggtggattcgggctcgttgtaggtctcgtcgaacgccatcaggcggcgcactcctcacacaccggctggccatcctcgtccgtgtaggcgagctggctgcgatgcttgaccaggaagcactgcgagcagatgaactcgtcaccctgcatggggatgacggtcaccgaggaatcctcgttgctcaaatcggcgcccggcagttcgtagtcttcggcgatggcgttctcatcgtcgtcgatgtcgctcgaggcgttctgcgaggacttccccagcgcctgcagcgattcctcgtcctcatccttgttgcggggggaatcataatcctgagccatcatggtcctttcgtcgtctttggttcgtaagtcgatatatatagcacggtcagcgccgtactcgcccataggatacacgatttgaaatactcgtaaagttcgacacgtggggcatacttaaaagaagtaatgtctttgcgacggaaagtggtgcgaatatgccagatgatcggcttgaaaaagcccgtttcgtgcgcgtgagcaagacggggacctcgtattctcccttggcggcagggaaatggctgtgagcgtggacgacacgctcgaacgggcgattcttgaggccaagcaggtcagaagcgagatgcgacaggctccccagccgcatcagcagtccactttgccgatttcccagatacagtcgctgattcgcgccggtgccgatccggcccgtgtcgcggagaaatatcatctgagcgaaatgctggtacgtcgtttctccatggctgtggagaccgagaaacagtatgccatcgaacagttccttgccgtggcggcacccaaagacagcagggtgcgcaccatcagcgaactggtggaacgcacgctggcctctgcgggaatcggcatggaatcagtgacctggaaatccacccgacgtggacttgagccttggcgcatcgtggcgatattcacttccgcgggccgtgagatccatgccgaatggacgtggaatatgcacgacaattccgtgatgagcctgaacaatgccgctcgaaaactgctcggcgaacagaatccggaatcagccacggattccaaactcaagccgacgattcccgaactgcccggcgactccgtacgctccgcgcgtatcgagcgcgccgtgtctgcttgggcggctcctacgccttcgattccggccgcacggcctgccgcaatccggccctctgtcacttccacaggttccatgcccccagtggatctatccacgtccatctcaccggccacgacccaggctcatggcactacggcccccagtccggtctcttcgcagaccgccggatctgtttcgccatctgccgcaggattacagcaatcgcctgccacggcaccagagcagggctctgacaatgtttcggacaagaccatacggagtggccccaatgcacagctagtagccaccgagcaggagcgggcggccgaatccgccgccaccgaacatgaggcaccagccaaaccggccaagcgtaaatcaggacgttcggccgtaccaagctgggacgagattctgttcggagactgaatttccgaatcaggccatatcgatcaggcagggaatatccatttccaatgctgtttgggagccatgcacgctcggcaggtgggtggccttgtctccttgcgtacgcgaatcgacgagggtcacggctcccgctgcctgcacgaccacatcgccgagcattggccggactcgctcgcagaccggtccaaacaatccgtccgcgatggcctcatccttggtccgcaccaaggctcggtcttgcagacaatcgcgccaccggcaagctatatcctcaggtcgttcatccggctcggcatacagcatcagcgagcgcggctccccccgaccagtgacacgcctcgggtgagctgcggttcaacggcgatgtcaatccgctggtccatgtcggtttgcaccatgccgtggtcggctacgatgacgatcagcgtgcctttgggtgcgctgcgtttcaggagcgcgagctgggcgtcgatatgttcgaatgcggccacccagtgttcggaatcccacccgtaattgtggccgactttgtcggcgtcacggatgtacaggtaggtcaggccgggggtgcgggaggcgcgtgcggcggccagcacacgatcgcgtggggtgacgttgccttgatagtcggtgcctcgcaatgcggcttcggtcaatggcgatttggagaacttgggcaaccccgagctcgtgacgcgcacctcttgagccgcaagtttctcgaacaccgtctcctcgcgctgcaggtcgagcggatcgaccatgggcggcacaggaatgtgcggattggctggtttgggtgccagcgcgtctttgaactggatgagttggatgagcttatggctggcgggttcgagctgcgtatagcccgccattgcggtcagtcccgggcaggttccggtaccgaatgcggccatggccgccacagtggtgcttggagcgcaggtagcgatgggacgctgattggcgctttcgttcatcagcgaacgcagatagggcgcgtggccgaggcgcatggcgaggttccagtagcccaggccgtccacgagcaccacgatggccgattcggcatcgggcagccccaacgcgcgctggcatgccttgggatcggcgtggaccttggtgggggccggatgtccgatggcggcggacaaggcgggcagcacggcggacaggtgcagtgctcccccacgccgatcggccggggcgtcatccccatagcccactgtgggcaccagccgcagcaactcgtccatatccggcgtctcaacactcatagttgcccattcaagtagcacccctccccttggctcagtgcgcagagaacggttctcaataacaactgtgcgctccaacgcacataatcaaacaaacgcacatcgactgaaacactggaatcacgccgttttatcggcaaacatgtgcgattggcgcaccgaaaccagcgcacagttgttatcgagaaccgttctctgcgcactgtttcgcgccctcccgctaatatgggggcgttcgaaagggagtttcatggcatcacaccgcaaaccgtccgcgcaaacctatgatccgcgcacggtcaaggagcatatcgtcgagacgccgctgaacgaggagatgagcaagtccttcctcgagtatgcgtattcggtgatttacgcacgcgcactgcccgatgcgcgcgatggcttgaagccggtgcagcgccgcatcgtctaccagatgggcgagatgaatctgactcccgaccgcccgtatatgaagtccgcccgcgtggtgggcgaggtgatgggcaagctccacccgcacggtgattccgcgatctacgaggccatggtgcgtttggcacagccgttcgcgatgcgtctgccgctggtagacggccacggcaacttcggctcgctggatgacggccctgcggcctcccgttacaccgaggccaggcttggcccggccgctctcggcatgaacgcggatatcgatgaggacaccgtcgacttcacgccgaactatgacaacaagctcaaggaaccgaccgtgctgccggccgccatcccgaatctgctggtcaacggcggctcgggcatcgccgtgggcatggccacgaacctggccacccacaatctgggcgaggtggtaaacgccgccaagttcctcatggcgcattcggacgccaccctggaacagctgatgcgttacgtgcccggccccgactggcccaccggcggcacgatcatcggccgcgacggcatccgtgaggcctatgccactggccgtggtacgctcaccacgcgcgccgccacgcatatcgagcatgtcacggcccgcaagcaggccatcgtggtcaccgagctgccgtacatggtgggcccggagaaggtaatcgaacgtatttccgacggtgtgaagaaccgcaagctggaggggatttccggcgcgttcgatctgaccgatcgtcataacggcacgcgtatcgtcatcgagatcaagactggtttcgacccgcatgcggttctggtgcagttgttcaagcacacaccgttgcaagacaacttcgccatgaacaacgtggcgttggtggagggccgcccgcacacgatgggtctgaaggagatgcttcaggtgtgggtggaccaccgccgtgtggtgattcgccgccgcagtgaatatcgcaagaagaaggcgctggagcgcctgcacctggtcgagggcctgctgctggccatgttggacatcgacgaggtgattcaggtaatccgcacctcggatgatgcggatgccgcgaagagccgtttgatggtcgttttcgatttggacgaggtccaggctcagtacatcctcgacctgcgtctgcgccgactgaccaagatgaaccgtatcgagcttgaggccgaacgcgatgatctgaagaagcgtatcgaggagctgacccggatcctggcctccgccgaggcgctcgaccaggtggtcaccgacgagatggacgaagcggtcgccaagtggggctcgccgcgccgtaccgtgctgctggatgccgacccggatggcacgttgacgccggtcgtggcgcagggtgccggggcttcgggcgtgtccaagtccgcgctcgaagcggtgaaggccgccactacgatctcctccgccgaagccgatgtggccgcagccgcagctgcggccaagaagaccggcgaacagtccacgctgaccggagccttgaagatcgaggacgagccgtgcgtggtgatgatgagcgctaccggtttgattgcccgtaccacgccaagcgcgatggacgtgttcaatgcacgatccacttccgatgagcgtttgagagacgatcagatcaccacaatcttcgagacttccacgcgcgctacgtatgggctggtcacgtcggccggccgcctggtgctcgcgcatgtggttgatttgcctgccttgcccgctaccgccacattgtcgctgaagggaggagttcaggccgacgaactgatcggcatgaccgaatccaccgatccgattcgcggtgagcgtgtgattacggcgattgccatggagcagccgacgtccggcaagaccagtgccaaggacgagagcgaggatggcggggccgccgaggccaagccgttgccgtcgctggctatcggtacccgtaacggtgtcatcaagcgttggaatcgtgaggcacccaccaccatggattcttggcccgtcattgatctgaaagatggcgacgaagtggtattcgccgccgtggccgaggatgacgaccgtctggtgttcatctcctccgattcctcgctactgacctttgaggcgaagaacgtgcgcccgcagggtcgtactgcgggcggtatggccggcatcaagctggccgagggcgcccgtgtggcggccttcaacgtggttcccgccggcaaggtggcatggacctatgaagagggcgagaacggcttgacttccggatccggtgcagtggtgctcaccgtggccggcgattccgatgcactgcccggcaccgaaaacggcgcggcgaaggtcactccgctggaaatgtaccccaccaagggtcgcgctaccggcggcgtgcgttcccagcgattcctgaagggccagaacacgctgattcttgcctgggtgggcctctacccgttgcacgcctctacatccgcaggctctccggtcgagcttcccaagcccgatatgcgccgagacggttccggagtagacctcgcctcccccatcgccttcattgcgtaacctcaattaagctccctctgatgggccgagccgtaaagcaaacaccccagtggggtgtttgtaggcgaggagcgaacgatagtgagccaaacaatagagaagagaccctaaacccggcctacactaagcattaaggaggtggcgatgagactactggttgccgtatccaatgaaccgttggcccacgccattcatggtgccctgcttgccggtcgtcatgaggtgtctttggcaagcaccggtagtatcgcgctcgccgctgtcgccaaggagtcatttgacgcagtgattctcgatgaatccctgctcggcatctccaccgagcagctcatcgaatccctacgcaatgcccgtgcctccgtcaagattctgctgctgacttcgacgccactcagcaaaaccattggtgaaggcagccgctggcgagcgctgcctgacgagtacgcccctatcgaagagacgccctacagctccttcagcgcgaattcacgcacaaacaactcagatgccgaagccgaacaacgctcggacaatgctgcctctagcgcacaagctaacgtacgacgcccagatgccgcgctgagcaaaccattctccgatggcgaactgctctcatacgtcggctcgcttgccaccgactcccccgccatgatcattcgtggcaatctcacgttggacaccacgaatcacaaggcctactacgcatccactcacagcgcaatctcactgtcccgtctggaatacagtttgcttgaagcgctggtcaaggctgatggccagttcgtcaacaccagcgagttggtcaaacttgtcggcggcccattcttcgagcaacagggcttactcaagaacgccctctacacactggataagaagctcacccgcgccggcctcatcatgacccaacgaggctccaactaccgcattcgatagctgggctcaatcagtacagccgcatgccttggggaacgggggtgaagccggactggtggaggatgcgggcgaaggggtgacgggcgttgaggggttcgccattgatgtcgctgaatgtcacggagccggtgccattgcgtttgagggcgtaggccagttctgtggcggccttgcgcatttgttcgtcggaatcattgacagcggcttcatggccgaccgattgatcgaacgctgtcaggtgcttggctttggcggccgcgtatagtagcgcgccttgcgcattgagcacgaccgtggctccgatacggcgtgccggtttacccgcaccggcaggcgcgtccggccacgcgatggcggagccactgagatttgcggggtcgagcacactcaatgccaccacggactggccgcgatgctctgacggatgacgcaacgcatccacggtgtcgcgctcggcaaattgggccgcgccgaaaccacggacgaacatgcctcgtaccagtcgaccatgctcctccatgcgattcaataccggatacaacgctgagtagccacccgggatattttccttgtcaatcaccggctgcgcgatgacgccatacctgtccagcaacgtctcgaccagtgcgagtgcccgttcggtctggtcggtgtcttcggcttcagcttgcccgattacggcggaccacaaacctcctaacgtcatatccgtagtggctcggcgaatcggagcgacacgcccacgacgacgtgatgtagtggatttacgcgggcttgctgcgcctgcggttaatgcacgcaccggcgcgaagctggaattggtgaccttaccttgccagaccaagctccacaaggcatccttgaactgctgttcgctccactcttgcggaatgatttcgccggtgtttggattgatgtccggctccgcggtctcattccacgcacgtttggcggcatccatcagttgacgggcatggaacgctcccctgagtccagtgcggtcagaatcgcttccggcatggtggcgtctgaggcgttcgatgtcgtaccatgttccacaccgctgaacaatattgaatccgccggatagaaagcaacctcaccggggtccatcgcactggttcccccggtttttgagccgacccagaccacatcgccgctggtcagcaactcatccagcaatgcaggttggtagtctcgtactcgtgcggggaatactgccgactcccagagtgcagtgggcagtgatatgccctccagctgctcgataacgcgcatgagcccgtcagcaccttcatatcgttcgccgccgaccggcccgataccttgtcggtcgataagaaacatctggaacgcctctgattctactggcttgactgctttacgcgccttggccaatgagcgagaccgaatacggcggaatacgtccttatggagccactgttggccttgctcgtcatcatctacaaagtggccttgcagcaactcgcctttggcagccagcacatccagagtgtgcacggcatccgtagcatcgaggtgtagatcggctatgagctgatcggcggtgaaaggaccatgggttttggcgtaacgggtcacgcgaccagtcacatcatcgtcggcaagctcattccagaaagtgtgctcccccagttcctgttcgacttcgcgaatcacgtccgggttgagcacttgtgccatatcggtggtgccgagcaagcgttcgagcacgtgcggatcgagagacagcagttgcgcgctacgctcggcctgaggttggtcatactggtacatcaccacgccgacgaagccaaagagaatgttctcggcgaaaggcgatggcgactcggtttccacgtccttcacggtaatggtgccggcttgcaatccggtcatcacctcgttcagggcgggcatgtcgtatacgtcttgcaaacattcgcgcgcggtttccagcagcagcggaaagttcttggccatacgtgcggattgcaggagctgtgcggcgcgcagtcgctgctgccataggggcacgcgacggcccgggtcggatcgcggcatgaacagtgatcgggcggcgcattcgcggaatcgtgcggcaaatagcacggactcgcccacttgacgctctacatctgctttgaggtcttctgggtcgaaaaggaacaggtcttgagcaggaatatgtccgtcaccgtccggtagctgaatgacgataccgtcatcggcggcatatacctgcccgtcgaaaccgtagcgttggcgcagtctgcggctgatggccatggaccacggttcgtgaacgcggcggccgaaggggcttaacagcacgatgcgccatccgccgtcttcatcgcgtgtgcgctccacgataagggtttggtcgctgggaactgcaccagtggcggcttgttgctcggagagtaggcgggccaagttggtgatggcgttggcatctaggccatcgtggtggagacgggtgaggattgttgggatgaaggttgggacagctggaccttctgcggcagaactcccccagtccgcttcacgtctaatccggcggcgatttctcgggtgaagcgggctatggtacggctgaaaccgtagtcacggccagcgccttcaccgtgccagaacggcagacgggcggtgcggcccggagccggcgtcaccaccacacggtcgcgggtgatttcctgaatctgccatgtggaggtacccagtgtaatgacatcgcccacacgcgattcgtagaccatctcctcatccaactcgccgacgcgacgctggcctttgccggcgtccgcctcaggcaggaccacggtgtacagccctcgatcgggaatcgtaccgccagaggtaacggccactttctgcgaaccgggacgggcggaaatcaggccattatcccgattccataccagtcgcggccggaaggccgagaattcctctctgttgtattcgccggacatcatgccgattaccgcatcgaacatgtcacgtggcagttcggcaaacggcgcagcacgacgcaccgtggcataccagtcatcagcgttcaaatcgtgcatcgcggcagcggccacggtctgctgggcaagaatatcgagcggattgcgcggcacggccaatggttctatatcgccggcaatcatggcttccagacttgcggccccagtgacaatctgctgacgggtgagcggatagaacaatgcgtgagagacgccaccgacctgatgatcggcacggcctacacgctgcaatccggaggagaccgacaacggcgtatcgacttgaatcaccaagtcgaccgagcccatatcaatgccgagctccaaactggaggtggccaccacgcaacgcaattcaccacgtttaagccgttcctcaatcattttgcgacggtctttggaaaccgacccatgatgagccatggcgatgacatcatcgccctcatgtgagccgacaagcatggtggtggagccgaccacagcatcgtaatgcgtggagaacccttcgcggccttccggagagcccagatcccgcacagtgtcgggattggtgccatgccgggtctgcgcatacaaatcgttcaagcgcgcagtgagtttctcagccacaccacgcgaattaacgaacaccaatgtagtgcggtgcgcgagaatctcatccaaaatactgcgttccaccacaggccaaatggaaccggaggtacggtcgcccgccgctccaaccaacgcggaggaatcaaactcatcactcgcatcagaatcgtccccagaagtggaagaaacatctctatcatccaccggcacaatgcccctgcgttcagcaagtcgctgcatggccggcgtgacaccactgatatgcggagcggaccgttcagcatccacgccaccgacacgctgcttggcattcacggactgcaaatcacgcatgttttccaacggctcaatcatgcgcaaatccattgcaggccgcccaccgggattcacgatggtaaccggttgcccgccgcccaggaatcgcgccgccttttcaggcggattcaccgtagcggatagaccgatgcgctgcatatgacgatcgccacggccagcatcaacggcggcatcaccgccctcatcagcatctgcatcgattgcatctcgcttgcgcgattctgcgacaaggttctccagccgttccagacttaccgccaaatgtgcgccgcgcttggtgcccgccactgcatgaatctcatcgacgatcaccgtatcgacagtgccgagaatccgccctgccttcgaagtgagcaacaaatacaacgattctggcgtggtaacgaggatatccggtggatgggaggctatgcgccgccgctcctgtgcggtggtgtcgcctgaacgagtggcgaccgcgatcttcggtacgggcagcccttgcgcctcgcattgtgcagcaatgccctccaaaggctgttctaggttcttggccacatcggccgcgagcgcctttaacggcgagatatacagcacacgcacaccggcacgccgcgtgcgtggcacggtcatcaatcggtcgatggctgagagaaacgcggccaatgttttaccggaaccggtaggggcgatgaccaagacattgcgaccggaatggactgccggccatgcctgagcctgtgcctcggtcggctgaccgaaggcatgctcgaaccacatcttggtgggttcggaaaacaggctcaggctttcgtacatatgtacgattataggtcagctgaagtaggcgatgacttcttcggcggtaccgtaggcactttgggcaccaagcttggtggccgcataggcggagacgtaggagccgatttgcgcggattgcagcagcgtatgaccggcggccaagccagccagcacggtccccatgaacgagtcgccgcaaccggtggtgtccactgcattgacttgcgcggcggatacgcgatgccaacgtccgttctcgatcaccaccgatcccgacgcaccaagcgtcactatcgcccggtcgaatccgtaatcggtgaatcgttcggcgacctcataccagtcgagtgattccacgtcatcatccggcaggcccagcagttgagccacttcatgctggttgaccagcagaatatccgtggcttccaccagttcgtgaggcagctcgtccataaatggcgagtcgttgagcagcacggtcacgccagcgtcatgcgcggtctgcgcggcggcgataacggtggcaatcgggctctccagacacagtcccaataccgcgcattcggcgatggtcgtgcgatgtgattgcacatagccggcacttgccttggcattggaacccggcgaatagacgatggtgttctcgccctcagcgctcacggtgattaccgtggtgccgctggggccttcgacatgcaggatatcggcggtgtcgacgccggcctcatccagcttgcttaataggaagtccgcgttggagtcctcgcccaccgcgcccagcaactggacattgacaccgagacgagcggcggcagatgcctgattcgcgcccttgccgcccggcagcactttcatggcaccaccattgacggtttcacctggcttgggtagtcgtttagtggttacggtgtaatcggcgttcatcgagccgaccacgattaccgagcccggcgcatccttcagcgctctcaatcgttcccgtacgggctcgggcatctgttcatgttcttcttcacttatcaccatgggctccaagcatagtaggcgtcgggcccaaatgcgcatatgatcagccgcgcaacttgcgaagacgctcgtgcatggccaccatcagcaccaagagcaccagcaaataccacgggtagagactgattgtcgcatattgcgcgatgatgccgaacagtggcggcatgagcagtgagcccacataggcgcaggccatctgcacgccgacgatggcctgcgatttgtcttcgccgaagtaggccggcgtcgagtggatgacgcacggataaatcggcgcgcacccgaagccgatgaccaccagcccaacgaccacgccaaggtggtgaggcaatggcacgaacatggtgaggatgccggcgaacaccagcacttggccgaggcgaatcatgaccgggtccttgaatcgcatggtcaggaagccggaaagcgcacggcccacggtgatgcctacgtagaataggctggcccagctggcggcggtgatcttgtcgatgccgctgtgcatcaccatatagctggaggcccacaggcccgccgtagattcgacggcgcagtagcagaagaacatcacgaggatttccttggcaccgcgaatggcgagcacgccggccacgccgagcggtttgcgttcggcaacagacaccccttcagcagtgccaaatctctcggcattgccgtcagatgatgcggtgtcatcggtcgattcgccgaccgcaattgcgccacgtttcttccacagcggcaggctcagcaccaggatgacggtcagcatcacctgcaggatcgcgatgtaccgatagccccacggccagccttggccttgagagagcgcatagcccatgatgtaggggccgaccgatgcgccgacgccccacatgcagtgcagccagctcatatgccggctttcgtagtgaatggctacgtagttattgagcgccgcatccactccgcccgcgccaaggccgtatggtatggcgatggccaacagcacccagtaattcgaggtaacggagaaaccggccaaggccgccgcagtcaacgccaccgaaacggcggtgaccttgcctgccccgaatttcaatgtcattcggaccgaaagcagtgccgagacgatcgtgaacatggaaatcaccgcggagatgccgccggcccacgccaccggcacgttcagatcctggctcatggtgggccatgcggatccgagtagcgaatccggcaatcccagactgataaacgccacatagatgacggcaagcaacagactggccatgtcccatctcccattcacagtacggcaccggttgtgataacgatgtcatcagtctatcgaatgactcatgggcaacacgcataaaacatatgacaacgtgctcacctcaaacgccaattacggaaattctcggtaagcacgatgtcattatcagcgacgtcttcgatcaggtatcgatcttggagcggtcgaaatcgtcggcgttgtcgacgatgaactgcttgcgcggcggcacgtcgtcgcccatcagcaggctgaagatctcggatgcctgggcggcgtcctccatgcggatgcggcgcagcatacgcgtgcgcgggtccatggtggtgtccgccagctggtcggcatccatctcgcccagacccttgtatcgctggatgtcgtcgttgtaaccgatgtgcttcttgtcgaggtcggccagtttgccggccagctcgtcatcggaatacgtgtagatgtattcgcccttgtgcgagccggtcaacgcgatgcggtgcagcggcggtactgcggcatacacgtagccgtgttcgataagcggccgcatgtaccggtagaacagcgtcagcaacaggatacggatgtgcgcgccgtccacatcggcatcggtcatcatgatgatcttgtggtagcgcgactgttcgatgtcaaagctctggccggagccggcgcccaccacctggatgatggccgcgcattccttgttggagagcatctgcgtaatcgacgccttctgcacgttcagaatcttgcctcgaatcggcagcagcgcttggaaaccggcgttgcgggcggccttggcggtaccgagtgcggaatcaccctcgacgatgaacagttcggccacgtcgtcattgcccggctggcagtcggagagtttggccggcatcgaggcggattcgagcgcgttcttgcggcgcgtgacctccttggccttgcgcgactggatgcgtgcgtgcatttcgccgacgatcttctccagcacgcggccggattgttccttgtacccgcgcttggagccggtgatcatctcgccgaattgcttgtcggtgagccgggtgacgatcggcttgacctgcgcggtgccgagcacatccttggtctggccttggaactgaggttcggccacgcgtgcggtgaccacggccacgagtccggcttggatatcgtcgcgctccaccttcatggcggagtccttcatgttcaccttgagcttgcgggcgttgtcttccaccgccttgcgaatctgcttggtgatggcgttcatgaaaccgtccacgtgagtaccgccgccgggcgtctccacgatgttcacgaagctcatgattgtggtgtcatagccgttgacccatcgcagggcgatatccacgccgcaggtgcgttcgatttcctgggcgtgcagttcaccgcccttgcccacggcctgggtctcctccttataggtgccctcgccttggatgcgccagatgtcggagatcggctcgcctttggacaggaagtcgacgaagtccttgacgccgcctgtgtgcaggaattccacgacgcgcgggtgcgcgggctgttcgccgaacgcgccatcaacgacctggtcgccggccgtcagtgagaagtcctcctcggccgggctctcggcatcgtcggacgagacatccaaggccggtgcctggtcttgcgcaggttcgactgttgtgtcatcagtggcctcgacggtgtcagtcgccgccgtttccggtacgttttcgtcgatgatggtgattttgaggccgggcaccaggaagctggtctgacgcacgcggtcgatgagctgttcgtatgagaactcggcggttttgttgaagatctccggatcataccagtaacgaatacgggtaccagtggttttgggagataccttgccgatgatttccagctcggtgggtcggttcttgcgagtgcgcttgaacggggaatcgggagacggattggccgggtcggcatccgtgtatacgccagggtgaccttggtggaaggtcatgtggtgcgtcttgccgtcacgatccacttcgacgtccagtcgggagctcagggcattgaccacggaggagcccacgccgtgcaggccaccgacggcgttataagacgagttgccgaacttggcaccggcgtgcagtttggtcagtacgacctccacgccggacaggccggttttcggttccttgtccaccgggatgcctcggccattgtccgcgacttccacggaaccgtcggtgtgcagggtgaccacaatgtcgttgcagaagccggccaaggcctcgtccacggagttgtcgatgatctcccacaggcagtgcataagcccctgcgagtcggtggtgccgatgtacatgcccggacgcttgcgtaccgcatccaagccctcaagaacagctaggtccttggcaccgtattcttctttgggcatacagtcctatttttctcttcaaatgcttggctcccctcacagaggggagccagacgatcattgatccaggaagtcgcgcagggtctgcgaacgggatgggtggcgcagcttggacatggtcttggactcgatctgacggatgcgttcacgggtcacgccatacacacggccgatgtcgtccagcgtcttcggctggccgtcttccaggccatagcgcatcttgatgacgccggcctcacgcggagacagggtttccagcacctgcttgaactgttcctgcagcagggagaaggccacggcgtcggacggagcgatggcgtcggtatcctcaatgaggtcaccgaactcggaatcgccatcctcgccaagcggggtgtgcagggaaatcggctcgcggccgtacttctgcacttcctgcaccttctcaaccggcatatccagctcgcgggccagctcgtccggcgtaggttcacgccccagatcctgcagcatctggcgctgtacacgggacagcttgttaatcacttcgaccatgtgcacaggcacgcgaatggtgcgggcctgatcggccatggcacgggtgatggcctgacgaatccaccacgtggcgtaggtggagaacttgaagcccttcttccagtcgaacttctcgacggcacgaatcagaccaaggttgccttcctggatcaaatcaaggaagagcatgccgcgacccgtgtagcgcttggcgagcgagaccacaagtcgtaggttggcttccagcagatggtccttagccttcttgccgtcggcggcggcccacttgagttcacgcttgcgcttgaactccatgccttcgctttcggtgtcgagcaggtgctgggcgtacaggccggcctcgatgcgctcggacaggtcgacttcctgctcggcattcagcaggctcacacggccgatctgcttcaggtagtccttgaccgggtcggcggttgcgccggccgcaatcacacgacgcttcggattgcccgaggggatgatgttttcttcctcatcatccgtgtcggagaccacgtaggcacccttttccttgggctgctcgggtgccttggacttggcttcttcctcgtcctcgtcgtcttccacatcatcgtcgtcggcatcgtcctcatcgaggtcttcgtcgtcggcatcgtcttcgtcaacgtcgtcaagatcctcgtcgaggtcgtcaacgtccaaatcgtcgtcgttgacctcggcatcgtcatcaagctcgtcatcgacctgagtgtcctcgtctttgacgagctcatcgtccttggccttcttcgcggttttcttcgcagcggacttgcgcgtggtctttttcgagggctctgcggacttggacttcttggcggaagtcttgcgtgcggtggtcgtagagctggccttcttcttggtctcggtctcctcgctggactcggctgtctgcttggttgccgtcgtttccttcgtggccaaaactgctcctcctgatctctcgccgtgaagtgcatataccacatgggcccacttctggcaagggcaaatcgtcaactatgtgagtaaaccaccctccacggacgattattcccacatcgttgcccgacgtgttgccgatcaccacacgctttccttccgcgcatcgcgcgtaaaacctcggaaatccgccgtttctgttcactcagcccgagcaccatgccggtgccacgcctcgatcggcggctgagaatatcatcgccgccagcgaacaatcctcatcgagcagcaggcatcgcaaggcgaacaccattgctcgcggatcgcccagccaccataaggtgtaggcgattacggccaatggctgtatgcagtacggcaccggtgaggcttcggcgatatcgagcaacataccgatgccggtatggcaacgctccttatccggcatcatgccttcatcctcgaatgcgcaggtcagcagctcgcccattcgtgttctcgtacgcgccagatgcggtcgcgccgcgaattccatgagccatgacttggggcaacggctttcatcaataaccaacgagagaatcagcgcatcacgaatcgataaggtctcgcgcatgcccaccgcaaacgcggccatcgtctctcggcctaggtcggtgttcccggcatcgaggcaagacagccattcgtccaatggttcggccacccagtcggcattagcctgttgcgcgcctcgaagtcggcgatcattgcgaaattcctgtgatctcgtcttcaactcgtcaaagacaaagggctccgtctgctcggcggcgtgccgtttggcgtgtcggttcttacgcggcttgtgtggcgtgttgttgttcatcatgtcctccttgactaatggtgtgcaatctattggtgttgtggtgcacgctgagccaggtagctcacgcaccgagtgggtgtgcccactatggctgaaaacgccgtatgacgcaggaaaaaacgaccattgtggttctagcttcaaaacccttgatttccaacgttcttgtgttcttcaaaccctgtggataagttattaggcatgtgcacaactgctaacaaccgcgaaatcatcgagccacgcatcattcagttggtgcgggaactgactgccgcccccgccaccgacgaggttgccgacgccctgaaaccggtgatggaacaggttgtggaccaagccgcctcctccagccaaggaggcaaacgactgcgtgcgctgctcgcattggacgccttcgatattcttgccggcgacgtgactcctgattggcgtgatgccatgatcgacctagcctgcgccattgaagtgtttcagacggccgcactggtgcatgacgacatcatcgacgaatccgatctgcgccggggcaagccttccgcacatcatgccttggagcaggccgtacacagcggtgccataggccgtggcttgggcctgatgctcggcgacattctggccactgcctgcattgaaatcacacgccggtccgccagccgtcttcccaacaccgatgccctgaacgaggcgtttcttaccatgcagcgcgaggtggaaatcggccaagtactggacttggccgtcgagatgaccccgctgtctaatcccgaagctctggcgaacgcctcattgaacgtattccgctggaagacagccagttacaccaccatcgctccactgctgcttgcactgctggccgcaggagagagcccggatcaggccagacattgcgcgttggccgtcggccggccgctcggactggcgttccaactggcggatgacctgttggatgtcgtcggatcaagccgcaataccggaaaaccaattggcggagacatccgagaaggcaaacgcacagtgctgttggctgatgctctgtctgcggcagatacggcggataaggccgatctgattgccatcttcgaagcggattgtcgcaatgacaaccaggtggcccgcaccattgaactgttcacgtcgaccggtgctcttgatcgatcccgcgagcgcatcgctgccctatggggtgagtcccgtaaggcgattgccggtcttgagctgaattccgaagcgcaacgccgtctgaccgaggcttgtgcgcgattcatccccgaatccttgcgatagtccgcaatgcgagccgccggaccatgagaccatggacaccggtgaaaacccatgaaaactatgcgctgatgctccggccgcgtaaccggggccatgtacactgaacgtgtttagtcgtgattaaaggaaccgtacgatacaacatgagtgagaacgagcccgcgcagatgattgagggacgctaccgcatcgtgcgcaatatcgccgagggtggtatggccaccgtgtatgaggccgtcgatgagcgtctggggcgcaccgtggcgattaaggtcatgcacacacaactcgccaaaggcccgcatcgggagcagttcgtcgaacggttccgccgcgaggccaattcggccgcgtccatcgccaacccgcacatcgttcaggtgtatgacaccggcgagttcaatggacttgattttctggtcatggaatatgtgcatggcgtcaatctgcggcatgagatgaacacccaaggcacattctccgtgcgtgagacgctgcgcgtggtcgcggagacgctggatggtctggcttccgcgcatcgcgccggcgtggtccaccgtgacatcaagcccgagaacattttgatcaatgatcgcggccatgtgcagatcaccgatttcggtctggccaaggccgccagccaggccacattgagctccaccggcatgctattgggcaccgccgcttatctggctcccgaaatgatcgagaacaatcaggccaccgcgcaaggcgacctgtattcggtgggcatcatggcatgggagatgatgaccggcaaggtgccgttcgattcggataatccggtgacgcttgtcttcaagcatgttcatgaggacgtgccgtccgtggccacggtctgccagggcattgatccgtccgtggcggcgttcatcgcccatctgaccgcgcgtcaggtggatgcccgccccgccgatggcgcggcagcagctgaggaattgagccagttggccgccaaattgccgctggaggcgtggcaataccgtttgcatgccgaacccatcggaggcgatcataccgatgccaccgctgcagcattggtaggcaatatcgccgagcaggccccgctgaccggcgtacctgccggtgcagcaacgttcgagccgtccgtaccggcatttttggtcgatgatgccgcaagcaataccgccgataccggtggcgccgcagacgtcaatcctccggcgcctccggtcgcccccaccacggcacttgattcgtcgatgttagccgatgcttcggctccccataagacgcagatcatggcacagtccggcagcgagacacaagtgctgcctcaggccggcgatgccttcacccgagcgcttgccctttccgatgagccggatgtcgcttccaatggcaccgggccaaagaagcagcgcagcaaaaaaccgctcatcatcgtactggtgatagtgctggtactggctgcaatcggcggaaccgccggctggtggtggtttgccggaccgggcagctattggagtgtgcccaagccggatgacgtgacctgcgatgcgaatgcaagcaccgaatgctcgttggccggcgcggattgggccacgtatgagagcacgttgaaggctctcggcatcccctacaagacgcacaaggaatacagcgacgacgtggcggaaggcaagatcatctcttcttccgtgaacaagaccaaggccgttgtgaacagccgcataagcaagcgagccaatcaggagcttacggtggtggtgtccaagggcgtgcggatgaccaccatcccgaaggatattctcgacgcgaattcggccaatggcaaggacccgttgaacgcgctcaagaaggccggcttcgataatgtcaagcatgacgagtcgaaggatgagtattcgatggacacgccgcagggtgtggcattgacgatctcccctgatcccggtaccacggccaagcacaacgatgaggtgacggttactttgagcaagggaccgatgccggtgaccatgcctaacatcgtcggtaagacccaggatgagatgcaagccgcgctcggcgagttgaagctcacggccaatgtcaccgaacagtacgatgacaaggtcgaggccggtcaagtcatttccgcgtctcaggaagccggagcccagctgaagtggggcgatagcgtggacgtggtgatttccaagggtccggagatggcgacgataccgtccggccttgtcggcaaacaggaaagcgccgtaaccaagacacttgaaggtctcgggttcgaggtgaaaaccgacaaggtgctcggtggcctgttcggcacggtacgtaccgtgaaaagtggcgatacggacctatccaacggcggcaagattcgcttgcgcgatgccaacggcaaccccaccgtcatcaccctcaccatcgtgtgagatttgaatgaggctccctctgtcttcagacgagggagcctcatttgctaattacttttcggcttcttcagcggcctgctgggccttgagctcggccttgaccttctgggcgtattcgttcacgaattcctgaccgctcattttctggattgcggtggaaacacgatcggtcagcgaacgcaaatcatcatgtgtaatttcatcagccggcttcttcgcaacctcaatcggcttgccatacaacaccttggtcttgcccttcttgggaatcgacgtgccaatcggctgcagcttgtccgagccgatgatggcggtcggaacaatcgggcaaccggtctcgagcgcaagtcgtgcggcaccggtgtgtcccttgtacagtcgaccgtctgggctgcgcgtgccttcaatgtggataccgaacaggtgcccatcctcgataatctcgcgtgcatgctcgagtgcgccaagcgacttgctgccaccggaacgatcaaccgggaacacgcccacggacgtgaaccaccacttcttgaacttgcccttcaatcccttgccctcgaagtattcggctttgcccatgaagtgcaccatgcgcgggcaggtaatcggaatcaaagcatcgtcaatcaccgccagatggttggctgcgataatcgcgccaccctctcgaggcacgttattcagtccgctgacagcagggctcaaacgatgatgagcaatagggccgagacctttgacgaagaaccagtagagcacttggcattcctcccgcagacgaactagccattggccggtcgcctgattagagtgacagttatgactgagaaccagaatagcaatgccgacggagagcggccaacccccacgccgggcaacggacaggattccgatacttcgtccaagtcgtcgactcccggtgccgccggacaagccacgaatggtgccgatacaccgcaatcgcatgacgcgaacgatttggatgcggcgtgggccgcgttcgaagccgagcatcaggccgacttgcatgacgtggcttcctccaggcaggccaaaaagttcgagaagcaggccaagaaacgcgagaaggaggcgctgctttccgtagatgacttggatatcggctcgttcaccgatgatgctcgcccgagccgtggcggcaaaaaaggcaagcagtcaggtccccgtgatttcaccggctccagctggctggataccgataatgtgatggacacctatgatgatggcggcttcactcccccgaaccctgatcttggtccggtcaaagcgtctacggtactgctgacggcgttgcttatcattggtctcgtaggcgaagcggtgatgatattcgtccccggcttgaacgcgattcctctcttgggcgcgctgctcaatattctcttcgggctgggcgtcattttgggcttgggtggattggtggccaaaattctcaaccgcaaagaccgccccggtgatcagggcggctattacgacgacggcgcgagggtgtagctcgcgtaggctgtgtggtccttggctcccctctctgaggctgagccgttaagcgaacagcccagtgggctgtttgtaggcgaggtgtgagagatagcgaaccaatgtattgcgggcgtgtctcgtccgtaattgcggtcgagccacgataggtcacgaattgaagtcgatggactcctgtaactcggcaatcatggccttgatgcgggcgtcgcctccccaccagttgagacggatcgtcacgtcccctttggccggcacaaccggcacatcagcggcaccaaccgaagtgccgcgcgtcgcagtcacgcacaaggccacggccgccataacagtcgccatatagacacataagccccctcatcagaggaggctgagtacggtgtatcacgccttggacttggcggtttcgatccacttgtcgaacagggcttcggccttgccggaatcgacggtttcctcggccagcttgtaggcttcggcgaaacgctcggccagtgtgccgttgccgaccagattgccgtcggccacgatggcggaggcggcgttgagcagtgcggtggtgcgggacggaatgtccttgccggccaggaagtccttgaatgcgttggcgttgacgtccggaacgccgcccttgagctgttcgacggtaatcttggccaagcccagatccacggtcgggtcgaactcggtttcggtgaccttgccgtcgcgaatctcccagacggaaaccgggccggtgggggcgagctcatccatgccctcatgcgaagtgtagaccaagccggactgaccacggctggcgtagacggcagccatgatcgggctcaccttgcggttggcgcagccgatggccacgtgtgccgggttggcggggttggtcaacggtcccaggatgttgaagacgcacggaatgccgagcgcggcacgaatcgggcccacgaagcgcatggccgggtggaaggtgcgggcgaacgcgaaggtgatgcccacctcgtcgcccacttcgccgacggcctccggcttcaaatccagcggcaggccgaggtcttcgagcacatcggcggcaccgcacttcgaggatgcagcgcggttgccgtgcttgacgatcttcacgccggctgcagcggcggccacggagcccatggtggacaggttcacggtggcgaagccgtcaccaccggtgcccacgatgtcggtggtcccaccggaaacgttcagcggcacggcgtgggagaccatggccttggcggcaccacgcacctcgtcggcggtcagtcccagctgctgctgcatagcgagcgcggcacccacggcggccggattggcgttaccttgcatcaggtcgtccacgaaccactccgattcctcagcagtaaggtggtctcccccgaccagcttggtgagaatcgacttccatgtgatctcggccatgatgccctccttggcgtttcctacgccgtgtgatgtatgttcgccgctcattgtaatggttcgtcatttcaaggccctgaatcttccatattgcaaaatatggcgctattgctgttttcgtggatgtcggttcgtcgtcgagccgttggtttcgtaagcgtgaggggcgttcccgcgtattctgttttccgaccaaagaaatgaatcacgaagaacgcctgggcaaaagcccattcaccggattgccgaacgtcaaaggcacggttgcagaggatgcgcggatcacggattcgccgccgcgttccgaacccgtgctcgagatccgggtgcgtccacgtgcgggtatgctccgatgctcccgatgcggaaggaggcgccgcgggcatgaccagggcggcggcgtgcggcgtcgtggtcgcttccgtgccgtgggccgagccgggcagccggtccacacgcgatttcgaatcggaacgcgcgtggccgatgagcgtcgcgaaccagaagaccgtaagcggttttccgcacgtcgcgtggcgcgccgccggaagacgccgcccatagggtcgccgaacggttgaaagcgtcgatgccgtctccgttcggcggcctcacgtcgatcggcgtggacgagaccggctaccgcaaaggccacacgtgcatcaccgtggtcgtcgaccacgaacggcatcgggcgatataggcgcacgacgggtacggcagggacgtgttcggcctgttcttccaaacgttgacgcccgaacagcgcgcctccatcagggtcgtcgccggggacggggcccggtggatcgactcatgcgtgcatgagtggtgcccgaacgccgaacgcgcgcccgacgggttccacatcgtcagttggacgagcgacgcgcccgacaacccacgaaaacagcagaagcctcttttttgtgctatcccgtaaaactgcgggacggcagctcattttcgccgtttgagccgtgccgtcccacatcaccctttgcggaccgtgacaccataacaccgagaatggcggaatttcaacgattccgtaattcgtactgcgggacgccacgctagtcaatcgattgacactcgtgccatcccgcaacagtgtgggatacgacgtcaaaatccgcgaaaatcgcgtgccgtcccgcgcgtacggcaccgcacgaatacatgctgatgaaccgcatagaaaatggctccccgtgtggggagccatgagctagttactaactagcgatgcgtcacttctcgttctggccgtggcacatcttgtacttgcggccggaaccgcacgggcacggggcgttcttgccagtgccagggaaggtgcggccgtcggcccacggcgtcttgagctcttcgctcttcggacgcttggaaaccgggaccttgccttcggcgtggctgatcggagccggtccggcaacaggcagcgtggactcgccggccccggaggcggctgcggattcggcgatcgcctgcttggcgtccgtatcctcgtcctcttcctcgacttcgccctcggcggcctcgaccacggattcgccgttctcgtcggggccggaggccacggcgatggtgtcggcgctttcggcggtctcctcgacctcgtcaacggcctcgtcggtggtggcgacctgcttgatgtcgatgtggaacagcagctggacggtctcctccttaatggcctcgatcatggagttgtacatctggtagccttcgcgctggtattcgaccagcgggtcgcgctggcccatgccacgcaggccgatgccgtccttgaggtaatccatctcgtaaaggtgctcgcgccacttgcggtcgagcacggcgagcaccacgcggcgttcgagatcgcgcaagccggtctcgccgatggtctcctccatttcgccgtactgctgcctggcgtcctcgacgatcaggtcgcgcacggcctcgacggccttcgcacccttgaggccgccgacgatcttcctgacctcgtcttcgtcgaccttggtggggatcacggtgttgagcgccttgaacaggccctcccaatcccagtccttcggtttctcggatcccttgttggcacccttgatgtaggactcgacggtgtcggaaatgaaacgcaggatgtccttgtggatgtcttcgcccttgagcacagcctggcgctcggagtagatgacggtacgctgcttgttcatcacgtcgtcgtacttcagcacgttcttacgaatctcgtagttgcgggattcgacggccttctgtgcggtgcgcacgcccttggtcacggacttggcctcgatcggctggccttcctccatgcccttggccatgacctgggccaccagctgggtgttgaacagacgcatcagatcgtcttccagcgacaggtagaagcgggactcgcctggatcgccctgacggccggaacgaccgcgcagctggttgtcgattcgacgggactcgtggcgctcggtgccgagcacgtacaggccgcccagctccttgacttcctcgtgctcgtccttgacctgggccttgatctcgttcagggtgcccggccaacgcttctcatactcttccggggtgtcttccggagagtagccctcggacttcagcttggcgtcggcaaggaactcgacgttaccgccgagcatgatgtcggtaccacggccggccatgttggtggccacggtgacggctcccttgcggccggcgacggcgaccacggcggcttccttctcatgctgcttggcgttcaggacctggtgagggatcttggccacgtcgagcagggtggagaccacttcggagctttccacggaagcggtaccgagcagcaccggctggcccttggcgtgacgcttggccacgtccttgacgatggcggccagcttctccttcttggtgcggtagatgaggtcgtcctggtccttgcggatcatcggcttgttggtcttgatcggcagcacgcccagcttgtaggtgttcatgaactcggcggcctcggtttcggccgtaccggtcatgcccgcgagcttgtcgtacatacggaagtagttctgcagggtgatggtggcgaaggtctggttctcggccttgacctccacgccttccttggcctcgatggcctggtgcagaccctcgttgtagcggcggcccggcaggatacggccggtgtgctcgtcgacgatgagcacctcgccctgggtgacgacgtagtccttgtcacgcaggaacagttccttggccttgatggcgttgttgaggtagccgatcagggcggtgttggccggctcatacaggttgtcgatgccgaggaagtcctcgaccttggtgatgcccgggtccaggatgccgacgaccttcttcttctcgtcgacgtcgtagtcctcgtcgcgggtgagcttcagcaccagcttggcgaactgacggtaccagcgggtcacgtcgccttcggccgggccggagatgataagcggggtacgggcctcatcgatgaggatggaatcgacctcatcgacgatggcgtagtggtgaccgcgctgcacgaggtcggccttctcccatgccatgttgtcacgcaggtagtcgaagccgaactcgttgttggtgccgtaggtgatgtcagcgttgtactgcttgcggcgctccggcggcttctgctcggtgatgatgcagccgacgttcatgccgaggaaacggtagatacggcccatcagctcgctctggtagctggcgaggtagtcgttgacggtgaccacgtgcacgcccttgccttcgagagcgttcagataggtgggcagggtggcgaccagggtcttgccttcaccggtcttcatttcggcgatgttgccccagtgcagggcagcaccgcccatgagctgcacgtcgaagtgacgctggccaagggtgcgcttggagacctcgcgcacggtggcgaacgcctcgggcatgatctcgtccaggctcttgccgttttcgatttcctgcttgaacttcggggtttgggccttcagatcctcgtcagagagggcggagatctcgtcctcaagagcgttcacggccttggccacgttctccagcttcttgagctggtggccttcacccattcgcagggctttgtcaataatatcgaccactgggttctcccttgactgataagtggtggtgtccgcgtatcaggatagcgcctcacaccgtcagcagtcgaatttttcgacctttttacgaaaaaatggaccgcctccatattggaagcggtccatgcggtatcagctgatcgtgtcagcaggccttaccttcaggccttcttgacgttctccggagtatcgatttcgaacacgccgtagctccaaccgtgacggtggtagacgacggacgggcgtccggtctccttgttcacgaacaggaagaagtcgtgtccgatcagttccatctcgtacagcgcctcgtcgatgctcataggctcggcgatgtgcagcttgcgacggatgacaatcggcgtatccccaacctggacctccacggattcgccagggccaagatcggaggcgaccgcagcctgcgggctgttgttcggctcttcctccggctcctccggctcgggctccggggcgataacacccagatccaccgggaccgggttcgcgtaaccacgacggtgatccttgcgacggtcacgagtacgacgcagacgcagcgtcaacttatccagcgccatgtccagcgcgctgaattcatcggtgctggaagcctccgcacgcaccacggtacgtccggcgataacggtgatttccacgcgcttggcggtatcggcctgacgcgggttgccctcatgggtcagcacgatctgcgcgcgctgagcatccggggcgatagcggtcacacgattcatcttggtctcgaccacatcacggaacctttgcttgacctgcgtgtggcgtccggtaacgacgatttccatgttgacctcctctaactcaagcggtgtaacccgctatatgtgttccgaacggcatcatcaccgaccgggtatgtttcattgtagacgaacaatgggtgaacggccggaaactcgcccagagaatatatgtttattcccgggcttttctctgcaatgaaacgatgtatatactggggctttggcagcagtctcctataagaagatttgataccggtttatcaggctggctcgtttgttcgtcatggtaaatactgcaatggataggcagcgttttcttgctctttctcgcacataccaagctcttacagatttgattcgtctccatacgacacgccacaacacgcccgacacgccccatccgatattcggcgcgtcgttcacgaatcgcccaactatgcccaaccatggagaaaacaggataaccgggcaacggcatggcctcgccgcagggcgggatgccgccttttccgcaccttatgtataattgcaagcttgagacctcttgatggccgcggccgtgatcttcattgggatcggctgaggaacttccgggctccatagagcacgatggcggataacgtccgcccagggtgacctgagagatagcgcaacagagaacagaccgcccgtcctcgacgggtaagggtgaaacggcggtgtaagagaccaccgggcctctggtaacagtaggtcgcatggcaagcctcatcgggagcaaggccaagcagatggcggtaagggctgctcgcccgtgtcatcgggtaggctgctagagcctggcggtaacgtcaggtcgagatggatggccatccgtgccgtgcgttcgcgcacggcacgacagaacccggggtataagaggtctcatttttttcttggctacaccaacaattcggcggcgactcgacggagggtttcggggctgtggcctttgcggccgccggcggaccaaagccgacgctgacggacccgacgatcgaggccatgggttttgcgggctatttggcggcccaattcccatgcggcatcttcaaagatgccattttgctcagcttcgtcacacacctgttcagccagcttgcggtccacacctttgcgagcaagttccatgaccgtaccacgacggcccatcatgcgaccggcacaatagcgtacggccgattcggcataagcgccgtcgtcaatcagttgcacgcgaatcagccgttcgatgacctcgtccacgatcgcctcgccgtaccctttggcaagcaatcgttcgcgtaacgcaccggatgcacgcggggccgcgtccagcaaacgcaatgcagcctcgcggcaagcgtccaaatcattgggatcttcgacaacggcagcgtctctcccccgtcgagaaaaacgtcccgacggtttcgactgaacatgctgctcggcaatgggcatgtcttgcgacgcaacaggattgcgccgcaagaacgcttcggcactaatcatgttcaggccttagctgtgccggccttggcacgggtcgttttggcagcaggcgccgctgcggccttgctgtccttggccacgtcggcagcagcagcctcgctgacggcggccgctgctgcggcttcgccatcttccgcgaactgatcggcggaaccgatcagaccgaactcggccttgaccttgttctcaatctcctcggtgatggccgggttgtccttaaggaactgacggaccttctctcgtccctgaccgagctgatcaccctcataggtgaaccacgaaccggacttcttgaccacgccaacctgctgggccatgtcgatcaccgagccctcacgggaaatgccttcaccgtagagcatgtcgaattcggcggacttgaaaggcggggccatcttgttcttgaccaccttgacgcgcgtgcggttgcccaccgcttcgtcgccgttcttcaaggtctggatgcggcggatgtcgagacgcacggaggcgtagaacttcagagctttaccaccggtggtggtttcagggttgccgaagaacacgccgatcttctcacgcagctggttgatgaagatggcggtggtgccggcctgagccaatgcgccggtcatcttgcgcagcgcctgactcatgagtcgggcctgcaaaccaacatggctgtctcccatttcgccttcgatttcggccttcggcaccaaagcggcgaccgagtcgatgacgatgacgtcaagcgcaccggagcgaatcagcatgtcagcgatttcgagggcctgctcgccgttatccggctgggagacgatgagtgagtcggtgtccacgccgagcttgcgggcgtaggccgggtcgagcgcgtgttcggcatcgatgtaggccgccacgccgcccttcttctgggcattggccaccacatgcaatgcgagcgtggtcttaccggatgattcggggccgtagatctccacgatgcggcccttgggtaggccgccgatgccgagcgccatatcgagagccaacgaaccggtgggaatcacctcgacgttctgctcgggctggtcgcccagtcgcattgcggaacctttgccaaaactcttctcgacctgcgccagcgcggtgtccagcgccgccttgcgcttgggatcgagctcgtgcttgtcctcggctgccgggtccttggccggcttggtctcaagtgccatgatcttctccttgtcgaagtcgtgtgcgaatcggatgcctccaccgtatgacggacatgccatgtgaggcaatccaaaccaaccattgtggttccagcttgcccgagcttggccacctggcctccttaaaccctactgcggtaaggattatggcagatggcaagcaccctgtgcacacgtatgcggcttcttgtcactgtggataactataaccacacacacgaacatttgttcgaatttggcgtgcaacacgccgaaatcgccaatttcacgattcagcgactccgtaatcccgcagtgtcagacggcgggcatgggcggcgcgttatgatcgtggccccaacgcttggagtccggaacctccatttggtcgcagagcacattccagaccacgcgtggctcctccccgcgtccagcgcctcgaccacggtcatattcgccagtttgggcatccgttgatcacgcgacagcgaacgaccgtaggtccgaccgaacacctcttcaagtaattcccagaattcccgttcacgcatacacgccagtgtgccaccaaccgcaggacagcaaaaacccgcatcgccacaagcgatacgggttcacagctagacatagattacgggacgcggcttcacaccgccaaccgatcagccctcgaccgagtcgagataatcagccaccatgcgcagcatgcgcgaagtggagactccgagcgcatcggcgatggagctcagcagttcggagctggcttccttctgtccacgttcgacttcggaaaggtagcctagcgaaacgcctgccttctcggagacttcacgcaacgtgcggcgatcgcgcgtgcgcagctcgcgcagcacatgaccgatagcaccacgcagcgaaaactcgcgaggctcctcctcagccaccacgggctcggcggcggcagtcggcttgtacgacggcgaatcctcatcccacatacgttcacgaacggcttgacgctgatccttggccttcttggcggcctgtgccttgagcacctgctgctgggcgaacatcaccgcacggcgctgggccggagtcagttcacgcatacgggcgacacccggctgcacagccatcggcttcttggcggccacatccatctgttcgttcactcgggtcatcgtttccatcgccatcgccccttcccaggtcggttcagtgtttccactatgtacaacacgacaacccaacggttttattccttaaaacttgctgtgaatagactcaagttttgcagaacgtggaatacggtgaggcgacgaacctcttcgcgcatgccatcaagatggagttcgacggctttgagcacttcggcatggtccgcggtgaggcttgcggggatgcgcaggcccacatacaccagtccggccggcttgtcaccgtccggaccggggccggccacgccggtggtggaaaggccgatgattcggtcgccgtattccggctggctgtataggcgagcggtaccgatggccatctgccgggcgacttcggggtgtacggcaccttctcgatccaatagggccttgtccacgtgcaggatcgaggccttggcattgatgtcgtaggtgacagcggagcccaacaacacgttggaggcgccgggaatacgcacgaacgcatcggcaagcaggccaccggtcagggattcagcgcaggcgattttcgtattgttcgcctcgcaaatcttgaggatgccggccgcgagactgtcgcacaattcccgcattggaatatccgtcacttccgcttcggggcgacgaacgtgttgtacaggtacacggcacccgagtagaggcacaggaccaatgccacgtagatgatggcgtaggtcaggaagtagtaagcggtcatccagaacggcgtggcttgtccgttacccagagaccagaacggcagcagcagcatggacagacccacgcactggaatacggtcttgagcttgccgggccatgcggcggcgatgactttgccgcccggacgctccatgacgaagaaacgcataacggtgataccaatttcgcgaatcaggaacaggatggttacccaccagccgagctcgccgaacgcggagcatacaatcattgcgccgcaagtgagcagcttgtccgcgatcggatccatgagcttgcccatttcggtgacctgattgtatttgcgggccatccaaccgtcgattttatcggtggacgcggcgatgatgaacagcaccgcggcgacccagcgcatggtcaggttgttctcaccccaggcaccggcgagaatgtcgagtgtcaggaaaaacaccacgagtacgatgcgcgagtaggtgactaggttcggcggcgcgttccatccgtcgaacagcgatgatttgggcgatgactgcttgtccattgtgttctcatccatagtgttcacgttacccccacacttctaccttgagtgagtattggctggatattgactgccattattcgggaatcaggttgcgtgctgatggccgcgtggccgcgcttctctctccgccccttcggggcacctccctcatcagaggaaggtcgatgggtgaattattcgccgagttcgggctgttgcggggcggtggcttcgagcgagctggtttcgcctcggatgaaggcgagcacctgcggcaggtcctgcggctggacgagcacttcgcgggccttcgagccttcggacggcccgaccacgccacgcgattcgagcaggtccatgagtcggccggccttggcgaagccgaccctgagcttgcgctgcagcatcgaggtggagccgaattggctggtgaccacgagttcggcggcctgcagcagcacgtccatgtcgtcgccgatctcctcgtcgggctccatgctgtctttcttttcggcttccttggccatctgttcgatgtcttcgcggtatttcggcttgcgctgggtgcgcacgaactccacggccttgcgaatctcggattcggacacccacgagccctgcacacgaatcggcttggcggaacccatcggcaggaacaacgcatcgccctgaccaatcagggtctcggcaccgaccgtgtcaagaatgactcgcgaatcggtggcggacgaggtggcgaacgccagtcgggatggaatgttggccttgatcagaccggtgaccacgtccacggacggacgctgggtggcgagcaccagatgcacaccggcggctcgtgccagctgggtgatgcgctggatggagctttccacatcgttcttggccaccatcataaggtcggccatctcgtcgaccaccacgaggatgtacggatagggggccaccttgcgctgggagccggcgggcgcatgtaccttgccggcgcgcacggcctcgttgaagtccttgacgtggcggaatccgaagaattcgaggtcggagtagcgtgcatccatctctttgaccacccattcgagggcctgtgcggctttcttcggatcggtgatgatcggggtcagcaggtgcgggatgcctgcgtaggcggacagttccacgcgcttgggatccaccatgatcagacgcacctgttcgggcgtggcacgcatgatgatcgaagtgagcatcgagttgataaaactcgacttaccggaaccggtggcaccggccaccagcaggtgcggcatcttggtcaggtcggcggtcacgaagtggccttcgacgtccttgccgatgccggagagcatcgggttcgggtcgcccacggccttgtcggagcgcagtacgtcgcccaagtgcacgatttcgcgatcctcgttcgggatttcgatgccgatggcggatttgccgggaatcggtgaaaggatacgcacatccgaactggccaccgcgtaggcgatgttgcgctgcaggttggtgactttctccaccttgacgccggggccaagctcgacctcatattgggtgaccgaggggccacgcaggaagccgacgactttggcatccacgttgaactgttcgaaggtggaagtcagcgcccggatcacgcgatcgttggccggggtgcgcatcgcatggggctggcctttggtcagcaggttcaggtcgggcaactgatacggcctattggcgtcgtcgtctgtatcgttgccggcggtggcattcggctggccgcccgtattgggcacgccctggccgactccgctgccgtccgcatcggcacccgcgtaggctccggtcgcggctgccgcagccgcggcaccggcggctccggccgctcccatcgcaccggctgcccctgcgagcgcgacagtaccggcctgggcggcactgggtgcccacgggtcgtctaccgctcccccaccgggcatggcgacggtctggccactggtgatgacgcgggttcgggaagcgtcgccatcatctgcatcggcagcaggcgcagggctggataggtgcggacggccgtcgtacgaagacgatgcaatggttcgcgcaccgataatctcgccggtcatcggatcgaccaccggggtttcggcggtggcaccatgctggctggcggcacggtcgaatggatcgtcggcagcatacttgtcaagagttttgtcgtcttcggtcttggatttgcggccgaacagtcgtgcgaacaggctgggccgtgcatcgccggcctgatcgttgtcgcttccgtcatcgtcgccgtcatgcgagggaacaccgtcggcaaaggcgagagtggtatctcccacacggacctcgttggggaactggctggcgctcccatccgtctcctggcccatcggcacatacggtttgcgttggattttagcggcgattttgcgcgcatcctccggcaaatcggtgacgtgggtgccggtaatcatcagcaaggagaacaggccgacgaccacgaaaatgatgatggcgaacacgttggaaaggccccaggcgagcggtgagccgaggaagaagccgaacaggccgccggcggattgcagaatcgtgatgtcgaatccggtgtggtcggcggcgatcgccacgtcgatgatcgaacaaatcgaccacatgagcagcacccaaccggtgaccacacgcgggttattggaccctttaccggaattgcgcatgagtcggaaggccacggcggcgagcaacaccggcagcacgacgctcatcagaccaagcacaccggccgcggtggcgtgaagcagctggccgaatggaccgctgacgcggaaccattcggacgcgcagaacagtacggcgagcacgagcagcaggaagcacaaaccgtcacgacggtaggctggatcgtattcgccgacgccggtgacggcgcgtacgccggagccgaacgcgcgcggaatcgcgagcaggatcttcttccacaacggctcaggttcgaggtcaagctcgggctggaccttggtttcgccatcatgggtagacccgttgtctttggatttacggggtttggtgctgttggaggatgctgttcgtgccatatcgggtctgattctactagtacgggggtgcatggttggtgacgacaccgtgacgatatggtcgattgacgaatcccgacagccgattcgccgcgttcgtctgagtcgattccccgctggggcgcgaatatgccttatcatgggttgcatgacacccgcagagcgtgcgagcgcagtcgcatttgcactcaagaactgcgcactggaagcgatgacgccgggcgaggcaacgatgcgcgccgcggctgcctacgaacgcggcttgaagcccgtgacccatctcatcgacgtggcggacgaacagaccgccatgcgtctgcgcgccaccgccgaccctgccggaaaggatcgtctggctgccggcagtctggatgatcatgccacggatcgggcggatgcggtgttcgcacgtaccgtgttgttggcggaacgtcgatggaatccgtctggcgacttggatgagctgaccgccattcataaggggctgttcgaaggcgtgtttgaggatgcgggcaagttgcgtacctcaaacaccacacgcgaggtgacgaacgaccgggctcgagccgcgaatcctgaggcgttcttcccggctgggctcattgagaccggcgcgcacaacatcgcgatggagttggcggacaagcgcaacctgcatgcgttggatcgcgacgtgttcgttcacgcgttcgcttctatttatgatgagctcggttatctgcatccgttccgtggcggcaatgcgatggtgctgcgtatattcggttcacgcttggcgcatgacgccggctgggatctcgactggggctcagtgacgcgcgaggagtatcgctccgccaagcactcggcatatcggggcgacacgtctgcactggagacgatgttcgacgcgatactacgcccggcgaatccgacgcgtgtgttcttgatcgccggctggaatcaggggcctgcacactgattgcgggtgattgcatcggcctttggctgattcctacgccgtgatatcgcccagatgatgctgggtgtattcgtcggctcgggcgtcgatcgggtcgtagtcgccggcgtcggcgtgcgcgataatggccatcgcgttgtcgaccagtttcgggttcagggcctgcagccagtggatgcgcgggtcacggccgaaccatcccatctgtttgcgggcgagtcgcttggttttctgtgcgatgtccgcgaaggcgtcgttcacatcccagatgccgtccagcaggtcgatgatctgctgatagccgagcgcacgtacggcggtggcacccagatgcgggcgcaaccgttcgacttcttcgatgaacccatcgtcatacatctgcttggtgcgcaaatcgatgcgatggtccaaatccgggcggtccaggtcgagtccgatctgcacggacggaatcacgtaccggtagcgcggcagactggccgaatacggtttgccggtaagctcgatgacctccagcgcacggatggtgcggcgtggattgcgtgggtccatgcgcgcggcggcctcggggtctttggcccgcaactcgtcgaacaaagcaccggcaccctcggttttctcgcgttcctcaagacgtgtgcgcacgtcgggatcggtgccggggaaggtgatgtcatcgatggccgctctggcgtacaagccggagccgccgacgagaatcggccgtatgccacgtgattgcaggtcggcgatggtctcgcgcgcaagctgctggaatcgggccacgctcatcgtgtcttcggggtcgatgatgtcgatgagatggtgcggcacggccgcctgttcctcggcggtgggtttggcggtgccgatatccatgccacggtacatctggtaggcgtccgcgttcacgatttcggcccgctcccccgcttcggccagacgccgggcgatggcgatgcccaaccccgtcttgccggacgcggtgggaccgacgatggagacgactcgttgcgtcatatacgccccctcagtgccgcacggaataggtctggccggcggccacgtcggggtcggcaagcagattatggcggccggcgtgtgtgacggtggccgtgacgaaatcgccgatttcaggtaccggttcgccttcaggcacgccgatgtgcaccagcacgccggttttctcgcggccggtgacacggtgggtgtcggtgtccttcttgccgagtttgccggtgatcatcacttcgacgtcgcggccctcgaatgtggcgaggttctcttcggtgatctgctcctgcaacgccaccagacggtcgaaccggtcctgcaccacgtcgcgcggaatctgttccattgcggcggccggcgtgccggggcgtggcgagtagatgaacgtgaacgccgaggagaagcgcgcctggcgcaccacgtccatggtctgttggaagtcctcttcggtttcgccggggaagccgacgatgatgtcggtggagatctgcgcgtcgggcatggcggcgcggatgcggcccagtatgtcgaggaacttggcggagcggtaggagcggcgcatcgcgcgcaggatgcggtcggaaccggactgcagcgggaagtgcagctggtgcatgatgttcggcgtttcggccatcgcggcgatgacgtcgtcggtgaaggcggccgggtgcggcgaggtgaagcgcacgcgttcgagaccgtcgatggtgccgcaggcgcgcaacagcttgctgaaagcgtatcgatcgccaataccataaccgaacgaattcacgttctggccgagaagcgtaacctccttggcaccatcggccacgcattggcgaatctcatcaagaatgtcaccggggcggcggtccttttccttgcctcgcgtggtgggcacaatacagaacgtgcaggtgttattgcagcccacggaaatcgccacccacgagctgatgcgggaggcgcgggcggcgggaagctggctcgggaactgccgcaattgttcagtgacctggacctgcgccttgccggtcgcacgattctgatccaacagcttgggcagatcttcgatgttcttggtaccgaacaccgcggaaacccatggcgcagtatccgcgatcttcttgcggtcaagctgggccatgcagccgccaacggcgatctgcaggttcggccgaaccagtttgacgcgattgaatcggccaatggtgccatacatgcgttcggctgcgttctcgcgtaccgcacaggtattgagcaccagcaaatcgaggtcattgtcattgatctggtcctcggttgcaggcacgtagccattggcctccagcacgccggcgatgcgctcggaatcgtgcacgttcatctggcagccgagcgtatggatatggaacacgcccttgccgcgtttctccagcaaaccatcggttccatcggctgcaatcgaggcgcgctccgcctcggtcatcatgtcttcattcataacgaccgattctatcgacggggttcgtcatgctccggtcacgtatgccattggttgtcacgatgtcaaattatgggttcttggaaagattccccgcgaacgtccagattggctggaatccgccgagtatattggtggacgtgatacttgaccgacatagccgactcaaaacctccgatctgcaagcccgtctcaaagcgttggatcttccgggaggcaccttcactcccgaacaggtcgttgaattcgttgacctcatgcaggtgtatgaaggcgcgatgtacgagatcagcaccaaactggagattctcgacgacgagttccaggtgcggttcagccatgacccgatacatcatatggaacgccgtctgaagtcggtgagctcgatcatcggcaaactggagcgcaagggtctgccgatcggcgtcaattcgattaaggacaatctgttcgatgtggccggcatccgcgtgatctgtaattaccgcgacgacgtgtattccgtgtccaactatctgtcgtcgcagtccgatattcaggtgctgcgcgtcaaggattacatcaagaacccgaaacagaacgggtatcgttcattgcacgtaatctacgcggtgcccgtgttcctctcctcgggcgcgcattacacgccggtggaggtgcagttccgcaccatcgccatggattattgggcgtcgctggagcatgcgctgcgctacaagaccgatttgccggacaacaagctcgccgagcattcccagacgctgctcgactgcgcgcgctcattgcagaacatcgaggtacagatgcagaacatccaccgcgacatcaacggcgcgccgcaagtgggcgaagcgcctaagacctcggactgaggtgctatggaatcggcctgcggccgattcattcaccgttgcggccacttcggcagcctggccggcgcttgggccagtagggtgccgaggaagatgagggcgcagccgaggtagccgcgcggggtcatcacttcaccgagaagcaacgcaccgcctaccgccgagaagaacgattcgaggctcatcagcaggctggctcgcgtcggtggcacccattgctggccgaccacctgcaaggtgtacgcgatgcccaccgagccgatgccggcgtacagaatcggaatccaggaatgagcagcgccggcccagtcgaccgagccttcgatcagcgaacccgcccagctcagcacggcggtggtgcagaactggccgaatgaaagcttgatggcgtccacggtgccgcccaaagtatcgatcaccagaatatgcacggcgaacagcacggccgtgaacacgagcaggatatccgccaggccgatcgaaccgaaaccatcggtgatgcacagcagatagaagccggcgatggacagcgccacggccacgaacaccagcatgccgatgcgccggcgcaggaacacgaaggccagcaacggcaccatcacgatgtacatggcggtcaggaatcccgcacggccggccgatttgccgtacagaatgccatactgctgcagggtgctggcggtgaacagcacgatgccgcagatcacggaaatgaccaccgggttggcgagcaatcgcgccacggccgaatcgggcttgttcgcattcagcttggcaccggtgatggtaacgacgtcggatgcaccgttcgatgcggcatctgtggagacggccacggatgcctcggtcccaacgacatcggccccggctgtatcgcccttatccgcgctcccccggccacgcatccacagcagaatcggcaccaaagacagtgctcccagcgtgaagcgcgcggcgttgaagaacatcggcgacatcgaatccatgccctggacctgcgccacgaacgcaaaaccccagatcagcgcggtcaacaacaggctcagcatgcctacgagttcttgtcttttcacggggagccagcctaacgtgcgaatgtgacagacatgaaaaagcccggccacaatgtggtcgggctgtgacgtttgacgggcaggctacatgccgctcgccaatcggctgtcgaggctagtccctgttgccgagcagctgcaggatgtacaggaacatgttcacgaagtcgaggtacaggttcagggcgcacaggatggagatcttcttgaccatttccgggccctgggcctcgtattcggtcagcagcgcgcgcgtggactgcgcgtcgtagatggtcatgccggcgaacaggatcaggccgatggcgcagacgatcttggtcatgccgtcgacctgcacgaaggcgagcacgatctgcgagatgatgagcacaatcaggccgatcatcaggatcgggccggccttgagcatgttgaacttggtagtcatgccgaacatggtcagcgcaaagaagaacgcggcggtgacaccgagtgccacgccgatcgagccgaggtcgtagaccatgaagatcgagctcaaggtgaagcccatcaatgcggcgtacacatagaacatgacgcgcgcggtggccgacttcatcttggtgacgcgcatgccgagcaccacggccagggcaatctgcaccacgcacaggccgatgaggcccaccatgccggtggccatgaggaagctgtagtaggctccagtgatctggccgagcacggcgaccacggcggtgacgaggatgccgatggtcatctcgccgtacaccttggtcactgagactcggcgggcttcctcatagttgtaggtcatcgtcgtgttgatggtggccgcacccgcaccggcaccagtaccctgcggcacgtattggtaggtgggagcgccctgcggctgggcatagtagttctggccgtaaccggactgtgcgtattgctggccatatccagactgttgggcggcgttgtaatcaggcgtgttgtattgcgggttgtattgcccgttgttctggggctgctgaccgaatgtcataatcgctcctttagcgtttgttccagtaccaatcttagaggaacaaagctgaacattccatgaatatgatcgatcggctcgttctgctcatctcaaagcgtaacgggcgtttccaccatgcgcgtggcatgcacttgagattcgattgacattcgatcgcagcttggaccgccgcgcgattcactgcaacgtgaaggtatgcgtcaccttggtgtcttgatccgttgataggaacgcagtgacatccaccgtaatcggcgaatcgtcttgcagcacatagcccagcgtcaccgttgccgcggtcccgggctgtgcttgggccaaatacgaattcgcgtcatagccttcaggctgatcgaagtatactgccgtctccagttcggtgccgttctggaacacgttcgggtgagccaaagtggcgaacgagttgttcttggacgtgttgttcgtccattcataagtcaccagagcggtgggcttgccgttatagtcgttgacgcttttcacggcggagactattttcacgtgggcaccttcgatatcaccttccaaatcctgctcgccctgcgctttctgctcggatgccttgctcttggaggcatcagacgatttgcccgcggactttgatgatgaggattgtgacgtgtcgatgcccttggactccttaatggaatcgtcaatggccttgctggcagcggactgcatggccagcgtgatcacaatggccaacaccgacagcaccgccgccacaatggacagcaccttgccgcgtttcttgccccggaaggtgcccactatggcgataatcgccagtatgacgccgatgaagccaaggattgcggcgatattgttgacgatgggaataaaactcagcaccaaacccaacgcgccaaacaccacggccgcgatgccgcagatggtggtatgcagatgttgcggttgcggcggctgaggctgaggctgttgtggctggtactgctgtggctggtactgctgtggggatgagggaaccggctgcggggcgatgttgtggttggacatgatgtgctccttctcgtattcttccccgaaatagggatgtgagcacgacgctaccggccgcgaaacagcgacgttagtggacgaacggtcattgttcgttgcctgttcgggcaatacggaggtgataacggtgcccgcatgtccagtggcgggggccggatgcaggtcatacagtggaaagcatgacgaacccacaacgcgccgccgggccataccccggtttccgacccggctcacggcctgacgctcgccctatgcccggcacggggtccccggttcctacaccggatacggacgaggtgcccgtgactacgcgcgtatggtgttcggtcgttatggtgccattggccagtttcatgtgcatggcgcaaacctcgttcttcgcccagaattttgcgcaggattccgcaggatacacgctgatggtcctctgcaccttgctggcattcccggcagggttcctgctcttggcccgcagcgaatacccggaggcgacgttctggatcgcctgcgcgctggtggtcgtgttcccgtatgactcgctcatcgcactgatggcgatgacctcattgctcgcccgtcgttcaaaccggaacacgaccatccgcgccacggttggcggcaccatcgtgacgctcatctcccagctccgcgacgccctgcaacagcccaaagcctcgatttggcatctgattttcgctcaaccgcataccggcggcgattcaggctccccgatggtgatgctggtggaggagccgaccgtcatcatcaccgccacggtggcctcactggtgttcgtgaccatcgctacgctcatcggcctgcatatccgttcgcgcgcccgcctgcgcacggcgaatgcggtggccagcgcggccaccacgcatgccgcgaccctgcagaccgacctgaccaaccagcagctcgccgacgccatcgcagccgaagcgcacgacaccctcgcgcattccctgtccctgatggccctgaacgccagcgcgctcaaggcggaggcggccaagctcggcgactcccccgaagcgcaatcgttggcggataaggccgaggacatccgtcggcagtcggccggggcattggacgaggcccactcgatcatcgacatgctgcgcaacccgcaccaggcatgggagcagctcgccccgtccgacgacacgtcgctgacccgcgaatcgctggatgcgctgattgcggacacgcgcaactcgggcacgtcgctcaacacctggatcgatatccagcagctgagcgtgatggatgagtcaatcggcaaggtggcctaccgcgcgatccaggagggattgacgaacgcgcggcggcacgcgcccggagcgccggtgtcgttggaggtctccgccacgccgcaggcgggcgtacatatccatatcagcaatccgatcgccacggatgcgaccgagacgcagcgggcccatggggccggactgcctggtttggcagcgcgcgtgcactcggtcaacgggcaatgccggtatgggatggacgatcggcacctgttccatgtcgacgtgcaactgccttggcgcagctaagatggctagcgtgagtgagaagaacgggaatagtgtgtctggtggaaagcccgaacgcggcggtctgaccggaagcggcaccggcttagagcccaagccgatccgggtcagcgtcatcgatgacgatccgatgatctgccaggcgatgagcctgatcctcaacgattattcccacgggcgcatcgaagtcgtctccacgtccaccgatggcgagacctgcgtgaggcgggctgccgaggaaaagccggatgtggtgctgatggacatcgccatgcccggcgtggacggcatcgaggcgacccgtctgctgcgctcgctctcccccgcgccgcacgtgctgatcctgacctcgttgagtccgtccggcaccgtggaacgcgcggtggaggcgggcgccgaggggttcgtgtcgaaaaccgatgcggcggacgatatcatccgccgcatcatcggggtatgcgagggcgcgccgcagttcaacacggccagtcagaaacagctgatcgacgatctgagcgtcacgcggccgcgttcgcgccgcgatgaggcgcgcgccctgctcgacgcgctgcccgaccgcgagcgcgaggccgtgatgctggcggccgagggctatacgaacgccgaaatcgcctcccgcatgttcatttcggagcgtacggcgaaggcgcatctttcttccgcggcgaacaagctcgacatgggccgcgtgcagatggcgcggctggtggagcgggccgatctgccggcgcggctgtaagtcgtccggttgttgagccgtatcagtcataatgggaatatgagtgaagcgattattcgaacattacgtagggatgactatccggcgctgatcgacctggtgcgccgcacctggtatgccgaattcgatgagcggaccggtctgctggcggccgaagcggactgggagaactgtctggcgcgcaccaccaacgcgttcgtcgccgaactggacggccagccggtcgccctgatcgtggggcgcgtcgatgcgctggaccatcggagcccgctcaactcgcatcggatcaactcgtggaacgcgctggcgcggctcgtgttcgcgaagggcggaatcaaggccgccggcgagattctgggcattctcggcatcgacaaacggctgcgcgcccaggccgcgagcgccgggcatgactatgcggcggaagtggtgctgttcgtacttgacccggcggcgcgcggccacgggctgggccggcgcatgttcgagacgctgatggacgcgttccgcctggccggcgtgcgcgactacttcctgttcacggacaccacatgcgatgtcgggttctatgtgcatcgcggcctgacgcaggtgtgcgagcagtcactgcccgcatccgtgccgggagaaaacccgtcttcgttctacttgtatgaggggtcggtgcccgagccggcgtgatgtgcccgccgtcgggcaaacactggtaggcttgagcacaagttggtatgccggcataccgtccacaggccggcgacgaaggggctgacatggcaatcagtgcgaaggaactaccactcgggaaagtgttcaccccggatttccggttcacgatcccctcattccagcgggcctacatctggaagaccgagaacatcctgcaactggtaagcgacttggatgacgcctgcaagtcgcccggtactccgtacttcctcggctcgctaattctggtgcgcgagggcgataaccgttacgacgtaatcgacgggcagcagcggctggtatccctgtcgatcatcatcgccgtgttgcgcgatctggagcgcgatccggacctcatgcgccaactcgatgcgctgctggtggagcccggcgacaagctgcgcggcatcgtcaccgagcctcgcctcacgttgcgcgagcgcgacgcagcgttcttccgcgaacacgtgcaggaagacaatctcgaatccgtgttcgatatgaacgacgatgatctagcgaccgcagcgcaacgcaatatcgtagccaacatccgtaagacgtacgacgagatttccaattggtcggatgccggacgccagcaattcgcgcagtatctggtcaacgaggtgacgctggtcatcgtgaccaccgacgatctcgacggcgcgcatcgcatcttcgacgtgatgaacatgcgcggcctgccgctcacctcgtccgacgtgttcaaggcgcgcgccacggccggcctgtcgaccgccgaacttgacgtgtacgccgcccgttgggatgacatcattgacccgattggcgacgatccgcatgactgtgaggaattcttcgcctatctgcatctcgtgctcacgcacaagccggccaccgacaagctcatcgaggatttcctggccgacgtgctgcaaccgtacatcgacaaaggcacggtgcccacgttcatcaaccaggtgctggcaccctacgcgatggcgtggcggatcatcgcgcgccccagcgataccgtactgcccgccgaggtgcgtagccggcttgagggattggatgattaccgcagccacgaatggaagcccgtggccatgtgggcgttggtcaattcgtatcgcgggctgggcgacgccgatttgtcgccgtttgtggttcgtgcctcgcgtatcgccagaaccacggccacgctggaatcgttgggtgcccatgacgagcgtcggctgctggaaattctgaccgcattggaacaggtgaccggcatccgcacgctgaatcgcactggagcgttggagcggcgcggttatgcgaacgccgccatccgtgatcttgacaagggctatctggtccagcgcgtgaacgggttgcatgtctcggacggcgaccgtgaaggcgcattggtccgtttgcatggcgagatgcagggtgacggcgatttggtccgtctgctgctgattcgcgccaacgagcagaaggccggcatgcagttggatcgaccacgccggttcagtgcgctgccgattatgccgttggatatcgaacggtcgaaatcgtttgcggactggccgcaggatcagcatgatttctggatgtaccgactcggcaatatggcgctggtgcagggccctgaggatcagttggacaggttgagtgaatatccggcacgtcgcgaccgcatgctgttgcgcgcggattcgcgtcgtttcccgctgaccaatcagttgaaggatttcgctgactgcacacctgccctgttggaagcgcggcaggaagaggcggtccgactcatcgtggaatactggggcatccggtatgacaaggacgcccgcgatctgaccaagcagaatgtcgatgagttgtcgaagacctctccacggccgtctcatagttcgcggcgcgtcacgatccggcaggtgattgacgcgggtcttctggtgccgggcgagcgtctggtgtgggagcggccgcgcaagggcgagcgctggttcgtcacggtcaccgaaaacggtcgtctccgtctggatgacggctccgaatatccgactccgaccgccgcggcccgtgccgccgccggaggacgtcgcggcggcggtctggacgtgtggaagcgcacgcgcaacggccagaagctcagtgacatctggaagcagttccgtctgcaggcgcagtagccggcacatcattggtggctcccctccgtgaggggagccacacgcttgtctatgccagcgccgccacgatttcagccggcgttttgcaatattcgggaaaatgcttggctagttttttgtcatacgtcaccacataggtggccccggattgttgtgcggcggcgataataaggtcatcctcgaaatcgttatgcgcgtgccgcaacgactgcgccaattcacattcctccgcgccaatcggcacgattgtcatgagctccttgagtttgctgattcccgaccatgccacctccggcaatatcagcttggcggtggtcgcaacgaccatggattcgtcattcatgaatcgttctttgaatcgttccggggtgatgtagaacacgtccttcagcgacagtgacgcacaggacagctttacctcccgctcgacgcatcgctcgaacagtttcatgacatccttgatgaaccgaggcgtacagagcatgtaataaataaggatattggtgtcgcacaagatcgacacctgctttgactgcctcatgacagactccgctccttctccaaataacgcgcatagtccgactgatgcctgtattccttcagccgttcgtcagctatctcatcgcggaactgcttgtaggtaaggccttccatgaggtcggtgtcttctgagatcagtccggccttgaccagttccttgtgtacgtatccggcaccttctcgaatcagtttcagcttgcgctgcttttcctcctcgcgggcttgctcttcggcggtcgtttccaaggccggcacttccttgcggtcggcgatgtacaaccacagcgaccggattacgtcactcaccgatacgcctttgcccttgaggacttcttcgacctcgttcttcagtttcgcatcaatgcgaacgttcatttggaccatggtcatggcaacctccattccaaagatgctatacagtatagcatactgacgtgcatgaaaaaggccggcatccgttggtggataccgacctttactccccctcagtcagcttcgctgacagctcccctcagagaggggagccagaataagtcacttcatgaggttgcgcagcacgtactggaggatgccgccgttacggtagtagtcggcctcaccgggcgtgtcgatgcggaccaccgcgtcgaactcggtcttggagccgtcctcgtgggtggcggtgacgtggaccgtcttgggggtcacgccctcgttgagcttctcgacgccggcgatatcgtaggtctcggtgccgttgaggcccagggactcataggattcgcctgccgggaactgcaacggcagcacgcccatgccaatcaggttggagcgatggatgcgctcgaagctttcggtgatcacggccttgacgccgagcatcaccgtgcccttggcagcccagtcgcgcgaggagccggtgccgtattccttgccggcgagcaccacgagcggcaccttgttgtcgatgtagtcgcgggaggcttcgaagatcgtggtcggcttcttggcgaggaagtcgtaggtgaagccgccgggcgtcacctcctcgcccacggaggcgagcagctggttgcgaaggcggatgttgccgaacgtaccacgcaccatgatctcatggttgcctcggcgagaaccgtaggagttgaagttcttcggctccacgccgcgctcggtcaggtacttgccggccgggccggaggccttgaacgcgcctgccggggagatgtggtcggtggtgaccgagtcgcccaggagggccagcacgcgggcgccgtggatgtcggcgaccgggtccggcgtggccttcatgccgtcgaagaaggtctgcttgcgcacgtaggtggacttgtcgttccacgcgaacagctcgccttccggcacgtcgaggcccttccagcggtggtcgccgtcgaacacggaggcgtagtctttgaggaacatctcgcggctcacagtgccgtcgaccacggcggccacctcggagttggtgggccagatatccttcaagtacacgtcattgccgtccgcgtcggtgccgagcggttgggtttcgaagtcgaagtccatcgtgccggcgagcgcgtaggcgatgaccagcggcggggaggccagatagttcatcttgacgtccgggctgatgcggccttcgaagttgcggttgccggagagcacggcggtgacggtcaggtcgttggcgttgatcgcctcggagatctcgggcagcagcgggccggagttgccgatgcaggtggcgcagccgaagccgacgagctggtagccgagcgcgtcgaggtcgtcctgcagaccggcggccttcagatagtcggccacgacctgcgagccgggggccagcgaggtcttgacccaaggcttgggcttaaggcccttggcatgtgcgttgcgggcgatcaggccggcggcgatcatcacggacgggttggaggtgttggtgcatgaggtgatcgaggcgatggccacgtcgccgttttcgatgtcgaaatcgccgcggaagtcggtggacacggccaccggatccttgacggtcttctcggtctcataggcgggagcggtcttctcgaacatctccttggcttcggagagcagaatgcggtcctgcgggcgcttcgggccagcgatggacggcaccacggtaccgaggtcgagttcctcgtattcggagtactgcggttccacgtaatccgggtcggaggcgtcgccccacagcttgttggccttggcgtaggcttcgaccaacgcgacctgttcttcggagcggccggtcaggcgcaggtagtcgagcgtgacgttgtcaatcgggaagatgccgcaggtggagccgaactcggggcccatgttgccgatggtggcgcggttggccagcggcacggaggcgatgccttcgccgtagaattccacgaacttgccgaccacgccgtgcttgcggagcatgtcggtgatggtcaggaccacatcggtggcggtaacgccctccgggatggagccggtgagcttgaagccgaccacgcgcggcacgagcatggagatcggctggccgagcatggcggcctcggcctcgatgccgccgacgccccagccgagcacgcccagaccgttttcggtggtggtgtgcgagtcggtgcccacgcaggagtcgaggtaggcgagcgtgttgccgttggcctcggccttgctcatgaccaccttggccaagtattcgatgttgacctggtggataatgccggttcccggcggcaccacgcggaagttcttgaatgcctgctgaccccagcgcaggaactggtagcgttcaccgttgcgctggtattcgatgtccatgttctgctggaccgcgtcggcgatgccgtacttgtcgatctgcacagagtggtcgatgaccatatcggactggacctgcgggttgatgacctccgggtcgccgccaaggtccttgaccgcgtcacgcatggtggcgaggtccacgatgcagggcacgccggtgaagtcctgcatgatcacgcgggacggcgtgaactggatctcgtggctgggttcggcgttcggatcccagtcgagcagggtcttgacgtgttcgtcggtgatgttggcaccgtcgatgttgcgtaccagattctcgaccagtaccttcagcgagtacggcagatgatcgatgccgtcaagattggcgatgttgtagtaatcgaagtccttgccggctgccttgagggtagccagctggtcgtcgcgtaaggacatgcttcctccgaaatcatgaatcggcttatgatgccgttgattatccgatacaaatggtacgggtacgttactttggctctggcgtgtcggcttgaagtgtgagacaattcgccgctattagatattgaaaccgtgctggcgcagtagattgccgaatattctgccgaccagcggagccagccatagacagatcacgaaaatcatggccgcgccgcccaacgcaatcagcgtggccaccaacgcagtgccggtaggcagaatcagcgcgaagaagttcgccacgaacgggatgaacgcgccgatgatgccggccgccgcgaaccccgcgaccagcgcacctcgccagctgttgagcggcctcgccacacgggccagcacaaacacgcccatcaaaaacagaataatggcgctggtggcgcgcaaagccgacagatcggcgtcattgttcaccacatcccagcccatgacgttcggcagggtccatgaagccagcaacaccgacagcgcggtggcgatgccgcccggcagcgcgaacgtgaccacgcgcttgaggaatcccggaatatagcggcgcgtgttcggcgcgagcgccagaatgaacgcgggcatgccgatggtgagagcgccgatatacgtgatatggcgcggcaggtatgggtatgggatttgcgtcagcactacgccgagcgagatcagcgcggagtacacggttttgacgaggaacaggctggccacgcgctccatattggccatgacctgacggcctcgcgccacgacgtccggcaggtgcgagaacttcgaatccaccagcaccacctgggccacggccttggtggcgggtgccgcattgcccatggcgatgccaaggtccgcctccttgatggcgagcgcgtcgttgacgccgtcgccggtcatggccaccacgtggttctgcgtgtgcagcgcttgcactatggccttcttctggtcgggcagcacgcggccgagcacatcgacgttttcgagcacgcgggcaagttcgttcacgtcctcaggcagttcgcgcgcgtccatcgccaccggctcatggtcgccggtgagtttcactctgcgggcgatggcacccacggtcactggattgtcgccggaaatcacacgacagcgcacaccctgctcacggaaccaagcgagcgtccgctcggcgtcctcgcgaatcttctcagagcacaacaccaacgccaccggctcagcctgcacatccagttgcgggtcgtccgagacattggctccctcaactgctcccctcagtcgcttttggcgacagctcccctcggagaggggagccagctcgctcttctcggctcccctctccgaggggagccgtccgcgaagcggactgaggggagctgtagaccgcgcaaccagcaacacacggttgccgtcattggcatactcgttaacccgctgcaacaccgacgaatagtcaccctcaagcgcagaaataataacctccggcgcccccatgtaccaggtctcgccggatttacgcaccgcgctccatttgcgcgccgaagagaacgggacacgagactcaaccgcacctgccccatatccttgggccttaagcccggcgagtacggcttggccggtgccgttgggctgctcttcgttgcagcagtcgtagagagactgcgtggctgcctgttccgcagtcgcattggcggagccgagcatcacgagccggttgaaggcgataccgccatcggtgatcgtgccggttttatcgaggttcagcgcgtccacgcgagccagtgtctccacggattcaagctcctgcaccagcgtattgtgacgggcgagacgcatggcggccaccgcgaagttcagcgaagtcagcagcaccaagccttcgggaatcatgcctactacgccggcgaccgcggaaaccacggcttgccgccattcgccggtggagagtgccgtgccccaaccgccgaccgtatgaatctgcgaaagaatcagcagaatgcacagcggtaccacgaggaaggtcatgaatttcagaatcgtgttgatgcccttgttcaggtcggacacggttttcttgtataccttggcctgcgcggtgagcgtggcggcgtaggaatggctgccgaccgcattgaccttgaccaatgccatgccggagaccgcggtggcaccggaatacacctgctcccccaccttgtggcgcacggtacgagattcgccggtgagcatggattcgtcgagttccagtccccaggtctggatgatctgcccgtcggccggcacctgttcgccggcacggatccacagcaggtcgtcgagcacgatctcgttgtggggcacctccacgtccctgccgtcacgatgcacgaggaattcggaggccacaaggatggaaagcttatccaacgtgcgcttggccctgagttcggtgacgatgccgatgcccgtgttgatgatgatgacgaaaccgaacaccgcgtccctccaggaaccggtgatcagcaccagtaccatcgcggcgaagatgatgccgttgaacagcgtgaatacgttggctcgcacgatatcttgaaccgaacgcgaggtggatgttttcaccgcattcgattggccactttcgatacgctgcaccacttctttgggggtaagaccggttgctccgatctcaggcatttccacggctgttgttgcactcatattccccagcctaccgcgtcttgtttcgcaatccgctaaggctcagggatgattcagggtgctttctcagcttcaagggcctgattcggctcaggaaacggtgactttgatctcgcgttcgtggggttcgtcgcgcgtgatggtgagcacggcgtcagtaatagtcattggcttggtatcggcagtgtcgccagaatcggcactgttggtgttgaggtgaaggatgacggcgtacagcagttcatcttcgggcgcatgctttggatcaatgagagcgactggaataccggcttcacgcgcattggtcaacgtctggttccagctctcccggttggcgtcggtaacgtcgatgccgctgataaccacgattttgaccgcgcgagctacgaaatcggcaacaccctgctgtgcggtggccgcattcttgtcgacgccagtatgagcatccatactatcggcaccgttttcgctggtagtgccggcgtcagaagattcggtttcaccggatacaccatcagttgcgtttgccgagcttgcggatgtttcgagcgaggcatagtagacattgagtttgtcatcagacagcgcattgatgacgaactcgtctgcggcggtgtcagtcgaccccacaaagccgactgtgacatccgtgggatgtgtggaatcgtgggcgacttccggcatgctgtcttgggtatcgccaaccgccctaccggccggcgtgcaggcggccagggacaacacagccgccatgcaggccagcaatccgagaattcgtcgtgtcatatgctcacctgtcagcgggtaaacagggccaccgtctcaacatggtgggtcatcgggtagatatcgaaggcacggatgtctttgagctcgtagccttcgccgatgagtgtcgcggtgtcgcgtgcgaggctggtgggatcacaggcgatgtagaccacgctggatgcgccggccgcggcaatctggcggcagaccttggcacgagcaccggcacgcggcggatcaagcactacgacattcggcttggccagatgcgccggcacatggtccagcgtgcgcgagacgtcacccgcgcgggcgtccacgtcgttcaggttcatggcgcgcagattgcgctgggcgttcttgacggccacacgcgcgccttcaacgctgagcatgcgggtgcgttcaccggtcattgtggccagcggcagggtgaacaggccggaaccggaatacaaatcccagattacggcgtccgccgctgactgcagctgcccgttgaccaggttgatcacgtgcgtaccgagggcgatcggcgcttggcgatgcacttgccagaaaccgttggcgtcaacctgatagtcgaaggtcgtgccgttgatggtcacctgttcggtgagcagctgggagccggcgcgcagttcgccgtccacaagtacggcgtaattgtcgtctgctgccgcggtatcgacgatctcgccgcgcggttcgggcacggaaagacgaatctgggagccgggttcaaagccgccctcccacacgtgttcgcgcttggcgacgtccagcagcgtgcgcgtggcaagcggcatggtgtcgatggccacgcggttgtgtgtgccgcgccggcgcatggatggcatgccgttgtcgtcggcaatcatttcgatgcgggtacgccaattgaggccgccggctgccttgtcgccgggcatgcgctcgatgggaacggccacgtcgatatggccgagtcggctcatctgttcggagacggtgatggccttccacttgagctggccgggcaaagagacgtgcacgagatccgcgccgcccactcccccgcccatcgccaagggaccggcaagtggccatgccggggtgactcggtcttcggacggctcgagaacctcgacgacttcgccggtccagaaccggtcgtcccggtcgtggggctcgtcaagttcgactcgcacgagttcgtcgggcaaggcgaagcggacgaacaccacacgaccgtcgatatgggccacgcagcggccttggtcggcgtatcgttcgatacgaacttcagcttgcatcatcgtcctttccggttgcgctcggttcgagttcggcatcaacagcgacttcagtctgtatcttcctagccgcgaccttatgccggtgcatcggcgtggcaataatgaggtaactcacccaaatcgccaatgcccagaacggaatgcccatgagcaggcgggtcacgccgagtgcagctacatggttggtcagatacagcggcacctgcaccaccagccgcagcaggaacagaccgacccacaggccggtgacaatcatataggcgcgtttcagggccttgtcgtccatccagtcatggaaccatgccttgaaatgctcggtgggcaggctacggatgaattcgacgaccaaacccagtccgggcacgcgcgcaatcagcgacacggcaagcaacgcggcatagccagcattggtaatgaatccgaagatgtagtaattgcgggcctcatgagtctgccatgcccaaatcaggcagatgcctaccgccaccagaccagagaccgcgcccattaccgactggcgctgaatcagtcgcacaataacctgcaataccgccaacacggccgaaaccgcaatggtgagattcagattgctcgtggccacgaacagtacgacgaacaccacgccaggcagcatggattcgatgacgccacgcgggccaccgatggcgtcgatgacggagaaatcctcgccttcattgccggcgtcggctagagcggacaggccggtgcgtttgttgtctgccaagtctcttcctataaatcagcgaacttcggagaacatcgggccgcgagacagcgtggtcttcacttcggtctgctggtcctggctcaacgggcccttcggcttgttgtccggaatgtccttgaagtgttccttgccgttcgcctcgccggcttcggccgcggccttggcggccttacgctcagcgggggcgaccggcggatgcatcgggatcagatcgcgcggcgccaaaggctcctcgccacgctcgacgacgatgccggcgaagaacttgttcagcgcctcggtctccgggctgtccggatcgatagcagccttgccggagaagatgccacgcagcatccagcgcgggccgtccacaccaacgatgcgcgtgttcacggtcttgccgcccttgacattgaccggcagcttcagttcggtgccgaacacaccgtccacttcagaagcggccttgttggcttcaagcaggtcaccgcgaacgtcatcccacagtcccagggtcttgggtgcggcaaaggcttcgatctccaggctggaggagccgaaggtgatggtggaaccaagcacttgctgggtggcgcggttggccttgatacgcagttggatgccccggaggaagggcaggtagtaggcgcccagatccagataatcgtcataatcgggcacgtcctcatcattgacgtcccacgggcctcgctcttctccgcggccctggtattcgctggccggttcggcgagcacggtctccgcgctctcggcctttgcggcagcgttcgcttctgcggcagccaccttgtcttcatcgacaggctcaacggccggctcggcttccttcttgctcttcttcttgccgaatccgaacagtcccataattcctcgtttcatgtaacggttgcaaccttgctaacactagcactcaggcttagagaaagctgagtcacacgtcgtatgtgatggtaagtggcgcgtggtcggaccaacgcaactcgtatgtgggggccttgtcgatcacaaagccgcgcgcggtctccgccagctcgggcgtggcgaactggtagtcgatgcgccagccgacattgttgtcgaaagcgcgcccgcgctggctccaccacgtgtacggaccctgaatatcaccggcgagcgaacgcatcacatccacaaactcatattcatccagccacttgtccacgtaggcgcgctcctcgggcaggaagccggcgtgcttttcgttggccttggcgttcttgatgtcgagcggcgtgtgcgcgatgttgaaatcgccgcacaataccgcctgcttgccgccgtgcgcggcctcgtcgcgcaactcgcccatgcgagtgagcatcgtgtccagaaaacggtacttctgttccatcttggtcgaatcatcggtgttgccggcgtgcacgtacacgcaggccacggtgatcgtgtatccctgcggcgtcttgacatcggtctcaatccaacggccggaatccacatcctcgctcaagcccggaagtccatagcgtttatcggtcacctcaagatcggtgaggagcccgactccggcacgacccttgacacggcagacctcgttcagcgaatgcaggtcagagggtgaggcgatcttgccggcggtggcatactcgaaaccgaattcgccgaaaatcgaatcgacatcctcttgcggggcgcgcacttcctgcatacaccagacatccggagcatgtttgccggcccagtcctcgatgcccttgcgctttgccgcgcgaatgccgttgacgttcgatgtggtgatggtgatggtcatgcagccatactattttggcctctctaccagtaccgcactcacgattacattgaggtataaaaaattagctccctcataagagggagctaatttagaatgtcctatcagtccaaaccgagctggagcttgccgccggggatggcgtcgagcaggtctcgggtgtactgcttctgcgggtggtcgaagacctcgtcggtggtggcatgctccacgagcttgccgtgctgcatcaccacaacctcgtcggcgatctgacgaaccacggccagatcgtgggtgatgaacaggtagctcaggcccttttcggcctgcagatcgttgagcaggcgcaacacctggtcctgcaccagcacgtccaaagcggacacggcctcatcgcacacgatgacgtccgggtccagagccatggctcgtgcgatggcgatgcgctggcgctggccaccagagagctcgttcgggtaacggcccatcacggaagccggcatctcgaccatgtccagcagttccttgacacggttggctcgccacttggaatcgccgatcttgtggatgcgcagcggctcctcgatggaacggaagatggagtacatcgggtcgagcgaaccgtaggggttctggaacaccggctgaacgtggcggcggaaaccgagcagatccttggccttgaacgtggaggtgtcgcggccttcgtagaacaccttgccggaagtgggcttcaggaggtgaagcaccatgttcgccacggtggacttgccggaaccggattcgcccacgatggccagggtggtgccgcgcttgacggagaaggacacgtcgtcgacggccttgaacatctccttcttgcggggcagcttgaattccttggtcaagtggtcgacggtgatgatgtgctcgctcttctcaagcgtgctttcgccggcgatgtggtgatcgagcagggcgtccgcgttctcaccgcgctccttggcggagatgatgcgctgggaggccagcgacggggcggcggccacgagtcgcttggtgtacgggtgctgcgggtgctgcagcacctcgagggacggaccggattcgacgacctgacccttgtacatcacgacaatgtgctgggcacgctcggcggcaaggcccagatcgtgggtgatgaacagcacggcggtgcccaacgagtcggtgagcatgtgcaggtggtcgaggatgcgcttctgcacggtcacgtccagagcggaggtcggctcgtcggcaatcagcaggtcagggcggcaggccagaccgatggcgatgagcgcacgctggcgcataccaccggagaactcgtgcgggaactgacgggcacgggtagcggcgtcgggcagaccggcctcggacagcagacccgcgatacggtcatccattgtggagccgatgacgtacttcttggcgaggtaccaggcctgatcgtcggccacgccggccttgatgaggtcgtcggccacgcgccaacgggtttcggagcccggaacccattcgttggtgaagcgggcgacggccttgtcgaaggcctcgccggacacgccggcttcggtcaaagccttcttggcctcggtcatgagctcgggcagttccttggcaccgaggaaggtctcgtcgtcgttgcccttgacttcgacctcgtcgccggccagggccttggcgagggcggagcgcttctcatggtccacgtccatgttgttggccttcagtgcttccttgacctgggtgccgatacgccacaccgggttgaggttgctcatcgggtcctgcggcacgaggcccatcttggtgccgcgcagcttgtcgaactcgctctgcttggcgccggcgatttcctcgccgtcaagcttgatggagccgttgaccacgtgaccggtgccgggcagcaggcccagcacagccatggcggaggtggatttgccggagccggattcgcccacgatggccacccactggccggggtagacggtgaagttggcgtcgcgcaccgcatgcaccggcttgccggtgtcagtggtgaagtcgatggccagatccttgacctcgagcagcggaccatgctctttctgcatagccagcatcttggcgttggtgttgtcagtcataatgattctccactcccctcactcaggccgtacggctcttcgggtcgagggcgtccttgacggcgtcgcccatcatgatgaacgcaagcacggtgatggccagtgcggcggacgggtagaacagcaccatcggatcggtctgcaggttggtctgtgcgctggagatatcgccaccccagctcaccgtggtggtcggcagaccgacgccaaggaagcttagggttgcttcggccacgatgtaggaggccagcgaagtggtggcgatgacgatgatcggggccaaggagttcggcaggatatggcggaacagattcctggcaggcgtggagccgagggccgtggaggcggtgttgaattcgaggttcttcgattccagcacggcgcttcgggcgatacggcatacgccgacccagccgaagagcgtcagcaccagcacgatcttccagatggacttggaggtcttgaacatctggagcaccacgatggcgccgagcagcataggcagggcgaagaagatgtcggtgatacggctcagcaccgcgtcgacccaaccgccgaagaagccggcgacggcaccgatcagggtaccgacaatcacgaccagtagcgtggagagcacgccgacggacagtgaggtacgggtgccgtagaccacgcgggtgtacacgtcgcagccctgcaggtcgtagccgaaggggtgtccggcggaggcggggctcaaggagttgcccagatcgcaggcgttcggatcctgcttggtgaacagaccgggggcgatggccaccacgatgatgaagaggatcagcagcccggagatgatgaacagcggattgcggcgcagggttcgccatgcgtcggcccacatgctggtggccggtgcggattcgtcgacggaatcgacgtcctgcaacggggtctcgtcgagaggagctacgtaacggtcctgaccgggcagggtttccatgaagtattcggttcctggctcgccggtctcgttgagctcgttttcagtggtttcgtttgccatgtgactcactcctccctatcacgcgtaacggatacgcggatcgagggccgcgtacagcatgtcgacaacgaggttgcacactacgaaaatcagcatgagcaacgtgacgatggacaccaccaggtttgcctcgcccttcagaatggactggtaggtgaggaagccgatgccgtggatgttgaagatctgctcggtgatcatggcaccacccatcagggcgccgatgtcctggccgaggtaagtgacgactggaatcagggagttacgtaacacgtggcgcagcatgacctgaccgttcgacatgcccttggcgcgtgcggtgcgcacgtaatcctcggcgatgttggaggagatttcggagcgggtcagtcggatgatataggccatcgacaccgaaccgagcaccatggccggcatgagcagatcaaggaagccggggtcggcgcctgccgtcaccggcaatatcgctcactgaataccaaagacatattgcatgacgaagccggtgacgaaggtcggcacggaaataagcagcagagagacgatcaggatgacggtgtcgtaccacttgcccttcttgaggcccgagataatgccgaagaccacaccgaaaatcgcctcgaacacgaacgccatcaagccgagcctgatggtgaccgggaaggcgcgggtgatttcgtcgagaacgggctggccggcgaaggtatcgccgaagttcagggtcagtgcattcttcaggtagataaagtactgaacgatgaacggctggtcgagatggtattctgcgcggatctgggctgcgacggcgtcattgacgggcttgtctccgaacatggccttgacagggtcgcccggcagggcgaatacaagggcatataccagaagagtcgtaccgagaaccacgggaatcatctgcagaatgcgtcgcagaagatacttacccatacggttgctccttatttcctagaccggccagaaagggcatagtacgcccccgccggtcgataaatactccgacagtttaccgcatgcccggactgtgatatgtaaatttgcgttaacgcaaggtttgagattgggcaatgttggtggatatgtccatggttgcggtcggatagtggatactttaacttggttcccgatggcgtgagcaagcacccctcacacaacaaaaagggcggggatcttgcgatcctcgccctttatttccgaactacctaacggtatccgttcagtgagtcagactcacttcttggacatctcggtgtaggtcgggaggttctgccaatcgaaggcgtagccggacttcacgttgagggaagccacaccggaggcgttggagtagtacagcgggatggccggaaggtcgttgaggaggatttcctcagcctgctggtacagcttgttggcgtcatcagtgctggaagcggcagcagcctgcttgcacaggtcatcgaaggccgggttcttgtagtcaccatcgttggagccgttgccatcagcagcagcggtggagtacagctgccacaggtagttctcggcgaacgggtagtcaggctgccagccggtacggaaggcgcccttcatctgacggttggtgaccgcgtcacggaattcctggaaggtcgggatcgggttggtggccgcgtcgatgcccaagttgttcttgagctggttcacgatagcatcgtagagcggcttggcaccaccatcggcgttgtaggagaaggtgagctggccgtcgtacttggagatggcgtcagccttggcccacagttccttggccttggaggcgttgaacttcaggttgtcggcacccttgagggagtcggagtagcccggggtcttcggggaggtgaactcggtggcggcggtggcgttgccgttgagcaccttgtcgatgagctggtcacggttgatggccatggagatggcctgacgacgcagctggccttcctcgtcgttcttgaagtggtcaagggaggacgggatggtgaaggtctggatgacggagccggcctcggagtaagcctggaccttcttgtcggtcttgaaggtcttggtgaaggcagccgggacggattccatcacgtcgaggttgccggcctgaatgtcgcggtaggcggcggagtcgtcggtgtagaccttgaaggtcacgccgtcgttcttgggctgctcgttacccttgtagtcagggttcttgacgagggcgatttccttgttgtgatcccagtggtccagcttgtacgggccattggagacaggcttctcgccgaaggccttcggatccttgtagaaggactcgggcagcggggcgaaggccgagtagccgaccttgatcgggaacacggagtcggactggttcaggtcgacggtgaaggtggtgtcgtccacgaccttgaggccggagagctgctcgtcacctttgaggccatccttctgcagatcgtcatagccggcgatggcggagaagaaggaggagcacttctgggcgttcttggcgttggccacgtaggaccaggccttggtgaaggactcagcggtcaccggagtgccgtcggtgaacttccagccggacttgatcttgatggtgtactgggtggcgtcatcgttcggggtgatggactcggccacttcgttggaagccttgccgtccttgtcgaaggagaccagacgggagaacagcaggtcgaccggcttgccgccgccggtttcgttggtgttgcccgggatcagcgggttctgcggttcggagttgtacgcagtgatgatgttggagccagcggtgtcaccggaggcagcgttgctgttggagccgccgcaggcgctcagcagcatggccacggagcaagccatggcagcgaaagcaagagctttcttcttcatatgatttctcctattcattaggttgcgaagcgtttcagcctcgcctcatgcgaacggggtcggatttcctcatcgtcgggacacttacgcttcccgccgcttcggacacccaaccccgttgctgttacctgtcatttttgcgcacttgggagacaagcagcgtatttttgttacacccatgtaaaattcgggggcttttaccggctaggttcagtctttgctaagtttgttaaccaatgcccacatagtggtcatgcccggggaaaggcctgtccgtaacggttcttgagctgctcgatggagacgtgcgtatagcgttgtgtagttttcaaggaggaatgcccgagcatctcctgcacctccctcagatcggcaccgccgtccagcatgtgcgtggccgccgaatggcgcaacgcatgggggctgatgtccggtacgccggcctctcgggccgctctgtgtacgatgtcacgggctatgcgttggtcgatacggccgcctcgtgcgccgaggaacagggcgttggcagcacgggacttgactgcatccgttgccgtacgggccagtaccggccgcccctgttccagccaagtctccagcgcacgctgggcgggtagtccgaacggcaccacgcgttgcttgttgcctttgccggtgactttgatggtgcgagtggagaagtcgatgtcggcgatattcatcgacaccagttcggcgacacggatgccggtggcatacagcagttcgagaatcgcggcgttgcgctgcgattcggcgacgactcgggcgctgtcgcgcttgtctgcacgggcgggtgcctcgttgcggtttacggtgtcggctgacttatcagctgtcttgccgactgccttgccgctgccactgccggacgcggctgccgctcccccatcgcccttgtactggtttgttgcaacggcctgttcggcgacatccaataactgctcagcttgagattcggtgagcaccgcgggcagcgtgctgggaatcgagggagtcatcagtgtggcggccgggtcggtgttggtcaccccatgctcataggcccacgcgaagaacccgcgcacggccacggttttgcgggccatgctgctgcgggcgtgatcgcgcgattccaccgccatccagctacgcagatcatccagcgtgatctcgttcagatcggtcacgccgcgcagctcgaacaggtgcagacatgccgtgagatccgcgcgatacgctttgagcgtattcgctgacaggccgcggttggacttcagataggagacgaaggagtcgatatcgccgtcgaactgcgtagatgacactctcgttctcctccgaattctttatggccttgggttacggccggggtggcgtgttgcgccgctccggcacgggtttcaatgtggcaatctgttcctgatggatggtcacgttctgggccgggcgcgaaccattggcggcggcgtcacgcaccatctccaacgtgtatccgtcccaggaaaccacgtgacccacatagtcgcggaacttcatacggtggtcgaccgggtcaatgccgtcggtgatgcgcaccaccacgcgggcaccggccggaatctgccttggtaacgtcatacgtcatcatcccccttaaccattcgccgcatcaacttcgatgcgtttcccgaaaaacggtacagactaccttactcctttgagcctttcgaacagcggagccacacggtcttctcacgaaaacaagcgggaacttcatccccctcgcgcggccttcttcgtgacaggcggcgaggggaacctgcgcacgggcctacatggcggtacgcagttacatggcggggcgcagttggatgatggcctgacgtggatggacgaagccggtgatggcttctcctcggcgtgcggagaacagcagggtctgctgccagccggcttcggggacgacgagctcgcgttccgggaatccggcggcagttgtgccggcttgcggcgcagcggtggccgtaccgtcttgtgcagcggtgatgccggcatgtgtcacggcggccttgtaccggcggaaggggtcgccttcggcgaagaatcccatcacatcctgctcgccggcggcaccagcgtgcagttggtcggccatatcggtcagacgtgccgccatgcggcgcagcagcgcttcgacgttcagcgagtcttcctcgaccatcgcgcgcgtgcggtccgggtcggtcagggacacgcgggtcatgtccctccagcagccggcggccagcgcggcggcgatgttgcggtccgggttggcgaccagttcgttgatcagcgcggtggacaccacatgcggcatgtgggagatcatcgctgcggccttgtcatgcgtttcgtcgtccacgacgatgacgcggttgccgacgtccttggtgatcatcgcggcgacgtcgaggaagcggcggtagtccgtggactcgtccacggtgatggcccatagggcaccgtcgtacagatgcgggtcggcggcctgccagccggacagttcgttgccggccatcggatgggcgccgacgtagcacttccccagcccggcagccttgacctgatcgcggaccatgcccttgaccgagcccacgtcggtgagcgtggtgttcggatggtcgcccatgagcggggccagggcggcgaggattgcgggcatcgccttgagcggattgcacagcacgaccacatccggctcggcatccatgagttcggagagcgtgctcttgcagaaaatgccatcggcttcggcctgggcgtaggggtgcgggcgatggttccacgcgacgacgcgcacgccgcgctcggtcaggcggcgtgcgagcgagccgccgatcaatccgagtccgacgattccgactgtatctaccacagcagttccttccttgcttcctcggtgtactgccagccttccggcgcgcgattggtgatgtggacgccgccctcgggcagcatccaggcgtcgaccggcgggttcgggcgttcgcggcgtgggtagacggccagggtttttgcccagtcgccgtgtccggcgatctcttccagtgcggtgcggaatctcggctcccagggggcggcgtcaagggtggcgatgaagctgtaggttccgtcgtggcctttgatcgggcgcgagatgaagctggtcatgttcagtcccgcatcgcgcaggacgtccagcaggtcggcgagtacgccggggccggtgaccagcgggatgaaggtgatgatggtttcgaagtcgccggcgtcattgctgtgggcgcgggcgttgagttcctggaccacatcacgcggggcgatgacaaggaattcggtgtgcgcgccatcgaaatcctgcacatgttcggcgagggtgtcgagatcgtagagttcgccgcagatgctggggccgagcgccacgcggccgggcttcaggtcgcggcaggcggcggcgttggaggatgcgggttcgggctgcaaatggtgttcggcgatgaaccgggtgcattgggccagaccgtgcgggtgggcgctgacggggttgccggtgcagtcgtagatgctgtggccgcgcacggtgaaggcgttgaaggccacgtccacactgatccgggcgaagccggccgcgttgggggcgtcgatcagcgcgtcgagattcgggaccacatagccttcgacgttgttttcccatgcgatgacgccccagccttggcgcgactgtacggcctgcatgatcgcgggcacgtcgggcagagcgatgaggtcgaagtcgccgagtgtggcgaactggtcggcggccgtcattgccgcctgatgggtgaaggtgccctccgggcccaagtaaaacagtttcatgcgtgccataaagttctatggtagcggccgtaatcccctacgcccgccgatacgcgacgcattcccgggaatgtatcgccatatatagttacgcgcgcgattcagaatgagtgggaatgacgaaccagcgggcgggaagaatgagcaggacgacttggaccagtatcaggccgtacagccagatgtagccggcatgttgggagaagaacggcatgtcgccttggaatccggcgacgatgagcgctttgccggatgtggtggtcagcgccatgccccatgcggtcagtgaggaggcgatgaggtgcagggccagtccgaccgcgcccatgcgcgaacgggcgcaccatgtcgataggccgatcagcagaaacgccagcaccagaccatacggaatattcagttccgcacccatacggtgggcgaacgtgcccacaaaggcggaagccacgcccgccgcaatcgtgatcaacgatttgaccagcgcgttctggcgatacgaccacggacgcaattcagtagtgctcttcacagtcatgcgtttcagtataggtggggatatgacttggtgaggaataaacttagctcccctcagagaggggagctagagagaatggtcggctacagccgcaccaaatcacttaccctgctgggcggcgttctggcggcgctgcttggcgcgccacttgtaccagtcctcacggccgaggatgatcttgcgcacgcggatggactccggggtgacttccacgcactcgtcctcgttggcgaagtccagggactcctcaaggctcatcttgatcggcggggtcagggtttcgagcacgtcagcggtggaggaacgcatgttggtcatgtgcttggccagcgtgatgttcacgtccagctcgtcgggcttgttgttcacacccacgacctggccttcatacaccggggactgcggttcgacgaagaagttgccacgggcctgcagacgctgcatggcgtacggggtggcgatacccttgcgatcggaaaccatggaaccgttctggcgaatggtgatggcgccagcccacggcgcgtagccggcagagatggaggaggagatgccggtgccacgagtggcggaaagcagcgcggtgcggaagccgatcagaccacgggacggcacggtgaactgcagacggacccagccggagccgtggttggtcatgccatccatacggcccttacggtcggccatgagctgggtgacggtacccatgtactcttccggcacgtcgatggtggtgttttccatcggctcgttgatcacgccgtcgatcttcttggtgaccacctgcggacggccgacggtcagctcgtagccttcgcggcgcatctgctcggcaagcacggccagcgccagctcgccacggccctggacttcccaagcgtcgggacggtcggtgggcagcaccttgatggacacgttaccgatgagctcgcggtccagacggtccttgatcatgcgggcggtgagcttgtggtccttgccctcggtgccggccagcggggagtcgttggtgccgaaggtcatggagatggccggatcgtccacatggatgagcggcagcggcttcgggtcgttggggtcgacgatggtctcgccgatcatgatgtcgttaacgccggcaacggccacgatgtcgccggggcctgcggattcgaccgggatacgctcgaggccctgggtgcgcagcagttcggagacgcggaagttctcgagggagccgtccacacgggacaggccgtaggtcttgcccttctcaagggtgccgttgtagatacggaccagaccgagtcggccgaggaagtcggaggagtcgatgttggccacgtgagcctgcagcggggcgccctcctcgtattcgggggccgggatggtggagatgatggtttcgaacagcggctcgaggttgtcgttgtccggcaggccaccgtcggcgggctggttcacggaggcgtagccggccttggcggcgcagtagatgaccggcatttcaagcagctggtcaaggtccaggtcgatgccctcgtgctgcacgtcgtcggccaggccgagcagcaggtcggaggtttcgccgacgacctcttcgatacgggcgtcggggcggtcgaccttgttcacgcacaggatgaccggcagcttggcttcgagggccttgcgcagcacgaagcgggtctgcggcagcgggccttcggaggcgtccacgagcagcacgacgccgtcaaccatggagatgccgcgctcgacctcgccgccgaaatcggcgtggccgggggtgtcgatgatgttgagggtgatgccctccgggtggccgtacttggcggccagcggaccggtgtattccacggccgtgttcttggcgaggatggtgatgcccttctcgcgttccagatcgttggaatccattacacgatccggcacttcctcacgctcggaaaacacgtgcgactgctgaagcatggcattgaccagggtggtcttgccgtgatcgacgtgagccacaatcgccacattacggatatctccacgaaccgccatcgaaacctctcttaatactgattcttttgcgtaatcgttcggtacttgcgttctcgagtacttaagtacttactctgaggtgtttattcatacctacacacaaaccgtcacgatggtactcgcacaccttgactatgtcggaacatagaaaagcacctcacaacggcagaactcccgcgtctcgacgaacccctcgcgggatttctgccgtttttacggccttcaaacggcagaacccccgcgtccctttcgccgggacgcgggggttctgccggtaatcaggcaaatatctgttctcccgtcatcgacttccgtcagtcttcgagatcgaggcctttgcgttcgggcaggcagagggcggcgacgcaggcgatgatgaaggcggcggcgaagatgatgaaggccacggccttgttgccgccggacagggtcaggaaccacggcatgaggagcggcgcgatgatggcggcgatgcggcccaccgctgcggcggcaccggcggccgcgccacgcaggcgggtcgggtagatttccggggtcacggcgtacagcacgccccacgcaccgaggttggaggcggacagcagcatgccgaacacgagcacgagggccacagatccggcctgcgagaacgcgaaggcggccacggcggagacggccaggaagatgctcagcgtcttgcggcggccccagacctccaccagccaggcggctaggaagtaaccgggcagctgggcgatggagatggcgagcgtgtagccgaatgacttggtcagggagccgaactggtcggcgagcagcgacggcatccatgtgaacgcgccgtagtaggagaagttcacgaagaaccacgtggcccagatggcgatggtgcgggccaggtacttggagccgaacagttcgcgcgtcttgatcttcggcagcggcttgcccttgggagaggttaccggggctactccccggcttcctcgaagtagcgcacggccttttcggcttcgtcttcgcgacccttggcttcgaggaatcgcacggattctgggatgtgcacgcgggtgacgattgcgtagagcagtggcagcgcgccgatggccagcgcccagcgccagccccagtcgccggtgttcgggatcacgaagtagccgatcatggcggcgacgatccagccgacggcccagaacgattccagcagcacagtcatgcggccgcgctgtttggtcggcgaaaactcggagaccagcgtggaggcgaccggcagttccgctcccaagcccagtccgatgatcagtcgggcgccgagcagcatgccgagtgaccaagatagggccatggcaccgttggcgatgccgaagataatcagtgtggcggtgaacacggttttgcggcccacgcggtcggcgatgaagccgcccactgccgcgccgatggccatgccgacgaagccgatggacagcacccatgacttttcggtcggggtgaggttgaagtgcgggtcggcggcgatggcggcgactacgaaggagacgaggccgacgtccatggcgtcgaatgcccagccgatgccggaggcgacgaggagtttgcggtgcgccttgttgaagggcagccggtcgaggcgctcgttgcgggtgagctgcgcgggttgcgctgaagtggtggtgctcacgtcgtttcctttctggtaagtggcgtcagatttaatggcgggtcaggtcggtgtaggactcttcgatggccaagctgatgcgttcgacttgttcgcgggtcagcggcttgcggaaggtcatgcgtaatgccgatttggcgatggacggttcgaggcccatcgccagcaacgtggcaggaatctcgtggcgcccgatggcgcaggccgagccggatgaggcagcgatgccgcgcgcgtccaggtcgacgagcagcgcttccccggtgacgccggggaagatgaaggaggcgtgaccgggcagacggcgttcggggtcgccggtcaggtcggcgcgaggcgcgacccggcgaaccgcgtcgatgagcatgtctcgggacgcgaccaactcacggtactgcgcctgcatgcgcgcattcgattcgttgagtccgatggcgagcgccacggcaccggccacgttctgcgtgccagagcgcaggccgcgttcctgcccgcctccggacagcaccggttcgatgggtgtgcggccgcgtaccagcagcgctcccagacctttgggggtgccgaatttgtgtccggatacggacagggcgtccacatcccagtcacgaaaacgaatcggaatctgcccggcggcctgtacggcgtctacatggatgggcacgccgtgcgcgtgggcgatgcggaccagttcctccacgggttccacggtgccgacctcgttgttggccagcatggtggagaccatcgtggtacgttcactggcctcgccgtcgagctcgcgttcaagtgcgtcgagatcgagatgtgcttgcgcatccacgggaatgcgcacgacttcgaaaccgaaccattcgtgcagccatgccgccgattgggccacggccgggtgctcgatagcggaaatgataatgcgcgggcgacaatttgccggctgtttgccatcggcttcggcgaatccgcagaccggccgcaagcccagtttgcgcatgcgcgccatggcgatgcctttgatggccagattgtccgattcggtgccgcctgaggtgaagatcacgtcatccggccgggcgcccaatgccgcggcaaatgatgcgcgagccgcgtccagcgcgcgggccgcggttttgccgggctggtgcacgctggccggattggcgtaggcctcagtcaggaacggggtcatggcctcgatgactgccgggctcactgattcggtggcggcggcgtccaggtacagttcgccgggttcaccggatgcgttgggggtatcggccatgactagttccaatccaatccgaggtcgatgctgcgcacagagtgggtgagcgcgcccacggagatcacgtccacgccggtgacggccacggctggcactcgctccaggctcatgttgccgctggcttccacgatggccttaccgtcgatgagctccacgccgcgacgggtgtcgtcgagcgagaaattgtccagcatgatggtgtccgctccgccggcgagcacggcgggaatctggtcaaggcggtcgacttccacttcgatatgcgtggtgtggcccacctgttcgcgcacgtggcggatcgcgccggccaggtcgatgccgcgcgcggcgagcgccgccagatggttgtccttcatcatgaccgcgtcggacagtccgtaacgatggttgtggccgccgccgcagaccacggcgtatttctcgaacgggcgcaggccgggcgtggttttgcgcgtatcgacgatgcgggtgcgctcgtagcggcgcggccgggtgacgggtccgtcataatcatcgccgtagatggcgttcaccgcgtccacgaaggcggcggtcatggtggcgatgccgctcatgcgctgagtgaagttgagggcgatgcgctcggcggtgagcaggtcgcgtaccgggcctttcacggtggcgagtatctggccgcgctggaatcgctcgccgtccttgatggcggcggtgacggtgacggccgggttctgtgcggcgaaggctgcggcgaacacgtcgatgccgctcatcacgccgttttcgcgcgcggtgaggtgggccgagccggtttcgtccgcggggatggtggtctcgcaggtgatgtcgccgtagggcgcgtcttcggcgagcgccgcttcgacggcgacgcggatgatgtgtgatgtgagcatgggtcagtccttgatgtaggcgacggagtgggcccagttgtcgactggctcgctgtggtcggtgcgggcgtgggcgcctctcgactcggtgcgggcgagcgcggcggtggcggccacatagcctacggtgagcatgttgcggttctccaaagcctcaacgctgcttgcagcaccatcggcgtttacatcagcctgggcgtttgcggcggcgaggccttggccgagttcggcgatggcggttttcagtccggcctcgtcgcgcagcacgccgacgccatgccacatggtgttctggatgcgggtacgattccacaccttgtcggcggcggtatcgtcagcagcagccgtagcggcaggggcggccagcgcgatcggcgcatggtcgaacacggcaccggtggcggagttcaggaacggttcgggtgcccagaccgcgtcgtcaccgtccgcgacggcggccagaccggcgcggcgtccgtagacgagcccctcgagcagcgagttggaggcaagacggttggagcccatgacaccggtacgagcgcattcgccggccgcatacaggccgggaatggaggtccgggcgttcagatcggtgcgaatgcctcccatgtagtagtgcgcggcgggcgccaccggaatcggctccttgctccagtcgaagccaagcgaacgcgtataggcgtcgatggtcgggaatcggtgggccaggaagctggccaggtcggggttctcgcgggccatcggcgagacgtcgagcatcacgggcttgccgccttgcgcctgcatcacgcggaagttctcgcgggccacgacgtcacgcggcgcgagttcggcgcgcggatcgatgtccttcatatacctgtggccatgctcatccagcagcaccgcaccttcgccgcgcacggcttcggagacgaggaagtgctcgcccacggccatggcggtgggatggaactggtagaactccagatcggcgacctgggcaccggcacgccatgcgacggcgaggccgtccgcggtggcgaccggcggattggtggtgtacgggtacatacggcctgctccaccggcggccaagatcacccggtcggcggccagatccttgtcctgcccgtcgatcagcaggtggacgccggcgatgtggccgccccgcacgatgagatctttgaggaaggcgttctcgatgatgtggatgcgcgggttcttgcgcaccatggcggagacgtccagttcaaacactttgccggtggcgtctcccccggcatgcaccacgcgggcgcgcgaatgagccgcttccaggccgcgcagcatgtgtccatgcgcgtcgcggtcgaagtggacgccggccgcggcgaactcgcggacgcgctccgcaccctcacgggtgaggatgtccacggccttcgggtcgcacaggccgtggcccgcggccatggtgtcggcggcatgcagcttcgggtcgtcgtcggagaagatggctgcagcgatgccgccctgcgcatgataggtgtttgattccaccagttcggccttggttaccaaggtcacgtcgtgtccggtgccggccacggccagtgccgcggacagtccggcgacgccggcgcccacgacgacgatttcagtgttgctcattgtgttgctttcctctgtttttgcgtcatctgctcccttcagtccgctacgcggacagctcccctcatgtacgaggggcgtcagggatggatcacgggtgaacgcgcagcatgcgctccagtgccaccttggcttcgcgggcggtgtcttcgtccacggtgatgcgattgaccacgttgccggcttcgaggttctccaaagcccaagccaggtaggccgggtggatgcggtacatcgtggagcaggggcagaccacggggtccaagcagaacacggtcttgtccgggtactgcgcggccagacggttcaccaggttgatttcggtgcccacagcaatggcggatccggcgggcgcgttggcgatctccttgacgatgtacgcggtggagccagtaccgtcggcggcatcgaccacctgcatcgagcactcggggtgcacgatcaccttgacgcccgggtatgccttgcgggcacgttcgacctgttcgacggtgaaacgctggtgcacggagcagaagcccttccacagaatcatcttggcgcgggcgtaatcggccggatcggcggcgccgccctgtgccttgaacggatcccacagcggcatctcgctcagcggaatgcccatcgcgcgggcggtattgcggcccagatgctggtccgggaagaacagcacgcgcttgccgcgggcgaacgcccattccagcacggcgtgcgcattggaagaggtgcatacgatgccgccgttgcgtccgcagaacgccttcagcgcggcggatgagttcatgtaggtgaccggaatgatctgctgcaagccatcggagtccggctgggtgccgcagatctcgccgagctggtcccagcattcctggacctggtcgatgttggccatgtcggccatcgagcagccggcggacaggttgggcagggtcacgctctgttcgggcgtggagaggatgtcggcggtttcggccatgaagtgcacgccgcagaacacgatgtggtcggcgtccgggcgttcggtggcgttcttggccagctggaaggagtcgcccacgaaatcggcgtgcttgatgatctcgtcacgctggtagaagtggcccagaatcaacagtttggagccgagacgctgcttggcgtcggagatgcgctgctgcagttcctcgtcggaggccttgcggtattcgtccggcaacacctgctggcgcggcgcgttggcgggcagacggtcgagcatcgaggcaccgggaccgtagctgggtgtggtggtgtcgaagtgccatgggtcctgggtcagtcctgcatcgcaggtgctttgcgcgcccagcttggcgatgatctcgtcaacggacggcgcagtgaatagtgcggtcatagtggttcctttcctatatacgtctgtgataccggcccgaagcgggtcggcgggaaaaatcagatgcgcgcggatgggatcagcgcgtcgagagcgtcttcacgctcgccttgtctggacagttccacgatgtcgtcaccatcggattcgtggggcgtaccgttctcgacaggtcgtttggggatgtagcggtagacggtggccggtcgttggcggccttcgcgcatcttctccccggtgtcttcaaggtcgcccgaggcaagcattttgcggcggaagttcgccaagtcgaggggttcgccgccaatcgcctcatagacgccgtgcagttggcgcagggtgaacgtggggccgagcagtcgggtggccacgtcggagtattcgattttggagcgcaggcggagcagcgcgtagtcgatgatctggcgatggtcgaacgccagctcgggcagttcgtcttcggggaaccatcgtacgttgtcaccgtcctcgaagcccgcggcctcggtctggccgacgagcgcccagtacacgacggataccatgggcaatccgccatgggaccgggtcgggcctccaaaggtgtacagctgttcgaggtatcgcgggtgcaggtctgtggtcgattcgagggccgcgtaggcagactgttccaacgaccggtcggagcgcaggtcaccgccgggcaacgcccagcagcccaggaacggctgacggacgcgcttgaccaggggcaaccagagacaggaatgggccgagttcgcggcgttgccggaatcggcggcactgttgccggtatcgccttccgggccgagtgccagaatcaccactgacacgccgacctgtggcggtgcgctgcggcgctcggacacattgccgaatcccatgccatgcctctttccataccggttgttctccctgcattgagagcatagcactacttatagtcacaatgaccataaatcacatatcggatggtctagcgcacgaatattggtcaggcagcgggccccaatcgctacgaaatcacgtccgtatcttccgatttcgactgtgtcatttcggcgacggacgggaggaatggcgctagggagggtagttcgtcgagactcttcagacccatttggtcgaggaagaattcggaggtgaccaagagggccgcgcgggattcggggtccacgccgtcttccttgataaggccgcgtaccgtgagcgagcgaatcactccatcggagttgacaccgcggatcgcggccacttgggctcgggtgacgggttggcgataggccacgatggcaagcgcctccagtgcggcctgactgagtctcgcagtctggccgtcggtgacgaatgatgagacgaccggctcgaacgcggcgcgactggcgaactgccagccacgagcggtgcggcgcagttcgaagccgcgcgggcggatgtcacgggattcatcgccctcatagtcatcgtgcagggctcgcaatgcctcttcgactgtgttgcgatccaatgccaaaatacgggccagctcggtggcggtctgcggctggtcggcgaccatcagaatcgcttccagacaggcgggcagcccgccgggaaaatcgtctaccgcgaaatccacgtattcggggtgcgtctcctccactcccctcaccgcggcctttgcggattcagccgtcgattcggcatccgccatgtgttcggttgtattcgttgcgtcaatctgttcagtcaccaatcgccgtccttacgcaaaatcaccttcggaaatgttcacgtcgctcatcgtttcggctacgccgggtacccacctcaggtgcagttcggcaaacggaccatcttgctgatactgcagcacaccttgtttgaagaacacgagcacggccatgaaccgagccaccacctcaatacgagaagtgcagtcccgggtcaattcgctgaacgatatcgactggtcgcccttggattccaatgccgcgatcagccggtcgcgcaccaccagcgattgggcccgcagatcgaccaacggcacgtgcagctgatggatcgacacttcggaggcgggcgcgttggcgatgacctgggcggtcagtcgggcgagttcgagcggagtcagcgtccataccagctcaggcagcatggcggcaacgccctcgtccatggccgccgggtgcgggaatcggccggagttggcggcgatacgcgcccggaagtcacctgcggcctgcttgtaggcgcggtattggaggagtcgggcgaacagcaaatcgcgttcgcgcagcacttcgaggctctgctcgtcgtgctggctgtcttcgccgccgggcagaatcgccacgcttttggcctcgaccagaatagaggcgatatcgagaaaggcgctggcctcatccatgttttttgtgaaatcgagcccgcgcacgtatgtcaggaattcctcggtgatcgaggagagggaaacttcggtcagctcgagtctgttgttggcgatcatgccgagcaaggcatcaaacggaccggaatagacttcgaggttgacccggaagccggaagtggcggattcctccgtgctgatttcggcttccgcggagctcccctcagcctcgctacgcgagccagcttccctcagagaggggagccgagaaagggaagtctcattcatcgtttatcgaaacaatcgttacgccacgatgccgcgagcaatgagctcacgtgccacctcacggtattcctttgatgtcttgtgctcaggggcatagaccaccacgggcgcggcggcaaccgtggaatcgggcagtttgatggagcgggagatgaacgtgtggaacaccttttcgctgaacgcctcgtaaacgcgctggcagacctcttcgcagtgcagtgtcttggtgtacatggtgatgagcacgccatccacttccaatgcgggattgatgcgggactgcactttttcgatggactgcataagcagggccacaccgcgcaaggcgaagaattcggcggccacgggaatgatcacgccatcagctgcggcaagcgcgttcacggtgagcaggccgagcgatggctggcagtcgacgatgatgagatcgtattccgacttgagcttgcgcagcacgctgttcaggatctgctctcggcccacttcggtgaccagctggacctcggcggcggacaaatcgatgttcgccggaatcacatcgatgttctcgaatgcggtgtgctgcaccacatcatgtgggtccacggaaatatcgaacagcgcggtgtaaatcgtgttctccacggtattcgcgttgacgcccagtcccacagtggcggcaccctgcggatcgaaatcgacgataagcacgcggcggccatactgggccaacgcaccggcaatattgatggagctggtggtcttacctacgccacccttctggttgcacatggcaatgacacgcgccggaccgtgctgttgcagcggttcgggtgcggggaaggtttcgtattcacgtccaagcaaatcggtaggcatactgtctaccttatcaacatccgggttcgctgggggtgcaacgacatacgttcctgtcataggcagcgttccttgacggaatgcgctgtctttatcgcgggtatctcgccagtcgtccatcgttgccctcgccccctttgtcgggaatacctgctcgcccatcctaatgtactcgccgggctcgcctcggaacaccgttttgccgctggtattccagtgttccgaggtttatggatctcgtctcgtactatgtcgatgcgcttactcggtgcgcagtgcggtggccgggtcttgcttggctgccttacgcgagggaatcaggccgccgatcagcgtgagcaccacgcttaggatcaccagcaccacgccaccggtcaccggcagggcggcattgacgtccgcattgccgatgaagtggtgtagcacggcgttgatcggaatattgagcagcacggtcaagcccacgcccaacaggccggagcataggccgatgatgccggtctccgcattgaacacctgggatacgttgtgcttcgaggcacccattgcgcgtaggatgccgatttccttggtgcgctccagcaccgaaatgtaggtgatgatgccgatcatgatcgaggagacgatcagcgagacggacacgaacgcgataagcacgtaggaaatcacgttgacgatggtggtcaccgaactcatcatgagcccaacgtaatccgtgtaggtgatcttgtctttcttcgagacggtgttgttgtagtcggtgatcgcgtcggcgatgtggtccttgtcttcgaagctgtcggcgtagatgttgatcgagctgggcgcgtcacgactcaccacaccgaatgcggcgaggttgtcgtcgtaggtgccggtcgacacgtactggtcgtagatcgcgacaagcacgtcgttcgaagccgtggcgatatacgcgtcgaaactgtcggcgagctgctgttcgctcatcgcggccatggcggcggcctgatcgccggcacccgccgcgccagcgacacctgcagcaccagcaccagcggcgtccgatgtgcccgtgccggactgctgcccggcgctcatcatcgacttggccatgttcgccttctgcgtcacgcccagcgaagccacgtaggtgcgcgcgtcggccaccttggtggcatcgtccgagggcgagaacgtcatgccgttgagcacgttcgtgttcgggttggccttctgatcggtaacgatggcgctggaggccgcacggtcgatcaaatcattggtcagagcgcgcgcgtaccccacaccagcggccaacggcgtggccgaagcatccttcttcgccttgacgacgcccaccaccttgagtttggtggccgtttcgaggcgctgttcgatttcgtccttgtcgttgccgatgaaacggtagtggccgtcatcgcccttgacgtactggtcggatgccggaatcatgtacagcgtctgatcgagggccttagcatagtcgatcttgtcttgtggagtgctgaccttgtcgccggcgttgagcttggacatcatctcgtggtaatcggaggcgggcagcaggccgagctcgtacagcgtggtcagcggcacgctgttgttgtcgtcaagcaccagcaccacttcatccttggacttcggccatgaaccgttgaccacctggtagttgtcggtgataaccttgcctacgagcttgctgtcgtccgctcccggcatgatctcgttgaacgagtcgggcgcggcgttctcatcggttttgccggtcagcatcgacatctgctgcgaggtgatcgacgaggtgccggacatgccggacgagcttgtggacgccatctgcgaggccatcgaggcagagtcgctggatccgatcgtcacgccgtccgcattgaccagcgtgccgtcggggtcgtggtcgaacacggagaatttcacgtcatatgtgtactggatgccggtggaacccacatactggtgaatctcgctcttggaattatccaggtatttcttgaagcgggtcaggttgttttcggtaatcgaactggtcaggctggacgcctgcttgacgctgcggtcgtccgggtagatgccgtcggttttgtgcgtcttgccgccgtatccgccatcgccgcccatctgtccgcccatcatgctgctcaggtcgaaggtctgggagtcgacggtgatcgggtaggcggtcatcgtgtcacgctggatgtcactgatgtatgtgttcacgccagtcgacaccgatagaatcagcgcgatgccgatgatgccgatcgagccggcgaacgaggtcagcagggtgcgcgccttcttggttttcagattgttgaagctcaacgccagcgacgtggcgaacgacatcgacgcgcggcccatcgtcttgtacacggccggctgttcggccgtctcatccacgacaaacgggtcggagtcggagcggatcacgccgtcgcgcaggttgacgatgcgcgtggcatattgttccgcaagttcggggttgtgggtgaccatgaccacgaggcggtccttggccacgtccttgagcaggttcatgatctgcacggacgtgtccgaatcgagcgcgccggtcggctcgtcggccaggacgatgtccgggtcgttgaccagtgcgcgggcgatcgccacgcgctgcatctggccgccggacagctggtttggcttcttgttgatgtgttcgccgagtccgaccttctccagcgccttgcgcgcacgttcgcgacggtcggccttgccgatgccggaaatcgtcagcgcgagttcgacattcgacagaatcgtctggtgagggatcagattgtagctctggaacacgaagccgatggtgtggttgcggtacgaatcccaatcgcgatccttgtattggcgcgtcgagatgccgttgatcaccaaatcgccgtcgtcataccggtcgaggccgccgatgatgttgagcaaggtggtcttgccggaacccgagggacccagaatcgcgacgaattcgctgtcgcgtaggttcaggctgactttgtcaagcgcctgctgaacgaaatcaccggttttatagcgcttcgagatcgatttgatctgcagcatgaatacctcttcctggctgacggttcgctgttatgtactgtattgtcacgccttgaatttccggccgactttggtgctcccccgccgcgattccgctatgggcggacgcgtcgcaaaatggtgtgtctcaccgcgctctgggatgtgaggtcagatacgtttcgatcagggtttcagggcttacgtgcgtgtagatctgcgtggtggtcacgctggcgtgcccgagcagttcctgcacggtgcgcacgtccgcgccgccttggatcaggtgcgtggcaaaggaatggcgcaaggtgtgcggatggagtggtttggtgatgccggcccgctccccggttgctttgacgatttcccataccgattgccgcgagatgcgcttgccgcgtttgttgagaaacagtgcgcgcctctcgggaatcttggcgctggagcgctgttccaactcgccacgccccgcattgaggtatgcggtgatggcccggcatgcgtaactgcccaatggcacaagccgctgcttggagcccttgcccatgagtcgcgcgatgtgctcgtccaggtcgatgtcgtccagattcgcaccggtggcttccgagacgcggcagccggtggcgtacatgaattcgagcagggccttgtcccgtaataccaccggatcggttgagccgccggctgccgccgcgtcgagcagacgggttacctcgtccacggtgagtacgtcaggcagggtgctggcacctttgggtgccttgactgcggcagaaacgtcggcagtcaccgcgtgctggccgagcgcgaagcgatggaattcatggatcgaggccagtcttcgggctttggagcgggcggactcccccgcctggtcaagggcggcgatgtagtcttcgacgtcttgtttggttatggcgtccggttcgtggatgccgcgggtttcgagccaatcaatgtatttggcgatatcggattcgtaggcggtgacggtggccgtggcgagccctcgctccacgccgatgtggacgaggaactgctcggtgagtctggtgaatccgttggtcatagtgcccatggtacaaagaaaccccgctcggaagcggggtttctagtgtgaagtcacgacttcaagcaatcaggcctcaaccggagcgttgacgtcctcaggcagggcggccttggcggcgtccacgatggtcttgaaggtgtccgggtcggagacggcgatctcagccagagcgcgacgatccagctcgatgccggcgagacgcaggccctggatgaagcggttgtaggtgatgccctcagcgcggacggcagcattgatgcgctggatccacagcttgcggaagtcgcccttgcgagccttgcggtcacggaagttgtagttaaaggagtgcagcagctgttccttggccttgcggtacaggcgggagcgctggccacggtagccggaagccctctcgagaacaacgcgacgcttcttgtgggcgttcactgcgcgcttgacacgtgccataatctattcctcagctttctaaagtcttgttatttccgggtaagccctatgctcacttctgcagaagctggtgcagcttcttggcctggccgccgcgcagcacatcgtcggcggacagttcacggcgcttgcgagcggacttgtgctcgaggttgtggcgcatggcggaaccgacatgcttcaccttgccggtgccggtgatcttggcgcgcttggaagcggcggaattagttttcatcttcggcattgctgccctccttgctggtttgcttcttgtcggaagtcttctgagaaatcgcggactgcgcgtcggccgcggcctgagcctgagactcctgcttggccgcgagacgagccgcctggcgagcctgacgctcggcgcgggactcggcgccacgacgacgctgctcggactgggtgtgcaccttcttgcccttcggcgcaagggtcatgatgatgttgcggccctcctgcttcggcttggactcgacggtgccgtattcctcgacatcgtcggccagacgctgcagcagttccacgccaccaatcgggcgggagatctcacgaccgcgcaacatgatggtgaccttgaccttgtcgcctccgttaaggaagcgggtcacatggcccttcttcacgtcgaaatcgtggtcgtcaatcttcaggcggaaacgaatctccttgatttccgcggtgctctggttgcggcgagcttcacgagccttgatcttctcgttgtacttgaacttgccgtaatcaatgagcttggcgaccggaggcttcgcgttcggggccacctcgacgagatcgaggtttgcctccttggccaggttcagcgcgacggaagtcgcgatgacgcccacctgctcgcccttcgggccgatcaggcgtacctgcgggacgcgaatctcgtcgttaatacgtggttcgtcgctgatgatgactccaatcctctacttcaattccgtggcgagggcctttgctggagtcctgttcaatgctttgggttcatggcaagccaaagcccgcgccaatatgcgctcagcttctgcagacgcatatcagttctttgcgtcattcctgattacgcgttgtatatcgcaatcgctaggctgtttgccttgaacccgaggccttgaaaggcttccaggtggggttgccccgctttcttgatttctcaagccaaatagaaagtctaccatacgcccggacattcgcggtccgtgtgtcgaacctactgcacggcgcgcagcagaccgccgaagccttcgtctttgagaatctgccgatatgggccggcctcatcggcgatgatttgatcgatggcatgcatgccgagtacttcgaccggcgccttgtcgtcggtgagaatagtcgacgctgagtccggttcgttcaccttccggaatcgagaggcgacctcttccatataccattcgagatcttcgctgccggtgcgctcgtaggtggtctcacgcaggttgagcgccttggaggcctgctgcatggagttctcttcggagccggaacccggcttcttggcgaacagttcacggttcgtggtgttcggcacgtcggccgtcagtgtgttcccattgccgaacacgctggcgatggtatcgctcaacgcctcgttgatcgaaccttggccgtccgagatcatgttcatgttcaccaccatcacgccgccggggttcaggtgctctctgaccatggtgaagaactcggtggagctcatctggaagggaatggtgatgtcctgatacgcatcgaccatgatcacgtcgtacttgtcatgcgaggcggcgagccaggctcggccgtcatacgtggtcacggggatgtcggcgggctcatcgaagtattcgccggccagatcggtgatcttctggtcaatctccacgccggtgatgttcattttcggataatactgcttcagctggcgggcgtaggtgccggtgcccatgccgaggatcagcgcggaattggcattgtcggcgagcgccggcgcagccagggccgtgtcgtagtacatacctgtcagtcctttgtctttcatcgtgacggactgcacgccgaacagcacgttggtggacaggatcgtgcggtcggagaggttcttgacctgcaggtagttgtagatggactcgccctcataggccaggttggtttcccagaacgcgaagccggtcaggggcgagacacaggacgtggccacgaagatcacggcgctgaccacgcaggcgatgcgcttggccttgatcgagatgaagtagatcagcggacatgccggagaagaattcggtgatgtagaggaatatctttgatttgagaatcggccgttcgcttgcctcggtgatctgtgccatcgctccgctcccctgcctgtgcgcctatcgactactgttctgatgcgtagcctatcagcattttcccggccgatgggtggataccggctacagtaggcatcatgactcaggtatgcgtgatttttggtgcgggcgaatactatgcgggcacgcccgtggtgccggccggcgcgtatgtgattgcggccgatggcgggctcgaccatacgcgccagttgggtatcgtgcccgatgtggtggtgggcgacttcgattcgctggagggccggccgccccgcaccgatgtgcgcaccatcgcgctgcccgcgctgaaggacgatccggacatgctctccgcgctgaaggtcggttggtcggcgggttgccgcgaattccatgtctatggcggtttgggcggccgcattgaccatacgatttccggcattcaactgatggcattattggcccggcatggggcaagcgggtatctgtatggtgatgggctcatcgtcacggccatcaccgatggtaggctttcgttccccgcgcatccggtgcccgaggacggccgcatggtgtctgcgttctcccactccgatgtttcgcttggcgtgaacgagccggggctgaaatatgagcttaaagacggcacgctgaccaatacggtggtgcaggggtcagcaacgagttccgcgacggcgtggacgcggccatcagcgtggagcacggcacactgatcgtcaccttccccatcgaggtggcgttgcctcaggtgagtcgattccacgaatttggcggcgatatcggcgagctggacaccgcagtgtccaagctgctggttcgctgacttgcatgccgcgcgcttgctcatgatgattcgagacattcctccaaaggagaggaaaaatcacatgtcggttgcgggcaatccgaattgtgagcgctcacagaaaatacggcatttttgcccaaaacgcacgctgaaacgttgccatgtgtacagagtcggcattacagtagcaactgttggtaaacaatggcccggtgtgccaaagcgcgccaaggccaccctacaagggagaattacatgacagttaagattggtatcaacggcttcggtcgcattggtcgtctcgccttccgtcgcatcttcgagctgcaggctcgcggcggccaggctggtgacattgaagttgccgccatcaacgatctgaccaccccggctaccctggcttacctgctgaagtacgacagcacccacggcaccttccgtcatgacgatggcactccggttgacgtcaaggccaccgaagactccatcatcgtcgacggcaaggaatacaaggtctacgccgagaaggacgccaacaacattccgtgggtcaagaacgacggtgttgagtacgtgctcgagtgcaccggcttctacacctccgccgagaagtcccaggctcacatcaacgctggcgccaagaaggtcctgatctccgccccggccaaggatgacaccaccccgaccgttgtgttcggcgtgaaccacgacatcctcaaggcttccgacgtgatcgtctccgccggttcctgcaccaccaactccatggccgccatggtcaagctgctggacgagaagttcggcatcaaggccggcttcatgaccaccatccacgcctacaccggcactcagatgctgctcgatggcccgcgtggcaccaagaccggccgcaacctgcgcgccgccgccatcaacaccatcgcccactccaccggcgctgccaaggccatcggcaaggtcgttccgtccgtgaacggcaagctgcagggccacgcccagcgcgtccaggttccggacggctccgtcaccgagctgaccaccgttctgaacaccgagaccaccgccgacgagatcaacgccgccttcaaggctgccttctccgacaccgattactacggctacaacgatgagggcatcgtctcctccgacatcctcggcgacacccacggtggcgtgttcgacccgacccagaccgacgtcaacaccattgatggcgtgaccctggctcgcaccgtgtccttctacgacaacgagtacggcttcacctccaacatgatccgtaccctgctgtacttcgctgagatctccgagtgaaccattgcggtctaggccgctacggttcgtttgagaactaagctgtgagacccccgccttgtgcgggggtttcttcgtagtagaacggtaatcatggcaaagaaaagcaagcatgataagggcgcgggttccactccggcgacagtccaactggagaaggcgggcgtggaattccacgtatacgaatacgagcactccaacgaccatatggatgacggctacggcgtggaggcggccaccaagctcggcttcgacgagcatcaggtgttcaagacgttgatggcggacaccggtgccgaacgcgtggtgggcgtggtaccggtgagcggtcatatggatttgaaagccttggctgcagccgtaggtgccaagaaggcctctatggccgatcccaaggtggcgatgcgtgaatccggttatgtggttggcggcatctcgccgttaggccagaagacacgtcataagactgtgttggatgaaagcgccctgcaattcgaccaaattctggtctccggcggcaagcgaggcctgtctgtgggcgtgaatccacaggacctgctcaaggtcttgaacgccgttgccgcaccaatcggcacgtggtgaccgttcttggctcccctcacggaggggagccaagaatgactacttcttcctgcgcaactccgccggcagcacaaagtgcatgttttctttgatggtttcgacggacttcataccggtgaaacccaagttttgcagagcgtcaatcacaccggacaccagttcgtccggtacggaggcacccgaggagatacctacggattccagacccacgaaccatgccgggtcaagctcgctggcatcatccacgcgatacgctttgccgcgctcccccaagccctcctgcgccacctccatcagtcgcacggaattcgaggagttggccgatccgacaatcaccacgcaatcggactgctgggccaccagtttgaccgcagcctgacgattcgacgtggcatagcagatatccgaactcggcggctcttgaatccaagggaatttggccttcagcgcggcaatggtatcggcggtctcgtccacgctcaacgtggtctgcgagagcagcaccagcttggtgtcgggcgcaaaatccagcgaatcgacatccgattcatgctcgatcaagtgcacgtgttcggggctctcccccactacaccgaccgcttcatcgtgacctttatgcccgatatagacgatttcatacccctcgcgcacgaaacgcagcacctcacggtgcaccttacccaccagagggcaggtggcatccaccacatgcatgccacgacgttcggcttccgccttcactaccggagatacgccatgggcggaaaacaccaccggaatacccgcttgggcagcagcatccggaatctccgccaattcctggacgaacaccgcgccttgcccggccaagtcctcgaccacatgcttgttgtgcacgatctgccggcgcacatataccgggggcagcccatcctcgcgcgtccgctttccggaagcctccgcggctttgagaatggtctgtacggtaagaatcgcacggtccacacccgcgcagaagcctcgcggatcagcgagcacaacgcttttggtcatcggaacctcctgaacgtcaatagtgttttccagtgtaaggcagggattacaggaatctgccgtcacaacttttccgcgtctcccacaaatcaccggtttccaaggaatccacgtgcttctcgcatgatggtgtgagactcgtcactccacgtattgctaccgtgtttatacgaattgtttattatatgccgcatatcgccaatccccgcctcgatagaggagacgcgctagactggggccagcgatagcaggagctaccggcccaccaacctcactacgggagtgattccatgacgagtaaaacaccacgcaccggaaatcagtattcgattcactatggcgattattccgccgtcatctgcgaactcggcgccaagattcgccgattcgattatcaaggcaaggaaattttctgcccgttcggcgtcaacgacctgacccccacctgtaacggttatgtgctggccccgtggccaaaccgcatcgaaaacggcgaatacgatttcaatggcaagcattactgcgcgccggttaacgaatatcatcccgcaccgcgcaacaatgcgaaccacggatacgcctaccactacatgtggaagcttgaatcgttgaccgatagcgccgtgacgctttcgctgcgcttccccaacttggacggatacccgttcgatgtgaccgtgaccgtcacctacgaactcggcgacaacggcatgaccgcgaccgtcaatgcccgcaatgatggcgacgaaccggcaccgtgggctctcggcctgcatccgtggctggccaacggcaagcagggcgcaactgccgccgaacgcgatgccgactccgccgcctgccacctgcagattaaggccgccagtcatgtgacggtgaacgaggcgctgattcccaccggcaccgaaccggttaccggtatctacgacctgaacgatggcccgacgctcgaaggccgagcctttgatgatgcctgggttgacgtggagcgtgccgccgatggtacgaccaccaccacattcacccgcccggacggtatcgaagtgaaaatcattggcgatgagacgattaatgcttggcagtgctacaccgccactggcgcaccgttcgccgagcatccgtatggcatcgccgtcgagccgatgaccgccccggccaatgccttccgcactggtgaccacttggtgacgctcgcccccaacggcgactacaccactgtggtccgctacgaagtagtccagaagtagttctgttacgctggctcccctccagaggggagccaattttttatccttatgtgccgccgcgtcttgggacttatgcgatacgattgtgagcgataacaatttgttccacaaaggagtgtgcactatggctttgaagcctcgcactggtaaccaatatgtcatctcgtccggcgaatggagtgccgtcgtcaccgaactgggtgccagcctgcgcgagctgaagtggcgcggcgaagacctcatcgtccccttcgacccgaacaaggtcattccctgctgcaacggctgggtgctggcaccgtacccgaaccgagtgaccaatggtcagtattctttcgatggcgaagactaccagatgccgatcgacgagttcgaccgccaatcctccctgcacggctatgcctaccgctacatgtgggagctcgttgatttgcaggaatcacacgtgacgctctcctggcgctcccccgacatcgccggctacccgtttgatatcaccatcaccgccacttatgcacttgacgagaacggtctcacggaaaccttcaccgtgcacaacaacgacagcgtgaaggcaccgtgggcatttggcatccacccgtggctggccaacggcaagcacgccaccggtcaggccattaccgccgacaacgagccctgccgtcttgagctgcactgcgacacccacgtgaccgtagacgaacacctgctgcccaccggcgaagagccggtttccggcatcttcgacctgcgcgataaccccacgctggagggacgtggcttcgacgatgcctggaccgatatcaccaaccgcggtgaagatggcagcacttccgccgcgttcacccgccccgacggcatcaaggtcacgctgaccggcgacaagaccatcaactcctggcaggtgtgcaccggcaacgaaatcggcgagaaggctcgtcaggccggcgtggccgtcgaaccgatgaccgcctacgccgacgccttccgcaccggcaaggatctggttgtgctcgagccgggcgatgactacaccaccgtggtcaccttccacgccgaacaaatctgaaaaaccgaataaccaagcctgacgatcatcgccacatggacacacgtgttgcatcacgtcgtacttatgtggcataattccgaaggcttatttttttactgcagcaaaggagtccatcatgggcatgcgcggacgtaagcgcaaggatcgtcgtaagaaggccgccaaccacggcaagcgtcctaacgcctgattcttcgcgtttcttatagaacgctcaaggcccgtctgatgatacatcagacgggccttgttgtatatgtcgttacttatcttccccgcagcagtgatcaagcgtggccttgagccgggccatcagacattcgggcgccacatccgggcgcaagtaggcacgcaacgcggcaatcaacgcctgttcacgctcgtcgcagcaggtacgggggtcaaaacagtcgccctccgtaacgatatgcacgtctgtctggaccgacgcagcggccgagccggtatctactgaacgatgatgcaccgccgtgatatgcacttcggtctggcttaccgtgccatcggccgccgtacgggttatggagatatggcgagtacgctctaccggctgatcgttcatcagatctcctttcccgaaagcttgcttgactgttgtggcgtgcgggcgccagtcgcatgactatgtctcactacggcttgcgtgtcgccattgctaccaacagtttgttcactactttcattatggccggaatcggcgattcgaccaacgttttcgctcaacttcgcggatggtgaaccagccgacgaaccagtcacgtacccgcgctctttcgcatacgaggcgagctcacgcttgagttgcgtgcgggcgcgattcaggcggctcattaccgtgccgattttcacgccctgctcatcggccacctgctggtaggacttgccgtcgatggcggcgtcgatgaacacctgccggcgttccggcgagagtttggcgagcgcggccatgatttcctcgggcgcgaaggcgtccaaatattcctcttcagcggacttgagcccgtccgacgtatgttcggcggcatcgtaaatgtcccaatcgtcgtattcgccagtggagtcgttggcacgctgcgggcgccgcttggccttggcatactggttgaagtaggcattgcgctcgatggtggtcatccacgcctcgaagttggagcccggctgaaatgagtcgaaggccttgaacccgcgttcgaaggtgtcctggaccagatcctgcgcgtcatcgggattgttggtcagcctcatcgcctgccggtacagtgcattgacggcgggcatggcgagctgctcgaatctggcgcgcttggctgccatggactcgcccgatccggctgactgcccggattgcgtagttgcttcgcttgtcgtcacggttcaccattctaatcaaatcatgtgcccatatcgtggtcgatgacgtgtgagccacaacacgctgcaccccacctgtagaatggcgtatcggctagataatagggagaaacaattatggctttgactttggcttcggccgctgacctgctcaaggaacaccatctgctgcgtgaaatcatccaaggggatgtctggaccgacgacccggcccgtatcgcttcggcggatgaaccgttcgccggcatcacctacgacacccgcaaggtcacgcagggcaccctgctgtgctgcaagggccgattcaaggccgagtatctgaacggcatcgacgaagccggcctggccgcatacgtggccgaaaccgagtactcagccgcaaccgccgcccccggcctgatcgtcaacgacgcacgcaaggcgatgagcctgctgtccgccgcgttctacggatatccgcagaacgagctcacggtcatcggcgtcaccggcaccaagggcaagacgaccacctcgtacttcacgcaggcgcttatcaacgccgtctccggtggcaaggccgcattgttctcctcggtcgataattgccttgacggccacacctacgtcgagtccgatctgaccacgcccgaatcgatggacgccttccgcatgatgcgcgaggcggccgataacggcatggagtatctggtgatggaggtctcctcccaggcgtacaaggtggaccgcgtctatggcctgactttcgatgtggccgcgttcctgaacatctcccccgaccacatcagcccgatcgaacaccccacgttcgaggattacctgtattgcaagcgccagatcatcgccaacgcgaagtcgctggtactcggcgcggacagtctgcacgccgatctgttgcgggaggacgcggcggcagccggcatcggcgcaaccaccttcgccctgcatgacgcggataatgccggcaccagtgcggacgtcgtcgcctggcccgccgacacggcgcacgcctccttccacatcgccgacggagatcagacccttggcgactaccatctgtccatcgatggcgacttcaactacctcaatgcggcggcggccatcgccatcgcccatgcggctggcgtatcgctcgatgacgccgacgcactgcacgccatcgaatccgtacgtatcgccggccgtatggaacagttccgcgacccgcagtcgaacacgctcgccatcgtcgattatgcgcacaactacgcatccgtcaccgcgctgcttgacttcgtctacgagcgttggggcgaggaaaacccgcgtatcacgctggtgaccggatcggccggcaacaaggcctacgatcgccgtaaggaaatcgtcgaggctgccgagaaccgcatcgcgaacttcattttcaccgccgaagatacggacaccgagccgttcatcgacatctgcatggaaatgcaaggctacatcacgaacaaggatgtggcctccacggtgatttccgaccgtccgacggccatcaccaacgccatttacgatgcccgtgcgcacgccgaccgattcaacatcctgctgattatcggcaagggcaacgagcgttggatcaaggaccatcacaagcatgtgccgttcgacggcgacgatcacgtcgtcgaacgcatgtttggcttgtgacgggattccagccaatcagatcctgatcggatcccgattggcccacatcagatcacgcgcaatacgaccaaaccagaaacacgacatacggatacgaacgaaaaaggatagctgaatcgtaatgatcacgttggagaaagttgacggagccacactggaagccgaagccgagaaggccggcatcacattgcccatcgaacagaccaaggtttggtctggttttcaggcggatatcgacggacgcacgccatggggcgattatctgatcaagcgtgatggtgaattggtcgccgtgatctcctttatcgattttgagacgcacggttatcattatctgcgctcgatgcatgggccggcgtgggctgccaagcccaccgaagctgaggagcgcgaggtcgtcgacgccatcgtggacaccgtcaagaaggccgacaagaacatcgcgttcctgcgtatcgacacctggttcgccgatggtacggagaaggtgctctccacagtgccgtacgaccagaccgtggtcatcgacgtcaccggtggcgatgatgagattctggctcggatgaagcgtcgtggacgccgtgacgtgcgcaagtctctgcgtgagtgcccggccgaggttgccgatgagacggataaggcgctggccgatttctccgaatattacgatgtgatggtcgagaccggccagcgcgatggattcacgcctgctccgatgagcgactactccgatatgatcggcgcgttgggtgccgatcattgccgtgtgttcgccgcacgtattgaagaccgtgtggtggcatggtcgattgtcaccgtgaatggcacacatgcggtgcgctactatgccggcatgcgcaacgaggttatgcgtctgcatgtgaccgacaagctgctgtattccgaatgctgcatcctgggctcgcagggtattactgaatacgatctcatgggcatcggctccgatttcgcgccgtctctcaagggccttaacgagttcaaatgcaagttcaccgaggaaatcaccccggtggcccccgcccgcgacgtacccatcaagaaggtcttctacaagacgctgcagactgtacagggcgtgcgcaaggcattgcgctaataccgccccgctcccgctggcgggagctgtcgaacgaagcgagactgagggcggtctttcgatatggaccgccctctgtcacctgtggcaccagttcctgtcagcgggaaccattcgtttatcgttcgagtttttgactcaccacggctgttacgccgtcggctctcatggttacgccgtaaagcgcgtcggcaatcgacatggtgcgttgctggtgcgtaatgatgatgagctgcgcatgggcgcgtaactcattgaacgcattaatcaaacgggtcaggttcacgtcgtccaacgcggcctcgacctcgtccatcacatagaacgggctggggcgggcggtgaaaatcgcgaacagcagcgccagcgcggtcagcgaacgttcgccgccggacaggaggctcagctgtttgacgcgcttgccggccgggctggcctcgaccagtacgccggtggtgagcatgtcttccgggttttccaggcgcagtcgcccggtgccgcctgggaacagcgtggcgaacatctgctcgaacgcctcggcggtatcgtcgaacgcggatttgaacacctggaccatcgtggaatcgagatccttgatgagctgcatcaaatcgtcacgtgatttgaccacatcgttgcgctgatcattgagatacttgttccgctcctcaagcgcttcgaattcctcggtggccaaagggttgatcttgccgagtgcggccagatcgcggcgagccttatcgagacgcttcttctgctcctgacggttatacggcacggtcttaaagagggcggaatcgccgttggtgccggcctctcccccggtttctccctcttcggtcccagcctcagcttccgtctcatccaacggcacagggttgccctcatcatccagcacgggcaccggctgttcggggccgtaatcaccaaccaattcctccaaagtgagaccgagttcgtcggacactttctgcatgagctgcccggattcggcggccaaccgttcgcggtttacatccaaggcatgttcgcgcccggtcagatcggtgaccttgggctcgatctggttgcgctgcgcgcgcagggccttgagttcctcgtcatggctggaggcggcggcctgcagctcgtctcgtttggcggccacgtcatgcagcgtatgctctaccatggcggccactgctcgcgcgtcatcggccacgccttgcaggtgtgcggcctgctcgcgtctgcgatcgttcaacgcctcgatgcgggcgcggcgttcggcggcttctttggcgttgtcccgcagcagcccggcctgtcggctcagggactcccctttgcggcttgcctcggtccacgcgattttcgcggcgacctcatgctcgcgagtcaggttcagtccgcgctccagcgtacgttcgcgttcatcgagttcgtcgaaatcggcatgttccgctgtggattgccgggccgatgccaaagcgcgattgaggtcgtcaagcttgagctgatgctcgttgcaattctcttgggtctcggtgattttcctatccagctgctcgagctgacgggtgaacgatgcgacgcgatctgtggcggatttcagagatttctccgcctgctgggctttgagccgggcttcggtgcgtttggcggattcctggtcgacgagtcgagccgcttcatcgcgcttggttttggcctcggccacttgctcagccattccgccgtcttgggcggtcaactgtttgacctgtgccaatgctttgtctcggcgggcggccagagacaggtccgattgagagattgaagagccgccgaccgccgccacgccgtgtgtgaaggtctcgccgttcttggtgacggcccgcatggcttcgccgaatgccacaatctgttgggcttcgtcggcggtgccggccgcggctacatcagccagcaggagacgcacggtgcgcacgaccgcttcggcctgtgccgggttctcggcatccgggttcgcggtgacgagtgctgccagcgcgttgcccgattgcggagcggcccccgcgttctcggcgctactctcctccgactccgtgcccggctctgtggcgggatcgccggcaatgctcgcggtcagcaccacggctttgccgagcttatcttcccgagcgcgttcgagggcgtgcaacatgttgcctgccgcgggtaccacgatggcgctggcatactggtcgagcgcgtgggccacggcttctccccagccttcggccacatggatgaagtcggtgagtcggccaagcgaggccacgtccgtatcgcgctccaacgatccggaggcattgcggctgtctagcgtgtcggcaagcgcatcggccttggatttgagcgagatgatcttggactgtatctcgcgctgcttatcggcgcgttcattcagtcgttcgcggcattcggcgagcgttgcacgtgcggcgtccaatgcggcaccgtcatcgtcggcaatggagtccgcttcgctgcgcaatgcgtccagctgttgctgggcatcgtcgcgctgggaagtcagcgagtcgcgttgggaggcgtaatccttggcgcggctggtcgccagttgtacggcggattcctcgcgggcgatgagttcgcgcagtcgggcgatttgcgcatcgcgttcctgtgcggttttgcgcagttccgtcaaggtctggcggactgaggcaagctttttctcgtcgtcggcgcgttcctcggtggccttgtcgagtgcgatgcgcgcatcggccacggccttggtttgtgccgctgcctgagactccagttcctcggctcgtttgacaagcatgccgggatcctcaccgaagttggtgacgatctggccggcgagtgaccggctgcgctcttcggccaactgggcgagcgcgttcagtcgttcacgggtctgcgagaattcatgccagtattggttggccttggcgatggccggactggattcggagctcaacgcctcgacctgttcgatgcgtactttgacttgggcgagttcacgttgggcgacggccagctggttacgcacagcgccaagctcttgacgtaccgtgtcgcgacggctcatcgagcgttgagcgtcttcggcgtacaggcgggcttgggcgtcgcgtacggatatctgaatcgcgtcggcgcgccgggagatacgtgcctggcgtccgagggggccgagttggcggtgaatctcccccagcaaatcgtctagtcggctcaggttcgtttcggtattggccagcttgcgcaacgcgcgttccttgcgcttgcggtgcttcaggatgccggcggcctcttcgatgaacgcacggtggccggacgggtcggccttcagaatcgcatccaatcgtccctggcctacgatcacatgcatctgctggccaagaccggtatcggagaggagttcctgaatgtcgagcaggcggcattgcgagccgttgatcgcgtattcggagcctccgttgcggaagatggtgcgggagatggtgacttccgtgtaatcgatatcgagcgtgtgatcggaattatcgatggtcaggctcacctgtgcacggcctaatggcgggcgggaggacgtgcctgcgaaaatcacgtcctccatcgaagtgccgcgcaggtttttggcgccctgctcacccattacccagatcagggcgtcgacgatgttcgacttgcccgaaccgttggggccgaccaccgccgtgatgccgggctcgaagcgcagcgtggtgacggaggcgaaggatttgaatccgcggagggtgagttccttgagatacatggcgtgagactgttttccgtatgccgggtgtccgggtatccgatatgccttggatgcgggttaccgggcgtcggcggaatcgtcggtgtcggcgctggctgtgtcagtgctgtcggtgtcggcactggccgtgccggtgccggcgtcaccggcctgttccttaccgaggccgaggacgtcgaacacgtcgaagtcgtccgggcttaccgaatcctcgaggttgtcggcggcctcatcctcggccttgtctgccggctgatccgaatcgtccgggtcaaccgccggctgatgaacggccatagcctgcctcatcgtggggctggcgtgttcctcaagcatcaggcgtgcgtcgccggcggtgacgaagctgccgcagataagcacgccgtggccgtagcccacgcccagctcgtcctcggcatcgaccatattgacggcggtctgaatcgcgtcaggcaggttcgcttccttgatcacacggtcacggccgaacacgtccacggcaatcttctcaagctcgtcggccggcatcacgcgctcgcgccacgagttctcggtgaccaccacggagctcaggatcggctccagaacacccagatattcctcgacctgcttgtcgcgcatcatggcgaccacaccgaccagctgcttgaagtcgtagctttcctcgatggccttgcgcagggcttcggcggcattcacgttgtgtccgccatccagaatgatggtcggtgaggtgcggatctgttcgatgcgtccgggaatcttgaccgagctcaacgcctcggccaccaagtcgccgtccagcgggccgttgaccggaatcaccacttcggaagcggcgagcgcggcaagcgcgttgtgggcctgatgctcgccgaacttggcgatcggcacgccctcgtaagtgccgttgggcgtggtcagggtggcgacttggccgccgactgcggccatacggtcggacgcggtcatttcgtagccgtcgcgcacgagcatggcgtggttgcgttcggcggcttcggcgagaatcggcatgacggcttcctcatgcggctgcgggccgatgatggcggtgcagttcggcttgatgatgccggccttctcggtggcgatctgttcgacggtgtcgcccagccactgcatgtggtccatgtccaccgggccgatgatggccgcatccgcgttgagcacgttggtggcgtcccacaggcctcccatgccgacctcgacgatggccacgtccacgggcgtgtcggcgaacttccagatggccatggcggtgagcacctcgaagaagctcatcttcggcttgccttgctcctccatcttggcgtccaccagggccacgagatccttggtctggtcccagatgtcgatgaaatcgtcatcggacagctgctggccgtcgatggcgatacgctcgttgatcttctccagatgcggcgacgtgtacaggccggtgcgcataccgtaggcgcggcagatggcctcggccatgcgtgcggtggagcctttgccgttggtgccggtgatatgaatcacgcggaacgactgctccgggtggcccaggatgtcgagcatcaggttcatccggtcgagatccagattggtggtgttatgctccggcgggcggctcatgatgtccagttcgacgtcccgcatgctctcattgttccgattcggatgctcgaatgacatatcctcttctaacctctgctcgtgttgctgttgcgccgttcggagtgcgtatgccacttacgtgttcgcgccattctcgtcatgtctacgcatgcccgcatatattccgcttccgcatgcgcaggaagttccccttgcacaggtttgctctgcatggttcgggattcttgccttcacgcgtggagccgcactccctcaattccctctatcctagccgccggggtggtttatcgtgcgcgcacagtgaaaccgtctcatatgtcgccgccgcgcgggcagtctctacctgcagccacgcacagtgaagccgtctcatatagttgcaatgcggctcttgccgtcggcatcccattcttagtcggctgcaatccaaaacttgtatgtccggcgacgctgatgctattcagcgtcggtacagtgccagcttctggcggtacaccgacgctatgatgctcttgcgagtcggtggctggccaaaacctggattaatcccgactccatcgcctctcagtgtcgtctcctcgccaaggcatgccattctgccgtcgttgagaaatttcaacgtcgtcaatcgaccatgtcttgccccggaaacgactctcacaaacgtcctctacatcatcttttgaactcgcagaggctcattcactgttatgactgctctcaccgtcggcagccgtccaagccctggatctatgccgccaataaattgcagcaaatcgtcggccccgatacaaccattggactcacgccgacgctagattccacactcagacagaagccagccaatatctgaaccagcaccgacggcgtacaaagcataagcaccgttaaccgtcaattcgccgccctctaccagctacatccgccttcgccgatgatatcttgttcgaatccccaaagcacgttgttcgaatgacattactgatggtggataagttttgtgtgttatccactattccgaattagcggcctaataccttgaaattatcgggagtatctcgctccaagacagccaagctccgaggctagaaccacaatggctgaaattcatacttacgctgcttcgttccggctacgctcgacgtcatgaagacacacaaagcagtggcctcgctcatatcagccgcgcagaatgagctgagatgcgtctattcaagaaatgaagcggaacagaccgctctacgccgccgtgcccagagtggtgagttgttgaaagtgtatgacggcattcccagtctttatgcaaatactgcatactgggatggtttgacgccgccggagcgaacgttgcatatagcccgcgctcttgcgcaagagcatcctcagtgggtttttggcggcttggtggcagtaagtgcctatggattcgaacatcaatggcatttgcatgatgactgcataaccatcgtgacttccgatcatggatctcgtcaatgccatcagcgcttacgacatgtctatatgcccgatatgaacaatccgaagacacattacgaggcctccggcctatccctgatatcaccggctagaaccttggtcgaggccgctatagaccttgattttcggtttgcgttaccgatctttgactcggcccttgccaagggaataaccaaggaagagatagccgccgactgcgttcaatggagaatcgattatgcccgagtattccgcctgctgcgctatgcaaacgaaaggagcgagaatggtggagaatccctcgcgcgaggcaccatcatcgaagatcgcttcctcacgccgcgtattcaggtaacggtgaccgacccacagacgaataccgagtaccgcgttgatttcgtatggaagctcgatgacgggcgcgtgatagtggccgaatacgacggcacacaaaaatacgtggacccagccatgaccgataaccgcagcattcaggaggtggtggccaaggaacgcgcacgcgacgagggactgaaacgagccggtgccaccgaaatcgtccatttcacatacgccgacgtcatcgaacgtactccgctgcgggtaaaactgatcaaagccggggtgcctcaggtggagacctccgcatagcagtgagtcccgcgacgcgataaaccttcatcgcatgggttcacatggattcagcccacagaatatgtcaatatcaatcggcaagctccagcccaagcccatgcccctctccttccctaccgagaacaataaacgggcccgcattccagcccgccgcactcgccatatgggcatatccggaagaccgtccaaattccgtacttggttttaccgtcagccgtcaatcgtggcacatcgcataaagccgactaatatgaggtgggaatcgatgattcgacaacaactacatacaggagagtggcaatgggtgaagtgatcaccgccaaggacaaggaatatgaggccgaagagcgcgctacggcaccgggcgcgaaccagtcgatgagcgaccgcgtgaacaaccgctcgctgcgcccgcagtcggccgcattcaaggagttcatgaagtccggctgggccgacgatgatccggagattaatcctctcgaatcctccaagttcacgccagcccgccttgaggcgctgggcaaggccttcccgggcgaacgtctggtcattccggccggccagccgaaggtgcgcaacaatgattgcgattacatgttccgcccggacaccacgttcgcctactacaccggtctgggttccgattacgaggccggcgccgtgctggtcctgaacccggtcgaccccgactcccccgaagccgccgccggcaagacgcacactccggaactgttcgtggcgccgcgcgccgacaattccaccgaggacttcttcatgtccgcccactacggcgaatactgggttggcccgcgtgccggtctcaaggagatgcaggcgatgaccggcatcgaaacccacgacatcgcccagctggccgacgccctgtccaaggacgtgggtgccgaagccggcgccgtacgcgtgcgcgtggtcagcgaaaccgacccgcaaatcacttcgatggttgaatccatccgcgaggccaacggtttcgccgatccggacaagaactccgcatccgacgacaagctgcacgagttcgccgccgaggcacgcatggtcaaggacggctacgaaatcaacgaaatgcgcaaggccgtggacgccaccaagcatggcttcgaccgtctgctctccgcactgccggccgcgctcgacaagccgcgctccgagcgtatcctcgaaggcgcgttcaacgccgtgtcccgtgaactgggcaacgccgtcggttacgactccatcgtggcttccggcccccacgctccgattctgcactggatgcgcaacaccggtgtggtgaagaccggcgacatgctgctggtggatgccggcgttgaggtcgattccctgtacacggccgacatcacccgcaccttcccgaccaacggcaagttcaccgacttccagaagcgtctgtaccaggccgtgctcgactcgcagcaggccggtttcgaagccgccaagccgggtgccacctactccgacatccaccacgcctgcatgcgtgtgatcgccgagcgtctgcacgattggggtctgctgccggtgagcgtcgaggagtcgctgtccccgcaaggccagcagcaccgccgttggctcgcctgcggcgtggcccaccacctgggtcttgatgtgcatgattgcgcgcaggcccgtttcgagtcctatcagggcgcgccgattcgcccgggcatgatcttcacgatcgagcccggcctgtacttccgcgaggatgatctgctgattccgccggaataccgcggcatcggcatccgcatcgaggacgacgtgctcatgaccgagaacggccccgaatggatttccgccggcatcccgaagcagatcgacgacgtcgaagcctggatggccgagcaggctgcccaagcgaagtaacctaagctccctctgatgagggagcttcttttctactaaggaggcaatgtgtccactccggaatttgtgttggaattgcgtaagaagatcggccatgatctgttgtggctcaatggcgtgaccggttgtgtactgaacgaacatggtcaactgctgttgggccgtcgttcggacacgggcgaatgggcgatggtctacggcatcaacgagccgggcgaacagccggcggacacggtggtgcgcgaaatcaaggaggagacgggcatcgatgccatcgtcaccgatttggtggccgtcacctcgtcaaacaaggtgctgacctacgccaatggcgacaacaccatgtacatggatcattcgttcctgtgcgccctgaagcccggcggcaatgccgagccgttcgtaggcgacgaggaaagcctgagcgtcggctggttcgatctggatgacctgcccactcccctggcggccagcacgagcgagcggctggagctgttccatacttacatcgagaacaaaaaacacggcgacgcccacgccctgttccagttcgatgggcagcagtactagcggatataaagttagctccctctgacgagggagctccaatgctatgcgattacgcctcttgggctaggagctcgtggaggtgggcgcggtgttgctgctgttcgcgcgggtcgggcacgggcagggaggccagcagcttcttggtgtacgggttctccgggtgctgcataatctggtcggcatcgccgtgctccacgatctggcccttatgcatcaccatgatgcggtcggcaagcatatcgaccaccgccaaatcatgggtgatgaacaggcacgcgaagccgatttccgcctgcagtcgcttgaacagctccaacaccttggcctgcaccgacacgtccaatgcagaagtcggctcatcggcgatcagcagcgacggcttcaacgccaaaccacgcgccaaagacgccctctggcgctggccgccggacagctcatgcgggaaacggttcatgtaggcgcgcggcagctggaccatctccagcagatcgcccacatagttcttggcatcggccacggaaccgtacttgtggtgcacgagcagcggctcggccacattctccgcgatggtcatcagcgggttgaacgaggagcccggatcctggaacacgaaaccaatgtccgcgcgcttgggcttgaagtcacgctccttgacgccgttcatctcgatgccgagcacgttcagggagccgccggacaccttctgcaggccggcgatggcacggccggtggtggacttgccggaaccggactcgcccaccaggcccagcacttcggagcggtggatggtgaagttcgcgccgtccacggccttgaagtcgggctgcatgagatggcccgggtacgtgatggtcaggttcttggcctcgacggcgatcggctgttcgcgccaatcggccttgcgctcgatcggtttgccctcgcggtcgcgcacgaccagcttctgaccgatgcgcggcacggcacccagcagtcgcttggtgtagtcgtccttcggatggtagaagatctgctccacgtcgccctgctcgaccacgtggccgcggtacatgacgaccacctggtcggcgatgtccgcgatcacgcccatgttgtgggtgatgatgagcacggaggcgtcgaactcgtcacgggcgaggcgcagcaggtcgagaatttcggcttgcacggtcacgtcgagggcagtggtgggctcgtcggccagaatcaggccggggttcagcaccaacgccatggcgatgacgatgcgctgcttctggccgccggagaactggtgcgggtagtagtccacgcgggtttcggcatccgggatgccgaccttcttcaggatgttgatggccttggcgcgcagttccttcttgtccttcatgccgtgggcgcgcaggccctcttcaatctgccagccgatggtgtacaccgggttcagcaccgaattgggctcctggaacaccatcgcggcctcggaaccacgcacttcgcgcagctgttcgccgctcagggagagcacgtccagcgaatcggagccatcgcgcttggacaggtagacggcaccggaggtggtggccgtctccggcagcagcttgatgatggagcgcgcggtcacggacttgccggaaccggattcgccgaccacgccgaccacggtcttgcgcggaatggtgaagttcacgtcctcaacggccttgatggagccggcgtcggtcatgaaggagacggacaggtccttgatatcggcgagattcttgttgttttcgctcatctctcactccttgccttccggcttgccctcgccggtccattcggaggcgacgatggtcgggtcatggtcggtgacggtggccggcgggtcgacgttcgcgtcgagttcggcaatcacctcgttgcgtgcggtcggcttctcgtttgggtcgacggacgtgtcttcgatcgatccgaccacttcgccggcggacttgcgggcgcgcagacgcgggtcggccagatcgttgagcgattcgcccacgagcgtgatgccgagcacgatgagcacgatggcgatgcccgggaacacggcagtccaccagatgccggcggtcacgtcggaaaccgagcggttcaggtcgtagccccattcggcggcggcggtcggctcgatgccgaagccgaggaagcccaggccggcgagggtcaggatggcttcggacgagttcagcgtcaggatcaccggcaacgtgcgggtggagttcttgaacaggtgcttggtcatgatgcgccaggtggaggcgccgaccacgcgcgcggactcgacatacgcggattccttgatgcggatcacttcggcgcgaattgtgcggaaatactgcgggatgtacaccacggtgatggagatgccggaggccaggatgccgctccacaggccggactggccgtgggagatcatgatggccatcagaatggcgagcagcagcgaggggaaggagtagacggcgtcggcgatcatcaccagaatgcggtccacccagccaccgtagtagccggagaccaggccgagcagcacgccggcgaagatggagagcagcacggccacgacgatggcgatgacggcggtgcgtgcgccccacaccacacgggagaacacgtcgaatccggcggcggtggtgccccagatgtgttcggcggagggtgcggcctgcgccgggaaggacgtgccgtcggcggccttgatctgggcgtggccgtagggggcgatcagcggggcgaagagggccacgagcaggaagaacgcggtgatcgcgagaccggtgatcagcatgcccttctgccagccgaccgccacgcgcagttccttgatgatcgggatcttggtccagaacggcgtcttggtgctgacgttgagcttggtgaggcggtcgtcaccggggacggtgatcttgtcttgggatgcggtggtcatctcagtacctcactctcgggtcgataagcgcggcgatgacgtcgacgaggaagttgacgacggccacgatgatggcgataaggatcacgatgccctgcacggccacgaagtcacgggccttcaggtactgggacagcatgaagcccaggcccttccattcgaaggtggtttcggtcaggaccgcgccggcgagcatcagggcgatctgcatgcccatgacggtgatgatcgggatcagggccggtcgccaggcgtgcttgttgagcaggcgcttttcggagacgccgcgcgagcgggcagcctcgacgtagccggaattgtaggtggagatgacgttggtgcgtaccagacggatgaacacgccggcggtcaggaggcctagggcgacggccggcagcacggcgtggcgcagcacgtcgacgagcacgttcatgtcgccgagctggatggcgtcgatgatgtagaagccggtcggcgataccagacgggtgaactgcatttcggagttcaggtcggagcggccggaggctggaaggatgttgagccagacagcgaagatgagcttcagcacgaggccgaggaagaacaccggggtggcgtagcacaggatggcgaaggtgcggatgccggcgtcggcggcacggtcgcgtttgcgggcggcgagtcggcctaggccgatgccgacaatcagcgccacaatcagggcgaggaaggccagttcgaatgtggcggcgccgtagtgcgtaagaatgctgatcaccggctggttatcggtcagcgtcgtgccgaggtcgccgtgcagcaggccgccaagatagtcgacgtattgcacaatcagcgggcggtcatagccggccgcgtggatgcgctgctggagttcggcgggtgtcaggcggccgcccagggcggcggaaatcgggtcgccggtggcgcgcatcacgaagaacacgatggtgaccagaatgaaaacggtgggaataatgagaaggaacctcgtcagcacgaagcggaagaaactacctgacagtcggttcttcttcgtcttggctttcgccggagtggtgctggaggtcgctatggcgctgtctgacacgcgatgctccttggtgttggtaatcggtatataaagcaataaaggctcccctctccgaggggagctggcggcgaagccgactgaggggagtcatacgagttgggctcccctcagtctgccgtcggcagacagctcccccccctcaaagaggggagctcatgctggatcagcccttggtgacggaggcatagcggaagcggaaggaagcgtcgagggtgacacccttcacggaggtgccggtgacggcgacctgggcaccctgcagcagcgggatggtggagaggtcttcggtctcgagcttctgaatctgcttgaggatgtctccacgagcggactcgtccttctcgccggcctgcttgacgatcaggtcgttgacttccttgttggagtagccgttgttcacgaagttaccatcgcggaagaacggggacaggtagttgtccgggtcggagtagtccgggaaccatccaagctggtagaccgggtacacaccgtcggaatcgtcggtaaccacacgatccttgttgtactgggtccattcggtggactgcatgtcgaccttgaacaggccgcctgcctcaagctgggacttcagggcagcgtactcgtcggcggagacggagccgtagtggtcgttgttgtactggagcttgaggtcgaccggggtggtgacgccggcgtcggcgaggaccttcttggccttctcggtgctcggcttgccgttgccgtcgccgtaggcggacttcagcgtgtcatcgtgaccggccaggccgtccgggatgaaggagtacatcggggtgtaggtgcccttgtagaccttggtggagagctcttcgcggtcgatgaggttggcgacggcctggcgcacggccttggccttgttggcgtcggcatcgggctgggattcgccgtagggctgaatcttgaagttgaaggcgatgaagcgctcctcaccgcccgggcccttgacgaccttgaccttggagtccttggagaggtcctcgatgtcggtcgggctcagggagcggtaggccacgtcgacctggccctgctggacggccatcttcaggttggaggcgtcggcgaagtacttgacctgcacgacggagttcttggccggggtcagacccttgtaggagtcgttcttggcgtaggcggcggactcgttgatcttgaaggctgtcagcgtgtacgggccggcgaaggccttcttggagacgatggtgtcggcgtcggcgagcttgtcggcgtcgaaggtatcctcatcgacgatcgggccggcggggctggacatgacctgcttcagggtcacgtcgaagggcacggaatccttgaacaccacggtggtgtcgtccttggcggtcacggattcgacgttggcgagcagggagctcgggccgttcgggtcgttgatcttcttgatgcgatcgtaggagaacttgacgtcggaagcggtcaggtcgttgccgttggcaaacttcaggccgtccttgagcttgacggtgaattcggtgccgtcatcgttccaggtaccgtcatcggcggcgatgtccgggctcagttcggaggtgttgtagtcctgggcgtacaggaacgggaacacctggatctgcacggcgtatgaaccgttgtcgtaggagccggcggggtccaggctggtgatcttatcggtggtgccgatggtgatggcgttgccggaatcggcgcctgcggcggtgtcatccttcacgccgccgcaggcggtcagggatgcgatggcggccacggagacggcggcggccagaatcttcttggaattcaacaggaatcctctctcataacttgtttccacgtcatcactgcgggcgtggattaccgcctgactatggtgcggatgtgttacctctgcgtttccatagtcatcgacttatgtttcgcttgtggcgaccaaggccggttttatgcggtatcgagcagtattacggattcttgtattacgacgtgaataacggtcacatggtgagacaaatatactatcatctcaccatgtgaccatgttcgtagacgaatgccttccattcgtcaaccggtcggcctactgctacttgagcttgcggcccgcgcaccacacctgttcgaccgtccagtcggccgggtccgcaaggttgaaatcggcggcgaagccgggggcgatgaggccgatcggcgccccggtgaccgggttcggccggtcgaagccgaacgccttggccggcgtcagagtggccgcctcgaccgcgtccaccgggctgaagcccagttcgtccaccgcacggcgcacggcgacctccagcagcagagtggagccggcgatggcgccgttggagaccaggcgcgcatgcccatcgaccacgttcacgtccagcgcgcccaacttgtaggcgccgtccgggcagtcggtggcggccatcgcatcggtcacgaaggccgtgcggtgaggcgcgaaccggaaggagaggctcaccatcggatcctgcacgtggaatccgtcgttgatgagctcgatggtgacgcgcggatcttccaccgcagccggaatcggaccgggttcgcggtgatgcaggccgttcatcgcgttgaacatgtgggtcatgatgcccgcgcccgcgtcgaagccggctttggcggtctcgtagtcggcgtcgcagtggcccacggccggcaccacgccggcagcggcgaactggcggatggcggagatgccgtggggcagttcgggggcgatggtgatctggcggatgcagccaagcttgccggaggcggggtcggcaccggaggcatcaagcatcttatcgacgatgtcaggcaccggatccttgagacattccgggtcatgtgcgcctttgcgcgccagggccaggaacgggccttccagatggcagcctaggatgtcggggcggccggactccatcttggcgcggacggtgcggatgttgcggcagatcacgtccacggggttggtgatcagcgagagcacctggcgcgtggtgccgtgcacggcgtggccggcccgcgccacgtcgatgccgtccggcccgtcatcgaagctcttctcccatgcgccgtgcgcgtggatgtccacgtagccgggggtcagaatacggccttcggcgtcgatgaccgcgttgcgatcggccgggtcgagccccaccgtgcggcagtagtgctcgaaggtctcctcccccgtgccggccgccacgatgacgccggcggcatcggagacgacccaatatccgcgccgttcgccgcgcgcatccaccttgcgcgcgttacgaatcgccaccggagccggcttgccctccagtgccgcggtcacgcgcgagactatctcgttcctatcagacatgttgttctccttaccgctcatgcgctcccgctggcgggagccagcacacgataactcagatgccctgccaggccggcttgtgggtgtaggcataacggtagtagtccttgtggcgcaggcgggacgcggcctcctcgtccacgataatcgtggcgtgcgggtgcatctgcagcgcggaagccgggcagaacgctgacacgccgccttccaccgtctcctcgatggcttcggccttgccggcaccgaacgccagcagcacgaggtgacgggccttcatgatcgtgccaataccctgcgtgatgcagtgggtgggcacttggttgatgtcgttgtcgaagaagcgcgcgttgtcgatgcgggtctgttcggccaaggtcttgacgcgagtgccggaggccaacgaggaaccgggctcgttgaagccgacgtggccgtcggtgccgatgccgaggatctgcacgtcgatgccgccagcggcttcgatggcacgatcataggccgggccggccagcgcgactttgtcgccgtcttcgagcggagtgccgttgagtacgtcgccgggcacatggaccttggccgggtccaggccaagcggttcgaccacggtgcgatggatggtcgcatgataggactcgggatgggtcagcggcagcccgatgtattcgtcaagcgcgaaaccacgcacgcccgaaacgtcaatggcctcgtccttgacgatcttggcgagcgcctgataggcggccagcgggctggagccagtggccaggcccagcacagcgtccggctttgctttgatcaggtccgccacgcaacggccgtagatctcgccggcctcggcttcgttcttgacaatgatgatttccggcatcggtttcctccagttccgtgcggcccgcccgatgcgagtcgctgtaccgccgcccgtcttgcggataatggcaacatccttgtcacgtccgggtgccgcgcggcgttccaaccaccgttcggcgtagcgccgattggtgattcgctatttgttaatgatactaacaattttggaccttatgaacactcacggtgtttcctgacgcttcacacaggtacactggaatttattagtgaagtttcataacagtttcaacgacgaaattgcgcttcaccgtctaagctgtgtatggaacaacaatcgccgtccactcgctcaccatcaggcaggaggaaacatgtcatatctcggtctcaacacaacgaccgacgaccatgcggccaaggcttcccccgccgatgtgcgccgcaagaaccgccaacttatcttcaggttgttgttccccaccaaccagtattcgcgcgccgagctcggccgacgcaccggattgagccgcgtggccgtttccgatgtggtcggtcggatgctggaggaaggattgctgcgcgagaccggtcaggcacccagcggcggcaaaggcaaacgaggcacactgctgagcatcgatatcgatcgactgcgcatcatcagcatcgacctgacgcaggagcacctgctgcacggcgcagtcaccaatctgctcggccagccgctgcgtcacgccgaagtcaccctgaacaccggctcattcgtttccgtggatgtgatcatcgagctcattgagaagatgctgggcatgtccgatggcgaggtcatcggcatcggagtcgcctcccccggcgtggtagacaacggcgtggtccgctcctccacgatgcgcggctggaacaatctcgacctgtccacgccaatcgccgaacatttcggacttgaagtaaacgtcagcaacgacgccaccgcagccatgctcaccgaacgtttctttggccaaggcgggccgaatatgcttttcgtgcgcatcgaaagaggcatcggttcggcgattctgctctcggacacgccggtaatcggcgaactgcacgcggctggcgagctcggccatatttccatcgatcttgacgggccgccgtgcccttgcggcaagcacggttgcttggagacgatgatttccggaaccgcattgaagaagcaactcagcgcagcagacgtggagcagcatcagaatatccttgctcgggcgggccgctatcttggccaagccctggccatgcctgtgggccttttggatatggcagacgtatgcgtctatggccagccgaacatcatcaacgcgacgttcatcggcgcggcccagcaatatctggatgccgccacatcctcgtccttccacaaacacacggtgattcggcgctgcgaatgcggacctgacatcaccgtacagggcgaggccatcgccgtggtcttccaacacttggccaaataaaagccggtcaccccggcaacgaaacgcgcaagaccaagcgcggcacagcacgacataaagcgatataggactgcgtgggagatggggcctcggagacaaatctgaggcctcatctcccatgccccggcactatgccaggctacgccgccatggcggcaccgatggctccgactggttggccgacaggtgccagacgcagccgggccggcaggtccagcgtttcgaggaatcggcattgcgattcgcgccggcgcagctcagccgtgatcacctcgaccaatggttcgccggttttggccatgccaccgcccaagatgatgagtcgcggatcaacggactgagccaggatttgtatggtgtcgccgatggcgcgcactaccatgtccagcacatcgacggcctcggcctcccgctttttcgcgcgacgaatcaggtcgggcatcggcgggtcggcgttgggccacagacgtcccacggatgcgcccgagcagacggtttccaagcatccgtattgcccgcaagggcacttgaggcgatgaggttcgactgggatatggccgatttcgccggccgcaccgctatagccatgcatcagcacgccgttttcgacaatgcccgcagccagtccggtgccgaagttcaggaacgcaatggtaccggccatgccatctgcaccgcccaacacggtggccgcgccgacggcggcggcgttgacgtcgttttccacatgggccggcacgcccgaacgctgcgagatcaacggccccatatccagcgagaccacgtcgagattcacgatattgcccacatgcccgctggccgaatccaccgtgcccggggtaccgacaccgatggccctcacctcgtcaaaacgctcacccgccgcctgatgcgctacagcgacgatgtcttcgatcacggcatcgttgccatgtctggcgggaatacgggcggaacccaataccgtgcccattgcgtcaaccagcacagcttcgatttttgttccgcccacgtcaacaccgattttgagattgttcatagtgttttcggacatcagtcctcccctgttcttcatcgaacgtttcgcttgatatcagtgtacatctgactattgacaactatcttaacaaattcacccaagacgacactcacatgcacgacacgccgaatgacatattgattgcgtcaatcaattaacagcgttaatatcttaatcaagttcagattcaaagacgagcggaacaactcgcagcagtgcagacaaggaggacttaagaccgatggcaacaaacaccacccacgccacttcccaggccagtgtctccgaatccaaccgctcccgcatcgtcaagcacctgtatcacaacggcatcagttcccgcgcgcaaatcgccaaggcactggaactcacccccgcggccatcaccaaaatcaccgcacgccttatcgaggccggcatgattgaagagaccggcgatctggaaggctccaagaaccgccgttccatcggactcaagctcaacaccacgcacttccgcatcatcggcatcaaattcgcccgctcgctggtgcagatcggcgtgttcgacctgtgcggcaacaccctgagctttgaaaacctgcccacggtgtgcgacaacaccatcaacgactccatcgtcaccatccaccagcgcgtcgaacaactgctcgacaacgacccatccatcgtggccatcggcatggcagtgcccggcccctatctgcgtaacgtaggccgcaccgccgtggtgtccaacatgcagggctggcgcaaaatcaacttcatcgacgaattcgccaccgctttccgcgtgccagtgttcatcgaacaggacgcccgcgccggcgccctcgcacattatctcttcgacccgtcggtgcacgccgacgacaacctcgcctattatctggtcggcgaaggcgtgggcctcggcgtcatcgacaacggtcgcctcatcaacggcttcctcggtgccgccaccgaaatcggacacatctccattgacgtcaacggccgcccctgcgattgcggcaacatcggctgccttgaacgctactgctccacccccgccattcacgatacgctcatcgccgatggcaccgtggttcccggcgcggccgatatgacccacaccgaagccgcccgcgccctgttcgccaaagccggcgacggcgacgaagcggcaatcgccattgtccgcgaagtcgcccgatacgtcggctacggatgcgtcaccatcttcaatggatacaatcccgagcacatcatcatcggcgacatcgtgtccgaagccggcccgatactgctcgatgaggtgcgcgccacggtggccgaacgggccatccccgaaatcaatgcctccacttccatcagcctatccaccttgtccgccgacgcggcggtctccggtgccgcagcagtgacagtgacccaattcctcgaacacccctcggtgttcttcgacgtctcctaaaccaagcgccgacatcacaagattttccatacgaaacacccgataaaggaaacaaaggaaaggaaaccaaccatgactaccccgatcgttctgagcctcggtgaactgctgtgggacatgctgccgagcggcaagcgagccggcggcgcccccgtcaacttcgcctaccacgcgatgaagaacggcaccgaaggctgggccatcagcgcggtcggcgaggatgaactcggcgacgaactgattgccaaggccgacgaggccggcatcaacaccgttcttcagcgcaacgcctggccgacctccaccgtcgaagtcgcactgaagaacggtatcccggagtacaccatcgtcaagggcgtggcttgggaccacatcctgtacacccgccagctcatcgacgtggtctccaaggccgacgccgtctgcttcggcaccctggccctgcgctcccccgaatcgcacgccaccatcacggagctgctcaagcacaccaagccgggcgcgatgaagttcttcgacatcaacctgcgcggcgaccactactccaaggaacttatcgaggaactcctcaaggcggccaccgtcttcaagatcaacgacgaggaactcctgctgctgcgcgacatgttcgacattcgcggcacctccggcgaagacgcctcccgctggttcctcgaggaattcgacctcgactacgtgattctgaccgccggctccgcctactccaccatcatctcccgcaagggcgaggtctccacgctggacactccgcacgtcgaggtgaacgacaccgtgggtgcaggtgactccttctccggcaccttcaccgcacgcatcctgctgggtgacacgctcgccgaagcccaccgcaaggccgtcaacaccgccgccttcgtctgcacccaggccggtgcctggcccgagtacccggccgagatgcccgactatctggctgaaatcggcaagtaatccactcccaccccattttcccgatggctttgccgctctataccggcaaagccatcttgttcagaggagtcaccatgtccattcgcgacaccgtcaccggcgtccagcatgtcggcattccgaccacggacctcgaaggcaccatcgcctactacgagcgtctcggcttcgaatgcctcggcatctatcccaacggtgaggaccgctgcaccttcctgcgcctgaacaacctgaccctcgaggtgtggaccatgaaccccacgcctatggaaaacggcgccatcaaccacttcgcgctggattcgacggatatcgaagcgtccttcgccgaagcccagaagctcggcctgaacttcgtggaaggctccatccagcacatcgacaccttctggagcaacggcatccgttacttcaacgtgcttgggccgaaccacgaggtcatcgaattctgccaaatcatgtaacgccatgatgacatccgataacggaaccatcactattcactagtcatcatccattgaccgatagatctgtcgtacgtccattcatagagaaaaagggaattcaaaatgagtagcgaaaccaccaagaccggcaacgccggtctcgtaaaaatcgcgcctgtgatgttcgcgttcttcgtcatgggcttcgtcgacctggtcggcaccgccacgaactacgtcaaggctgagttcaatctggccaacggcaccgcgaacctgttcaccaccatggtgttcttctggttcctgatcttcgccgtgcccaccggcatgctgatgaacaagattggccgccgcaagaccgtgctgtggtccattctcgtgacgctggtcgccatggcactgcccatcatcgcctacgtggccctatccggcaccgcacgtctggtgctcatcgtcatctccttcgccttcctcggtatcggcaacaccttgatgcaggtgtctctgaacccgctgctcaccgtgttcgtcaagggcgacaagctcgcctccaccctgacgctcggccagttcgtcaagtccttcgcctccctgttcgccccgtacatcgccatctggggcgccacccagctcggcatgtggtggatactgttcgtgatctatctggtcgtcggcatcgtcggctacgtgctgctcgccatcgacaagatcgacgaacccgcccccgacgccggcaccaccaccatcggccgctgcttcaagctcctgttctccgaccgcatcgtgctgctctgcttcctcggcatcgtggcccacgtgggcgtggacgtcggcatcaacgcccaggcgccgcgtatcctcaccgagcacaccggcgacaccttcaccgaaatcgccgccaccgccaccatggtctacttcgtggcccgtatgatcggctgcttcaccggcggcatcgtgctctcgaagatttccaaccgcgtcggcattctggtgtgcggcaccatcatgaccgcctccaccgtctgcttcgccatcttctgctcgatcacctccaacccgccggtcgccctgttctgggtggccgtggccctggtcggcttcggcaactccaacgtgttctcgctcttcctctcccacgcgctgatgtaccgtccggagcgccagaacgaaatctccggcctgatgctcatggccctgatcggcggcgccatcttcccgcccatcatgggtgccctggccgacgccatgagtgcccagctcggcgccatcatcgtgatgtccgtcggctgcatctacgtgctggtcatcggcgttggatacaaggccatcattgaaggcaagaaggcagccgtcaaggcctgacgatcggcctggctgcggcttcctgaagccgatatacgaaaagccctgtgcgaatgatccgcacagggcttttcgtatatgtacttgtcgcttggctcagcgggacccgtcaggcatatcagtttcggtgtcgatgacgatggtcaccggcccgtcattgaccagtccgacccgtatatgcgcgccgaaacgaccttccttcaccggcactcccccggagcgcaacgcctcgttgaacttgatccacatgagatcggcatgctcgggcttgccggccttgatgaagctcgggcgattgcccttgtgcacgtcggcgaacaacgtgaactgcgagatggagagaatctcaccgccgatgtcctgaatcgaacggttcatcttgccctgcgcatcctcgaacaccctgagattcagaatcttatgggccaaccaggcgatctgcttgtcgccgtcctcatcggtgacgcccaccagaatcatgaatcccgggccaatctgctgcggctcgaacgtgggatccagcgtgcccaattcattgaccacgtccacggacgcttcggatactcgttgcaatacgactttcatggttccctacagtacaacgtgtgcagtcaccagccggtaacgtacacgaccgactggtgaccggtaatatctgcactgcagttcatcgtttaccgcttcattcgacgacgagaccgatagtcatcacgaacaccaccaagaaagtccggcgcgctgaggtcatcaaggtcagcacctccgcgcacggcggtcgcggcacaggcaacggcctcaaacgaggctttgattccctgtccatcggcatgaaaatcagtggcgcatcgcggtgagataccaaaatcaccagccgtctgttcggcgtcgatgttcgcgcccagaaacacaaactcccaatgatagcgttcacgctcataggtaatcatctgcttgatctgatgcaacgaatatcgacgactcgcgttctcatacccgtcagtaatgatgacaaacagcacatgttgagcacggtacgctgccgcagtatgtcgttgcgtcacgatcatgcggtcaatggccagcccaatcgcatccaacaacgcagtgctaccgcgcacccagtaatcccggctcgtcaaatcgttcacttcgcggatgtcgaggtgattatgcaaggtttcgattcgatgatcgaacagtagggtcgttaccctgcactcgccggcaattgttcgctgcttggacagcatgctgttgaagccaccgatggtgtctgattccagacctcccatcgatccgcttctgtcgacgacgaacaccagttccgtacggccgttattgccattgtcgttcttgcccatgatgaatcctttcgctcattcgccagccggattgtcggcgatatcaatgagcttcgcatcatgggaccagtcctaggtcgcttggcaagcgacaatatgccgcgtatcggcagcaggtcaggagacgagcgtaccgctccgcatcattgcccaagcaacggctgatcgtatcggaacaacatctcgttaatagtgaatacatcaaacatctcatggacgatgaagaattccacgatcacatcgaatttcacgctgtgcgacagcgcatacccggcgcacgccaatatatcttgcgtctcgtcaatattcagccgtaaggcaatggccagtgccaaaaccgttttcttgctgggcatatagccatcgccacagcgaattttagagaacagtttacgattgatattcgctcgtttatatacctccacgtcggaatatcctttggcgtcgataagcctcaagagaatgatgttaaaaggttcatccagattggagagcaccgcatcatccacatgcccggcggatttcggcgatggagctgccgacggcgccgagtagacaggcgtttcacccatatcgcccaggaaatccggcatgtccaagacgccggaaggtacggccctatccgccttcggcttattatccgaaaaccgttggagagcaagcagctcatacgttctgcttcctagcgtatcttcatgctccgctacataataatcatcaatatatgcgcgaagacgtttgtcaatactgctgcttatttcgaaagcggttttgtcgaatacgcataggtatacgtcgagatcgtgtccggagtcggctgcgtcgcccaggaatcggcgaatctcatcgagggccacatgaagggcctcggctttcggatatccatagataccgctggaaatcaaggggaaggcgatgctggcacacccctgccgtgccgcgagttccatcgaattgcgatagcacgaacgcagcagacgttcttcatcatgcttgccgtctcgccatatcgggcctgcggtatgaatcacatagcgtgatggcaaattgaatcccggagtgataaccgcctcaccggtatgaatgggagcaaaccgatcgcaggcagcagccatgcgcgagactcccgcagcgcggaatatcgcgccgcacactcccccacccatggcgagctgcgtgtttgccgcattgactatggcgtccaccttcatcttcgtaatatcctgtcggaccaattccagcggcatatatcctccctgattacggcgtagcataatagcctctacacatcgtgcaatcggcagccctgaactaagtctaaatcgtttcttccccgcaagttcgtccaactgacatatccgacacgagagaatagcgggaaaacaaggaatcaacggagcaataacagaaagccgctcagccttactttcgtaaagccaagcggcttgtttccgccgaggcggattggtggaggcgcggggaattgaaccccggtccgatgaccgagcccacagtcttctacgtgcgtagtctgctggccaagttggcgatttttctgcccccatcgatgtcgcagacaactgatggcgagcatatccgcagttaaagtcccgatgcagccctgaggctcaactgcatcagcaagtcttctaaacgacgctcagcatcctcccaaagacgaggaggagtgaacggagcggctgctcactggttaatcctgactaaaaatcaggcagcgagagcgaactcagtgcggttagatttagcacttattcttttgccggggtcatccacgagcggacccggcgttctcggcacgcttccctgcagcgaacaggtcaccgtcgaaaccgatcgcccccaatcttgagttatcaagcttccggcttttcggccggacttttcagcatacaccctatggcgctactcgcgcaaatcgccagcagcgaacatcgccccggaaccaacgaagccaacgaaatcgccgtcacttgatgatgggcttctgggatgaggaaacatcaatctgatgtttcccggcaaagccagccgtgccagcggtgatgttcttgtcgatttcctcgacttccgccaacttcagcttcagttgcgaagagtcgccccaaatgattacgcggtcaccgtcgttaagcgtggtagtcaccgaatcctgcgtctcagcggtgaccttggtaatggacttacgcatcgattccggcaacgcgcccagaatcgtcagcgtctccttcaccgaacggttcttgagactggcgtctatatccttgacctcgatcaccgggatgccatccacgttggcgttcttcaccgagttcaacacacgcgcctgggaatccaccgcggtcagggtatcgcctcttttcagcatggccgcgggccgttgcgccttgacttccacgctcatcgacttggggaactgtttggagaccttggcctcgctgacgccgggaatggacttgagttgctctgtgacctcatgggcggagaccaggaacaacgactttccagcctgcttatcggcgatgacatggatggtctgcgcactcacccattcgttggcaccggatacgccgatctcgctggtttccagacgaaacaccgacgagaaaagcagcagccatgccagccccgccactacagccacactgacgaccgcaatcaacacgcgtaacgcaacgacgcgcacgtttgcacgcttgcgttctttggcgcgttcggtgaaattcaccactttcgggcgtgatgcgactcctagggagccggtggtctgatgcagcgtttcggcaacgtaatcctcgctgtgcaaccgccgtgcatcgacgaaggcaccggcctggcccttggctaccgtcgcatcgtcgatgatctccggctcgtcgatctcatgaccggaagacacggaccggggagcgcgagacttcgacgagcgacccgtgtttccgcgtgaaccgatggtgcgcggcttgcgggagctcccagacgaacgacgtgagccgttgtcattgcccccggatctgaccgtgcgcccggacatcactcgcagctttcccgatgggcctcaagtgcggtgagcagcacctgatccatgtcggtgatgtcgcccgcgcccacggtgaagatcacgtcgccgtggtgggcgcgcatggccatcatcttggcggccaggcacatatcctcaaccggctgaatccacgtgcctgcggaagcatccttgagtcccgcagccgcgtccacgatggtggaggggctgatgtccgggaaatcggcctgcttttcacgggccgggaagatgccggtgataatgacgtcatcggctttggctaaggatttggcgaactggtgcgcgaagaacttggtgcgggagaacaggtgtggctggaagatcacacgaatggtcgaatcggggtaccggcgtcgggccgcatccagcagggccgcgatttcggtgggatgatgggcgtaatcgtccactacagtgacctgcttgaccgtgccgcgcacctggaagcggcgtgccgcaccgaggaatgtgccggccgccttggccgcgtctgcggggctcacgcccagcagcacggcagcgctgatggcggcggccgcattgcgcgcattgtgcacgccaggaaccttcagggcaacgctctgagacaccggctcccccgccgtcaccgcggccggcagatgcagggtgagctgttcgacgccgctgccagcggtctcgctttccgaagcgatccagacatacgcggcaccgcccaaatcgggcagggattcacgcgcggtagtgccgtaggcaacggtatgggatttcacgtcggcgggcagggcctccagcacggcaagtccgtcggggtcgtcgatactgatgatcacgtgaccggtggcccggccggcgtgggcaacgaacgcggcacggtagtgggcttcgtcgccgtaatggtcgagatgatcggcttcacagttggtgataatggcgatggtcggatggtatttggcgaagctgccgtccgattcgtcggcttcggccaccaggatgtcgcctttgcccgcgtgtccgccgtccagcgtggtgccgtccgggccttggataaagccgccgatggcgtagcttggatcggcaccggcgttcaccagaatgtgggacagcatggagctggtggtggttttgccgtgcgctccggccacggtgacggctcgtttgccgttcatgagcagggcgaggatgtcactgcgatgcacaatgcgcttgcccgccgcgtgtgctgcgacgatttccggattgtccggtttgatggcgctggagtagaccacggtctcggcctgggcgacattttcggctcgctgcccgaattcaacggtgatgcccagcgtttcaagtcggtcggttttggcgctgtgtgcgcgatcggagccgtccaccgcgactccttcggtgtgcagcatttcggccagaacgctcataccggcaccgccgataccgatgaaatgggtggcgccgagatccgcagggcgggccgcagcatcgaatgaggcatacgtagggtcaagcactatgggctgatcttgagacaattcaaaactcctttagggattccagcaccctatattatgaccgtatctcgtgctgcggaacggaattggtcagtatcgcgcacggaatgatatctgaatactacttggatggttcggctaattgcagaacgtgccgggccatgatttcggcagcgtttctgatgccgtattcccatgccttgcggccgaattcggcaagtcgttcgtgatcggcgagcagatcgggcacatgctcatgcacccactgcggggtcaggtccttgtctgcgaccagaaggccgccgccggcgttcaccactggctcggcgttgaaacgctgctcgccgttgccgatgggcagcggcacgtaaatggccggcaggcccagtgcagccagctcggataccgatccggctccggcacggcaaatcaccaagtcggcacaggcaaaggccagatcgattcgttccagatattcggcggtatggtagtcaccttgtccggccgattcggggccgatgccggtaagcacgtccgcgccggccgaggccgtgaccagttcgcgtacttcgctgattttgcctcgcccggtcaagtggatgatttgtgcgtgggccaacaggtctgcggcggaggaggcgatggcgcggttcaggctttgcgctcccagcgatccgccagtgaccagcaccagcggacggttcggatcgacgccaagctgcgcggccgattcacggcgtacggcggcacggtcgtcaccgatgcgtttggtcagggaggcgatggccgggcgcaacggcagaccgacgcgctcgacgtcggctccggcacgcggtttgagaccggtgccctcgtacacggtaccgatgaaatcggcccaacgagcgcccagtttattggccatgccggcacgcgcattctgctcatggatggcaatcggaatgcccatcttgtgtgcggtggcgtagacgggggcggaagcatacccgccgaatccggccacgacatccgcatgccgcgtttcaagaatggagcgcaccttggcggtttctcgcttccattttgccgggaagcgcagcatgtacaggttagggcgacgcgggaacggcactttttcgatggtgtcgagctcgtagccggcctccggcaccaaatccttctccaaacccaccgcagtgccgatgacggtgacctgtgccgtgggttcgatgtcgcgaatcgccccggcgaccgcgagcagcggattgacatgtccggcggtaccgccgccagcaagaacgatatgtggtgtgccttgattcatgattaccgagtctacttacgcgctctgacgcgactgttttatctgcggttgagagcgcataagtcccacaaccagtccggccgccgtcaagcacataatcatggatgagccacctgcggagacgaacggcataggcacgcccaataccgggaacacacccacgaccacgccgatgttgaccatggcctggcccacgatccaaatggcgacgcacatcagcaccatggcaacataacgatcggtgacctgcaatgcgatgacgatcatgcaccaggcgagaatcgcgaagaacagcaatacgatggcgcaaccgacgaatccggtctcctcgccgatgatcgcgaaaatgaaatcgttatgggcggccggcaggtagttccatttctcccgcgaattgccgatgcccaatcccagaaaacctccggaggcgatggcgtacttggcgtgaatggactggtagcatacgctctgcgcgtcagcggccgagcaatcgccatatgtggccagaatacgacgcaagcggttcgggctggaaaccgccaatgcaccgaccataaccaccgcgcccaatacgccgactcccatccatttgccggggaacccgacgatcagaaaggccacgcctccgatgaagaccagaatcatggccgtgccgaggtccctgccgcccatcaccagcgccacgcctatcgcatacaacaccaacggcgcggcatatgctttgattcccttcttgtggtacatcttgctgcaggcatgcaacgacgagggcagccatatgcacatcgcgaacttcatgaattcagccggctggatagtggtgaagccgaggttcagccaacctttgttgccatagacgtcgatacccaaaggagtaaaggtcagcgcctgcaacaggcaggcacccaccacaaagagcacgccggtccgtttccagaacgtcaccggcatcatcaatgccacgaagcccagcaccaagccgatcaggcaaaacgcgccctggttcagaagctgaaggaacggcgacttgcccagtgcggccatggtgaccgtggagctggagaacaccatgatcaggccgaagcatgtcagccccaccacggccatgcggaagccgtggtagcaccatagcgggttgagcaagcttcgccaacccgtgtagtcagtgatttcgagtgcgggcttgtcagggactctgtatgccttacgcttatgggtatcagtggaggccatgcacctcgctccacgtcttggctgcggcggcgaatcgattgcctcgatccgcgtaggacttgaactggtccatggaggcgcaggccggagccataagcacgatgtcgccggcggcggtatacgtgccgcaggcttcgacggcacgatccatgacggtatcgttgtcttcgggatcgatgatggtcaccgggatgtccggagcttggctggcaaacgcttcgatcatcggctgctggtctttgccgatgatgacggccgctttgatggtgtgtgcctggtccttgaccaggtcctcgaatcgactgcccttggccagacctccggcaatccagatcacagacttggccgggaagctggacagcgaggcgcgtgccgcatggccgttggtggctttggaatcgtccacaaaacgaacagagccgccctcgactgcggcctcagccacggtttcgatgcgatggccgcccggcttgaacgaggtaagcgccttcaacgcggtatcgcgatcagcgccaagtcccagcaccaacgccaatgccgtcaatgcatcggccaccagatgcgggtacagtgagccgtccggctctgccagatgcgtgaaatcggtgatggcggccagtctgaccgactctcctactgcgccgccggccacgccgctcctgtccacgatccagccatcttcaatgccgatctggccggcttgaggggcctcgagcgtgaatcccaccttgcggcatccttcggcagtctgagcctcggccgccagttcgctgactttggcgtcctgcgcattgtagacgatggcgcgtttggcgttgtggaacaccttggatttgtcggcggcgtaattctcgcgcccgccatgccagtcgaggtgatcgtcggcgatattggtgatcgccgcgcagtcaagtgccagcgaatcggtgaagtgcaattggaaggagctcagttccacgcacagtacgtcgtgctgcggattggtggcgcaacgagacaggctcatgctcatgtctccggaggcgatattgccggcggtcggcgcgtcgagtccgcaggcggtgagcatttccgaggtcatctcggtggtggaggttttgccgttggtgccggtgatgccgatccatggagccggagtaccggtgcgctcgttattcacacgcagctgccatgcgaattccacctcgctcatcacggggatgccacggcgttgggcttccagcacgaacggggtgcgggggttgaacaccggggacgacatgacgtagtccacgtggtcccagtccacgtcatcaaaggagtggagatcggcctcgggcttcctctcgtcgacgccaatcacgtgggtgccgcgttccctcaatacctccgccaacgaggtgccggacacccccagtccggcgatcaccactgtcttatccgctacttgcattgttcctcctgatataggaattccgtgggtgagcataatccacccagatttccgctagctgaacagcaggccggagcgggtgacccagtcgccgtagaaaatcgtcagggcgagcagcacgaagatgagttcgatcatccagaaccgcaccaccaccttggtttcggtccaaccctccagttcgaaatgatggtgaatcggcgccattttgaatacacgtttgtgggtcatcttgaagtacccgacctggatgacgtcgctcatggcttccatgacgtacagtccgcccagaaccaccgccaggaattcggtgtgcgtggcgatggacagggctgcgaacagaccacccaaggccagggaaccggtatcacccatgaaaatcgatgcggggttcgagttgtaccacaggaagccgaagcaggcgacggccgcgcatacggcgatgacggtcagatcgagaggatctgacacggcataggaatatccgccatggctgccgcccttgatgtggtagctttcccagaatgcgatgatgccaaaaccagtgaaggcgatcatcgacgaacctgccgccagaccgtcaagtccatccgtcaaattcactgcgttggtccatgcggtcatcaggaagttcacccagatgacgaacaggatgatggctacggcacggccggcgaagtcgaagttgaagaacggctgttcgatgaagctgatgcctgcctgcgcactggggaatcccgatttggtgggaatcagcagcgcaagtaccgcgtagatggtggcgaagatgaactggccgatgaacttgccgcccaccgataggccttcgttctgcttcttacgcaccttggcgaagtcgtcgataaagcccagcagacccatcgacagcatggcgaacagtacgagcgccgcggaccaggagggcacgtcgcccgaacgcaggtatcggtacagtgcggaggatgcccaaccgagcagaatcgcgaagttgatgaccacgccgcccaacgtgggggtgccgcgcttgaccagatgcgactgcggcccatcctggcggatgtactggccatagtgcagcttgtggaccagccgaatcagcagcggggtgccgactaaggtgacgatgagcgacaccagcattccaatgatcagagcaatcacgtgcagcttctctttcttgtcggtttcttggggtggttatcaggtcagttctttgcccagcgttcagccaaagcgctcaggcctgacgcgtgcgatcccttgagcagtaccacagcgtcgggatggttgcgagccaagtcgatgaccagctgttcggccgcatcgatgtcgtgtacgcaatccaccgacgcggattggctctgacgggcaccgtccgccagagcctgtgccagtgcatcgagatgttggtcttgggcggaaccgaccgcgatgatcgcgtcgatgcccaattcgtccgcatacgtgccgatcgaggtgtgcaatgccgtttcatcggcgccgagttccagcatggcacccagcagcgccacgcggaacggctccttgccgtcatttgagttccaggccttcaacccgttcaggccggctttcatggagtcgggattggcgttgaaggaatcatcgatcagcgtgaaggaagtcccctcgcgattcaccgtggacaatgccatgcgatgagggctgatggtgtgctgcgaggccagaatccgtgccaccgtttcgggtgccataccgtaacgcatcgccacggttgcggcggccaacgcgttcatcacattgtgacgtccaggaatgcccagatgcaccggcgtatggttgccgtccgcatcgaccaacgtgaattcagcatgatcggaccggtcggcagtgacatcaatggcccgcacctcgggctcctgcgacgatcccaagccgaaccacagcacgtcgccgttggccaggccggccatgggaaccacgtgttcgtcatcggcgttcagtaccgcggtgcctccgggaagcaatccctgcacgatctcgcttttcgcctgtgcgatgcgttcgcgggagccgaattctccaaggtgagcgacgccgaccttcaatacgattgccgtgttcggcggtgcgatacgggtcagtcgcgcgatttcgccgatatggctggcacccatctcagccacgaagaaccgggtgtgctcatcgacccgcaacgcagtgagcggcaggccgatctcattgttgaacgatcccaccggagccacggtcggacctacggtggcaagcagggaggagagcagatccttggtggtggtcttgcccaccgaaccggtcaatccgatgatgtcgaagtcgccgtccagctcgcggcggcgaacgatgttgtatcgggcgagttcgccaagggcgtcgaccgtgtctttcactacgatctgcggaaggccatcggacttcacctcatggtcgacgatggccaccgtggctccctgtccagcggttttcgccacaaagtcatgcccatcgacacgctcgcctcggatggccacaaacaccgatccggggccggcctgccgcgagtcgctgaccgtattggtggctcgagactcggaaccggcgtctccgatcaatcgaccatcgacggccttggcgatctcctccacgctcatcggaaccatggtgtttcaaactcctttacgattacgcttcgtcccgtatccacggacttaattgagattattggccacatgcagggcactgcgtatgttgtttttcctcacgccggcggccagcaccatggcgatggccaaggacatgtgcccgagtcggacgcggtcatacattgccggtgaatccgcagccatttcatccgattcgggtgtcgacgaggtcatggacatgtcatgttccgcaacgaatgcgtagcgtgtcttcaattcgttcaagcttgcgcttgcgttgacatcctccgtgcccagtacatccacgttcaccgattccaacgcatgctcggccaacgtgcggtcatccatggcgatgatcacggccgccacaccgtcttcggcgcacacggacagcgcgcgctgcatatcgaggatgcccagaggatagttcaggttcatggtacgtgtcatcgacgtggacccggatgcggtgattaccgccaccggattgcccagcatgtgcaggaattcggagagctgggacacgcctgcgtcgacggcctgctcatccgcaccggtcaccgcgaacaccgccatggcattggacggtccgccggccagaccgctggccagatcgccgagtacgcgatcgtcgaaatcgccgtagagcaacggtatatcggcattggcgatctgccctttggacgcgcgtggcagcaacgccgcataggcaccggcctgtgcggcatgcagtacatcgggttcctgctcatgcgtgcagatgaacagcgagccgggaatcacggtgtccacggcatcgctgagtgaggtaatggtgacattggtggcgaagggtggatcgacttcaaaaccgtaccgttcgaccagcattcccagggtcacccgctgggcgatggattcgctcactgcactcatgggctatcgcctttctcccctgatccttaccacgtgactggaatagcatttttgcgtggactggagacaggcacctcgtatttctgcataaggaactcacaaatctgtgcggaaacagggccggccgtcagaccgccgaacacaccattcggatccttcatcaccacggtgaccgcatagcgcgggttgtccgcgggaatcaccacggaataatcggagataatggacgagagcgtaccatccgagccctgcacctctgcggtaccggacttggcggccatgcggtaaccatcgaccttgacgaacttgttgtagccttccgccactgattccatcgcattcatcatgtccgatgcgaccttttcatccaccacgcgggtggcttcgcccttcttggtctcagtggtcttgccattggcatcggtggttgatttgatgatcgactgctgctgcttgacacccttgttcgcgatggtggccaccacgttgttgagctgcagggcgttgacggtgtagccctgaccaaacaggatggtgttgcgcgtacgcagatcccacgccgaagggttggtgagcagaccgctcgattcaccgggcaggttcagtccggtcggttgtccgatgccgaatttggtcaggtactcgtagcgttgctcatccggatagttctccccggccataatcatgccgacgttcgatgagttctgcagaatgccggcgagcgtccagcgctcagtgccatggtcgaatgagtccttgtaggtctggccctcctgtgtgatgtggtccgggaccgacaattgatcgctcatcttatgcagtcccatctgcagatagccggacatggagataaccttgcccaccgaaccaggctcgaaggtttcggacacggcccgagacgggctcatcttcgccgcatcggtaccagcctgtacttcatcgctatcggccagtgcgcgaatctccccgctctggacatcctgcaccacggcgatcgcccacgctgcaccatacttggattcggcctccttcaagacctttttgacataccattgcacatcacggtcaatggtcagggtgacatcgtcgccatttttggccgccaccgattcggtcatggtgccgggaatctcttcgccgccattaccacgctggtaggtttcatggccatcggttccggtaagcgtcttgttctcgacctgctcgatgccggcgacgccatcgccgttgtcgttcacgccgccaagcagcgcgcccatgagatcgccatccgcatacagtcgttcactgctcagctcaccccagacaataccgcccaggtgcaacgactcgatgctgcgcttgacctgcggagtcacatctttcttcagaatcacatactgcccggtaccggacagatcagcgcccagttccatggcgttcatatccaggactttggccagcagtcggcccacggccgccgctccggtagcgcccacgggtttgccgtcaatttcgtggcagtaatcacgggtgttgtcattgcaagtaatcggctcgaactcctgtgcagcctccggattggcgacgatagtataacgctccacgctttgagcgagcacggagccgttggcgtcgaggatacgcccacgcttggcgctcaacgtcacggtcagggtgcggttagccgtggccgcttgtgcggtttgacggccgccgatgagctgggtggaggccagctgaatcacgcatgccgacgccaccaacgccaatgcggcgccgatggcgatgcatttgaacgcgaaggtcttgaccttggcgaactctacgatgcgacgaatggtgttcactgggttccgcctttgttggactggtatccgcttaagtcgatggacactgatccctgctgcgggaccatgcccatgtcgctggccttgtcgggcaggttcgcgaccaattgatcgagtttggcctgatcgtcttcgatatcttgggtaagtctgttgatgttggtttcgatctgtgccgcctcaaacgagttctgcaccatctgggtacgcagcatcagcgcgccgaacaaggtgccgacgaggaagatcactgcgatggccacgtgcaccagcggtgcgcttcttgttctggtccattcgatgacccgtccgacgacattgccctgctcgtttccacgcgggttggagaccacccgcagctcaggtcgggaggaggactgatgcttggtgtgcggtcggttcgaggctggagccgcgttcgatcgaatgctacgtgcagttgccatatgctgttatcccctccttgtacgaattcgtgccgtgtttttggctctgcccggagacgcggagccttgtatcttgacgtcattcaggccctgcgcggtttgcgtaaagcgtttcctccatcgtgacggaatctcacggctgacttccaccgcccgcaaccgcaccgaagccgatctcgggttggctgcgatttcatgttcgtcggccttgatggcacctcgcgtgagatccgtgaaaaacggttgggcatccggcggtatgacaggcaggccagccggaacatccactcgcagcccttgtgccatgaacgatttgacggttttgtcttcgagcgaatgataggactccaccaccagtcgtcccccgacatgcagtcggttcgcggcctgcggcaatgtggaggcgagcttgtccaattcgccgttgacttcaatgcgcaacgcctggaagacgcgtttggcgggattgcccgccgggcggtgggcttgcggcaccacttcatcgaccagacggttgagctgtgcggtggtggtaaacggctccttgtctcgacgcgccacgatggcgcgggcgatctgacgcgagaaacgctcttcaccgtattccttgaatatgcggaccagttccgccgcatcataggtggcaagaatccgttcggccgtcaacggctggctgacgtccatgcgcatatccagcggcgcatcatgcgaataggagaagccacgatcggtttcgtcgatctgcaggctggataatcccagatccatgaatacggcgtccacgcgttcgatgtcttggtccgccaacacctgatcgagctgatcgaaggcggcatgcaccggaatgaatcgatcggcgagcccctcccgttccatacgttcggtggccagccccagcgcttcactgtcacggtcaatgccgatgagccgagcctgaggcgcggccttgaggaaggcgatggaatggccggcaaggcccagggtgcaatccactgcgatggcgttctcatgttccagggcaggtgccatcaggttcacgcaatcgtcaagcaataccggcagatgaatattcgccacatcaaccatcagaattccacctccggcaacacatcgtcagcaatatcggaatatccctcttccttctcggcgaggtaggactcccacgtgtccttattccacagttcggcacgggtgccaacgccgatcaccacgacgtcggaacccagattggcgtaatcgcgcagcatctgcggcaccagcacgcggccctgcttgtccggctgctggtcgacggcaccggaaaggaacacacgcaggtattcgcgggcggctttgtttcccaccgacacacgctgaatctgcgaggcgatacgtcgaaattcgtcgaacggcagcaggtacacgcaccgttcctggcctcgggccatgaccaggccctgccccagctgggagcggaatttggccggaagcgccatacggcccttggcatcgatcttcggcgtatatgttccgagaagcaatggcggcagaccagccatgagatcggccatagtggtggagccttgtgcgttggcatcagcgtcgcgaatcgtctgatcggcaaccatggctccacctccttcatcgttacgtgggatacacttcggccaactggctcaccactctaccccacgattccccatttctccccactcatgcacgatttgctcacccttttagggcaattaccgatggattgcgcgtgtcggccacgactgtcgcacgaatggacgctccgcacattcaatccacgtcgcgcaccccaccgaccgagcagcatggtgaattcacgctgaattcacctattccgggttgtccgcatcactgacgtagggggtgtgcggtaaatttgaatgccttaagtttttctgccccacggaaatggaacgaagagaacagcatgtcgagttacgcctcccagctgcatgaagagcagcaggccgtcgatcgcgcctatggacgattggatgatctgcgagccgaaatgtggcaacgcctggacaccgtacgcgccgccggctcccacggatcccccacgcaacgcagcgaacgagactcctttgccacaatgtacgaaaaccgcctcacgcaattgcgcagcgttgaggatcggctggtgtttggccgcctcgatgccaagaacggcgaccgtcattacatcggccgcatcggcctgtcgagcccggaccatgagccgattctgaccgactggcgtgccgaagccgcacgtcctttctatgaggcgaccccttccaatcacggcgacatcgtgatgcgcaggcatatcaccttgagtttccgcgaagtcgtgggcgttgaggatgaggtgcttgacgtgcattcagaccaggtcggccaggcgtcttccgccggcacattgaccggcgagggtgcgctgctggcttcgttgagctcacgccgcaccggcaagatgaccgatatcgtggccaccattcaggccgagcaggaccgcatcatccgctccgacatgaatcgcgccgtggtggtgcagggcggccccggcaccggcaagacggccgtggcgctccatcgcgccgcctacctgctgtacacgcaccggcgcacgctggaacgttccggcgtgctggttgttggccccagctcggcgttcctgcactacatcgatcaggtgctaccctccttgggcgagaccggcgtggtctcacgcaccatcagcgatctgattcccggcatcaccgccacggcggtcgactccccttatgcagccaagctcaagggcgatcgacgcatgacctccgtagtggccaatgccatcgccgcacgcgtgcgtgttcccgctgctctgccgacagtaaccattagcggcattcaggtaccaatgctggccactgatatcgagcaggcgcaggcggacgcgaagcgcacccgacaacctcataacaaggcccgcgagacctttatccgttcgatgctgaccagcatgcagaaccgttatgccgaacagcttgattacacgccggatcaggcggagctgaaccgcgcgatgtcgctgctacgtatgaacgagcaggttcgcaagaccctgaacctgtgctggctgccgatgaccgccccatggctcatcgatcagctgttcgcccatcccgaacgtctgaagtctctggctggttggctgaccgacaacgacatcgcggcacttgcccgccccaaaggctccccgttgacccgctccgatattccgctgctcgacgaagcaatggatatgctgggccccgatcccaaggcggtggcccgccagtccgccgccgacgcacgtcgtgccgccgaagagcagtatgccaaagacactctggccgcgaccggtctgggtggaggcatcgtctccagtcagatgctgctcgaccagatgaacggggacgacgctgagctgaccgcgcagcgggccgcggccgaccgtgaatggacctacgggcacatcgtggtcgatgaagcgcaggaattgaccgccatggactggcgtatgttgatccgccgttgcccctcccgctcgttcaccatcgtgggcgatgtggcgcagacttcggcgctgggtggcacccgacgctggagcaaatcgatgaaccgcctgttcggcgaaagccactgggatttgaacgagttgaccatcaactaccgtaatccgcaggaagtttccgaacttgcctcacgatttgccgaggaggaaggcctctacatctccacggtcaatgcggtgcgcaccatccccgattcggtgtcccgcaatgtggtgcccgacatgtcgtccttgctggaaacgacggccgagcaggcggcgcagcttgccgaacaattcgtttcggcagacggcaccggccgcatcgccgtcatctgtccggataatctcatcgccccggtgcgcgatgccgtgcgccgcaaactggctgtcattcttgacccggccgaatacgcaaggctcatcgagcagcccgaatgggatgagcaaatcagcgtctgcggcactgaaacggtcaagggtctggagttcgatgccgtcgtggtggtcgagcccggtctcatcgaggatgacgcgccgagccgcctggtcgccgcctcggacctgtacgtggcaatgaccaggccgacccagaaactggttatagttcggacaaaagcggacgaaaagtccctgaacatctaaggtatgaagcatgcccaaagcactgttattggaaaacattcaccccgatgcggccaaatcgctgcgtgatcacggtttcgaagtcgagaccatgaagggagccctgagcgaggacgaactcatcgatgcgctggatggcgtggacttggtgggcgtacgctccaagaccaacgtcacagcccgcgtgctggatgcgcgtcctacgctaagcgccatcggctgcttctgcatcggcaccaatcaggtcgatctggcacatgccggcaagcgtggcatcgccgtgttcaacgctccctactccaacacccgttccgtggtggaattggtgatctgcgacatcatctgcttgatgcgccgcattcccgcacacacgcatcacatcaagcatggcctgtgggacaagtccgcttccggctcgcatgaagtgcgaggcaagaccctcggcatcatcggctacggcaacatcggctcccagctgtcggtactggccgaggccctcggcatgcgcgtggtgttctacgacattgaggagaaactggcactgggcaatgcccaccgttgcgacaccctcaacgaactgctggaacagtccgatgccgtgaccctgcacgtggatggccgcaagtcgaacaccggattcttcggcgaagaccaattcgcccacatgaagcaggacgcgattttcattaacctttcgcgcggtttcgtcgccgatctgggagctctgaagcagcacctcgattccggccatctgtctggcgcggcggtcgacgtgttccccgttgaaccgaagaagagcggagatccgttcgagacctcactggccaatgaagacaatatgattctgactcctcatattggcggctccaccttggaagctcaggaatccatcggccatttcgtctctcagcgtcttgaggattactggttcaagggttctacctccttgtccgtgaacctaccacagatcaacctcggtgagtgcaagggtgtgtgccgtatcgcccatctgcacgacaatcttcctggtgtgctggctcatgtcaatcatgtgctcggcgaggagaacatcaacgtttccttccagtcgctggcaaccgaaggcgaacttggctatgtggtcaccgacgtggctcagacgcccagcgccgccacgcttgaagcactgcgcaacatcgaaggcaccattcgcatgcgtgtcatcagctgacgcagctcatcctcgattgatatgaaagagacccgtcatcatgacgggtctctttcataagtgctgggcttcatgattggctcgcaccatggtttgcgaatcactcgcatatcacggtgcatggcattcgcatattattcacgcaaaccatcaatggcgctttggaaatcctccagacctgcaaagttctggtacacactcgcgaatcgaaggtacgccaccacatccaagtcacgcaacggtttcaggatggctttgcccacttcatctgaggtgacttcggcaaggcctcgggagcgaagatcctcttcgactttctgtcccagcagcttcagatcctcttctctgaccggccgcccctgacaagctttgcgtacgccggaaatcactttgtctctactgaatggctccacgccacccgaacgtttagtgaccagcagcatactggtttccaccgtggtaaaacgcttgctgcatttcgggcatacgcgacgccgacggatggaatgaccgtcatcgctaatgcgcgtatcaatgactttggtgtcggggttctggcaaaaaggacaatgcatgctccccagaataacgtgtacgggcggaaaaaccatgccgctcgggtttcatttactcaaccggaacaataatgcgctgcccggcctgcaatgatccggactcaagattgttcaacgcaatcagctcatccaccgtttccgatacatcatgaccagcaggcgtgatagccgaagcatatgaccagagcgtatcccccggccgcacgatataactggtcacctgcgtggcccccgtatccgattgggcccgctgagcggtaagcgcgccgaaaccacaccaggcctgtatttagtcaagtcggtgtttcgtgtttcgtcactaatttttttcggttttcggcatgaggagtgccggccggtggtttgttttactggttgtccgtcttgccgaacatgagggcctggctgacgcgtcggctggggccggtgaattcgatgaggcgtccgtggtggacgatgcggtcgatgatcgcggcggcgagtttgtcgtcggcgaagatcgtccccatttgctgaactcgatgttcgtggtgaagatgatgctgcgccgctcgtagctgccggcgatgatctggtagaggaggcgggccccgtcgatgtcgaagggcacgtagccgaactcgtcgaggatgatcaggtcggcacgggcgaggtctttgagcaggttgtcgagggcgccgtcgcgtttggccttgccgagctggagcacgagctccgcggtctgccggaacctcacgctcctgccttgctcgatggcgagcatgcccagggcggtggccaggtgggtcttgccgcgtcccgtcttgccgtagaacacgaggtcctgcgccttggccacgaaatcgaggccggtcagctgctccttggtgtatccgtcgggcaggcgcacgttcgcgaagtcgtagccgtcgaggcttttgggcaccgggaaccgggcctggcgcatgagccttgcccgtttggaggcctccctgttggccagttccgtggcgagcatgcggtcgatggcgtccagttggcggggcgtggcccattcgagcgtttcgtcgatggtggcctgcgagatgaacaggctcctcgcccgctcgcgcagcgggccggggtcggtccgtccgttcttctggttcactcgtcctccttggtgtaggcgatgtcgtattcgctcaggtccacggggtcgtcgtaggccacgggtcccaggcccgaggcgtggcgtgccgcggccagacataccccggcccggtccgtgcctccggtggattcgaggatctcgagcatgccggccacggccgcccgccagccgctctcgccgtcggcgtgcagcagggcacgcaggctgtcgcgccgcgtggcctcgtcctgcgcgtcgatccattcgcgaagcgggtcgggcatcgcgtcgcgcacccggctgttgcgccaggccgccggccggtcgcacaacagcccgagctggctcgacgggtcgccgctgtcggtcggcttgtccccgtaggacctcggatgcgtgatcacgcgtttgccttcggcatcgaggatctccacctccagggccctcaggccgacgatcatctcatggccggcgtgttcgggtccggccgcgtaccggtggcggccctggacggtgacgtttccgtatttgtcggccttcatcctcgtccacgtgaccacgtcgaacggcttggcgggcaggggcagcagcgccttgcgatcatcctcgaacaggccggcctggctctcgcccttcctgtaatggtccttgtcccccagctcgagacagcggtcgggaaggcgcaggttgaagttgtcgaggctccacacgctgggcaccggcacgaacagccttcggcgcacggccccgaccctggcctcgaccgcgcccttctcgtggcccgagtacgggttgcagaacgagtactcgaacccgtaatgggcctggaacgcctggaacaggcgggtcaggcggatctcgtcgaaccgtcggcggcccacgccggcggcattgtcgtacacgatgcgccggggcaccccgcccagccattcgaacaggttaagcaaagcctgacacgtgcattccgcgttctccccgggcatcagctggcacggcgagatgttcgagtacgggaaatccaacacgaaatgccgcatccgcgtcacgacgccccggtagcgcacgtcgacctggccgaagtccgcctggcattcgcccggatgccacgacaggtccaggaaacccatctcgcgctccgccatgaactcacgcttcaaccgggccaccgtccgggtcaccgtcgacaacgacgcctccaccccgtactcgtcacgcaaccgctcgtggatgcgcgtcgccgtgtgacgttgcttgtgccaggtctcccggtcctcggcgagcatgccctcgatcacgggaatccactcgtcgagcaccgagccacggcgtctccttaccggaggcctggccgacaggtcgtcggccttgagatacttgcgcacggtcggctcgctgaccttctcgccgcgcgcgatcgaggcgacggactccccattcctgcgcctctgacggatagactgtattttgggcatgctgatcatttgcctttccggccctttcccgaatggattcgaagcaccatcaggctaaggcccacgggtggtcggcatgcctttctgcctaaacccgaaaaaactacgtgactaaaacctcaactccctattgaacacatacaccaggccagcgccaaggcgaccatcactgcgataatcttcccacgcacattccggtggaacgttccagcatgctgcatagctacacgtgcgctacgggccggggccatcaccattgaaccagtcatcacgaccacctctctcgaacagatgttctatcgaacaactgttcttataatgacacaaacgttcgacacggtcaagtcgaaactcgaacagatgtttgatttcacacgaacaacacgttatgctggtgacataacgaaaggagccctgacgtgagcaccattcccttctccccaagcagaagccggacgagtccaccctgaccgaccgccagcgcaaagtgttggacgccattcgcacgcatatcgacgaacaaggcttcgctccctctttccgggaaatcggaaatgccgccgggctcaaaagtccgtcttcggtcaagcatcagctacaagttttggaagacaagggcttcatccgcatgaacgcgaacaagggtcgcgccatcgaggtggtggcaggatccgccccgaatgccgaaaagccctcccaagccagcgaagaggcaaccagcaccagtaatgtggcggagatataccaattccccgccgaagccattgccgaatcacacgatgtgccgctcgttggccgtattgccgccggcgtgccaattaccgccgaacagcatgtggacgacgtcatgcgtctgccggaacggctgaccggctccggcaccctgttcatgctggaagtccacggcgattccatggtggatgccgctatctgcgatggcgactatgtggtggtgcgcgaacagaattccgccgtcaacggagatatcgtcgccgctctgctggacgacgaggccacggtgaagaccttccgcaaggaaaacggccatgtctggctgatgccgcacaaccccgcatactcgcccatcgacggcacacatgccacgattatgggcaaggtggtcaccgtgctgcgcaaattgtagcctgttcgccaccagctgatcagcgtgcaccgaatcgcgctggtcgtgctatagtcacgcacagcttacgaaaccccggcctcgcgccggggtttcgtcgtattcagaccatatcgcaaatggaaatgagaagcggtttcaactcgatagagcgaaggagtacatatggctcatacccatgcacccgcaccatccacatccgtaaaccctgccgcgcaccagcgtaggctgattgccacgttgaccgtaaccggttcggtcttcctcatcgaagtggtgtcggctgtcttaaccggctcattggccctgctggtggatgccggtcatatgctcaccgacatgtccgtgctggcggcatccacaatcaccgccatactgatgcgccgcaagcccagcaacactcgtacttggggctgggccaggcttgaggtgctcaccgctgccgcaggtgccgtggtgctgctcgtcgttggcatctatgcgttgatggaggccggcatgcgtctgttcggcggttccaaagcggaaatcgacgatatcggcttgctgctgttcgtgggcattctgggtcttgccgcaaatatcatctcgattttcatccttgcctcgcagcgcgaagacaacatgaatatgaaggccgcgttcctcgaggtgatgaatgacgcacttggctcggtggccgtggtggcctctgccctggtaatgatctccaccggatggaatggcttcgacgccgtggccggtgccgtcatcgcactgatgatgattccgcgcgccatcaagttgctgcacaacgcggtcaaggtgctgctggaggaaacaccggatggacttgacctcgataaggtacgcgaacatctggaagacgtgccgcatgtgcttgccgtgcatgacctccacgccagcacggtgtccaccggcatgccgattctgatggcccacgtggtagttgacaaagacctcaccatggaagatgccgccacaatcctcacccaactgcaggattgcctgcgcgagcacttcccggtctcggtcccccacaccaccttccagctcgagcccgagggctatagctccccctcctccaacgaaatccacgaataaaaaatgctcccaacgggagcattcagcagggtataaaaaatcgctgtacgtgtgcgattttcgtgccgcacaagttgaaggcctacaaaggtaggtcgagtcttgtgcggtgcgaaaggcgctccgtacagcgattttttatcagaagccgaactgggcggcggtttccttcagcgtctcggcagagcgcttcagagcggcgagctccttgtcggagaccggggtgttgatggtgttgttgacgccctgacggttgaggagggtcggcacggacatgcagatgtcggagatgccgtggaagtccttgagcatggagctcacgggcaggatgcggttggtgtcgtgcaggacggcttcgatgatgtcgacgccggacatgccgatggcgtagttggtggcacccttaccgttgatgatcttgtaagcggcgttcttgacttcctggtggatctcctcgcgcttgtcggcgtcgagcggatcgtggccgggcagcggggtccagtcgcacatggggacgccaccgatggtggcggactcccacagcgggacttcggagtcgccgtgctcgccggcgatgtaggcgtgcacgttcttgacgttgacgccggtctgctgggcaatcaggaagcgcagacgagcggagtccaggttggtgccggaaccgaagatctggttctcgggcagaccggtgagcttctgagccacgtgggtagcgatgtcgaccgggttggtgatgagcatgtagatggcgttcggagccaccttgaccaggttcggcatgatggccttgaggatgttgacggtagcgccaacgagctcaagacgagactgacccggcttctgacgcggaccagcggtgatgacgaccatgtcggcgtcgcggcagatctcaggatcgtcggaaccgtcgatggacacggtcgggtagaagctggagccatgctgcatgtcgagcacttcggcttccacgcgctccttggcgatgtcttcaagcacgatctcgcgagcgatgccacgctgggcagcggcgaaggcgagggtggagccaacggcaccggcaccaataacagcaagcttcgtgggcttaacggtagtttccgccatgatggatgaacctctcttcaaaggcggtctgctgatgaatggcaggccttgtaactaacgtcttcactctataaacccgctaagacgttttgctaccagcacaccaccctgtttgataaccgtatggtaatgttttcaacggttgttagcgctcacgaatatactgtgatgtttatcacgttagtcaatggactgttcgaccacctgagcggcaagatgggcgtcaacgtccgcttcaagctgtatgccatcatcgcggtactccaccttgtctaccttgccgtattcgcgtacacgagagatcagggagccagcggtatacggcagcagagcgttgacatgcacatgcgggaccggcagcagactttcgaccgcggtacgcagctcgtccaatccctcaccggtataggcggagacgatgaacgcatctggctgcagcgcggcgagtcgttcacgagtcgcctcgtccgcctgatcggccttgttgaatacgagaatacgcggaatcgaggccgtgccttcgatgtccgccaacacgtcattgaccgcgtcgacctgagagaacgggtcagggtgggagccatcgaccacatgcaggatcacgtcggcctcggccacctcttccagggtggatttgaacgcctcgaccagctgggtgggcaggcggcgcacgaagccgaccgtgtccacgtaggcgtaagcgcgtccgtcgcgggttttggcgcggcgcacggccgtgtccaatgtggcgaacagcgcgttttccaccagttcggccgaaccggtcagacggttggtcaacgaggatttgccggcgttcgtgtagccgaccacggccactgtgggcaggccgaagcgacggcgtgaaccgcgcttgacctcacgtgccggggccatctcacgaatctgacggcgcagtctggcgatacgcgtgcgaattacacgacggtccatttcgattttggtctcgcccgggcctcgcgatccgatgcccgcatccgcgccggccgcgcgaccgccggcctgacgggacagcgaaccaccccaaccacgcagtcggggcagcatgtattcgagctgcgccaactccacctgcgccttaccttcacgcgaggtggcgtgctgggcgaagatgtccagaatcaccgcggtgcgatccaccaccttgactttggcggcgtcctccaatgcacggcgctgtgacggcggcaggtcgtcgtccacgataatcgtatcggcttcctcacgcgccacgatgccggcaatctccttggctttgccggaaccaacgtacgtggctgcatccggcttggagcgatgctgcagcaaaccatcgcataccaccgcaccggcggtttcggcgagcgccgccaactctctcaatgattcctcggccttggcttgcgtggtgacggcggacgaccagacgccgacgagcaccacacgttccagacgcaccttgcggtattcgacttcggtgacgtcctgcagctcgccgagaccggcgacatgcttgagctcgttgcgggcctcgcgctcctcccattcctggttggcgtcctcatgccagccggtcgcgcgctggctgtcgtcgagcaacacttcggactgctcggccagcacaccttcaggggtaacgtcgttgttgccgcggttgatgtcggtgtactgggtgttgtcggtcaagtgcgcctcgtttggttggaatggttcacgattcttctatggtcctttattatcatcacatgaggtgacatgctggcatagatcggcacgtaccggcataggccggctgatacaggtcggcatacgagagcggcgaatcccgcagaaatggagcgaccatggcagaacagtatttctctgcggaacccgcatcgaaggatgtgcgccgcacattgaacgtaacgttgcgcggccatgaggcgaccgctcaggtgtcgaacggcgtgttctccggctcgcgcgtggacctcggtacgtcggtattgctgaagcatgcgcccgagccgccgcttaccggcgattttctggatttgggctgcggctggggccctatcgccctgacattggcgtttgagtcgcccgaagcgaacgtgtgggcggtggatgtcaacgagcgcgcggtggacctgacccatgccaacgcacaggcgaacggccacacgaacattcatacggctcaggtggacgagtccagcactcccctgcctgccgagaaccagccggcgttctgcgagacggtgccgagcgacctcacgtttgatgtgatttggtcgaacccaccgatccgagtcggcaaggaagcgctgcatacattgcttatggcttggctgccgaagctcaaggtgggcggtgccgcctatctcgtagtgcagaagaatctcggttccgattcgctgatcccctggctggacgatgcgctcggcgaggggttcactgcgagcaaatacgcgagctccaagggcttccgtatcattgaagttcgtcatgaaatatgagtatcccgcagaacttcccgtatctgccgcgcgtgatgagatagccagcgcggtcaaacgttcccaagtcgttattgtgtccggccagaccggttcgggcaaaaccacacagctgccgaaaatcctgcttgagcttggccgtggcacgcacggcaagcagatcgtgcacacccagcctcgccgtatcgccgcacgcacggtggccgaacgtatcgcctcggagatgggcgtgaagctcggtgacgaggtcggctatcaggtgcgtttcaccgacgaaagctcgcccggcacacgattgagggtcgtgaccgacggtattctgctcgcccagatccagcgcgatccgaaactcacccgatacgatacgatcatcatcgacgaggcgcatgagcgcagtcttaacatcgactttctgctcggctatctgacggcactgctgcctcagcgccgcgatctgaagctcatcattacctccgcgaccatcgattcggtcaagttccaggagcatttcgagcacgccttgcatgagaaggtgccggtaatcgaggtttccggccgcaccttccccgtgcaggtggtctacgagccgcttggcaccgcgcccgcgttgatgcgcgaagtgccgggattcgcggtgggcgcccgccccggcgacgccgattacgacgagctggccagcgccatcgcggaatccgattccgaccggccccgcggccggtccggtgcctcctatgccgatgacggcatcaccgatatgcctaccgccgtggctcgagcctgcgccgagctggtgattcactcctcccacgagcgcggtccccgcgatattctggtcttcgcctccggcgagcgcgacatccacgagttcgaggccgcactgcggcatcattacggcccgcgcgccgacgacatgcgccggccggatgccatcgagatcatgccgctgttcgcgcgactgtccgccgccgaccagcataaggtgtttgaatcgcaccttcaccagcgcatcgtcattgccaccaatgtggctgagacctcgctgaccgtgcccggtatccggtatgtggtggaccccggttccgcccgtatctcccggtattcgaagaccgcaaaggttcagcgtctgccgatcgagccgatcagccaggccagtgccgaccagaggtccggccgatgcggccgtgtggccgacggcatcgcgatccgcctgtattcgcgtgaggattacgagacccgtccgcgcttcaccgagccggaaatcctgcgtacctcgctgggtgccgtggtactccacatgctgtcggtgggcgtggcccgcacggccgaggacgtcacgaacttcgggttcatcgatccgccggatatgaaggccgtgtcggacggtttcaatgagctcaccgagctcaaggccatcggccgcaagcgcggcgaggtgacgctcacccataccggtcgtcagctggcgcgcatccccatcgacgtgcgtctgggacgtatggttatcgaggccgcgaaaaccggttcgccgaatcttctggcccaggtgctcgtggtcgtggcgttcctgagcttgcaggacccacgtgaacgcccggacgacaagcgtgaggatgccgaccgcatccacaaccggtatgcggatgagacctccgacttcctgacggccctgaatatctgggaccgcgtgttccaagcagacggcgacccgagcaacaacgcgctgcgccgtatctgcaaaaccgagtatttcagctggctgaggatgcgccagtggaaagatctcgtctcccagctacgccagatgtgcaaggagctgaagttcaaggtcggcgacccgctgcccgcctcccgcccaggcttggagatccgccagctgccgttgaatcagcaggccgcgcattcgctgtgctgcgcgtgggatgcggacggcatccacaagtcgatgctcgccggattgctgtcgatgatgggcatgcaggtggtgcgcgagcccaaggcctccgatttcgcggggctgaccggtgcggcgcgcgcccgtgcgatgaaacgcgcccagaagcagtcgaagaacgattatcagggcgcacgcggcacccgtttcgccctgttccccgcttccgccgtggccaagaagaccccgtcatgggtgatgagcaccgaactggtggaaacctctcgcctgtgggcccgctattcggcggccatcgaccccgcgtgggccgaaccgttggccggccaattgacccgcaccacgtatgcggagccgcactggtcgggttcgcgtggctcggctgtggccaccgcgcgcgtgctgctgtatggtctgccgatcgtacaggaccgtgccgtgcagtggggacgcatcaatccacttgaggcgcgcgacttcctgattcgccagggtctggtcgagggcgatattcagcagcgtttcagttacgacgacttcgtgggcaaaaaccgcgacattctcgaggatgccgccgatgatgcgagccgcacccgccagctggcggataccgtgtccgacgaggatctgttcgacttctacaacgcggtcattcccaacgatgtgaccagcgtggccgatctggcgaaatggtggaagtccgagcatgaccgtcagccgaatctgcttgatttcgacccggccaaggtggagcgtctggcatccagcgattcggtgagtctggacgattaccccgaccattggcatacgaccggatcggacggccaacccatcgacctgcgtctgagctacgtgtacgatccggccgacccggccgacggcgtcaccgtgcatgtgccgttgaaggcgctctcgcgtatcacgcccgaccagttcacatggaatgtgccgggtctgttggatgagctgatcctgtcgatgatcaaggcgctgcccaagcagctgcgcgtccagttcgtgccggccccggatgccgcgcgtgcgattcgtgactggatcgacgagcattacccggatctgccgggctcgggctcgcagcagaagccgaatctgccgccggtggatgaggatggcacgaccgttggctggcccgatctggcacatgtgttcaccaaggcggccatcgccaccaagggtgcgcagattcatcccgaagtgttggggccggaactggtcgagcgtctttccccgtatctcagagtcacgttctcggtggagcagcaactgccggccggcaagcaccctcgtggacgccggcatgcgcgcggccccatcaaggtgctgggtgtgtccaaggatctgaaggcgctgcaacgcaagttcgccgcgcaggcggaggcgtcggcccgtcaaatggtcaagaagcaggccgatcaggctggagaacagggcaagctggtcagtcaggcgaacctgttgcataaggcgggtgccaccaccgagtcccgggccacgatgctctggcgtggcgcattggatgcgttgcgattgccggccgaacgcatttcgtcgcgctggctgggtaccgaggcgttgatgctggcttctgctccgtacaagtccaccaaggatctggtcgaagacctgcagctggccacggtcaaacggctgatgccgaatgtcgacaggctctcggacgatgaggcgttagccaatgcggtgctcgatgtgcgcgaagtgtacgaggacaccgtctatcaggtggcgcatgacgtgatcgccgtgctcaaggcttatgccgaggtcgacaaggccactggcggcaaggctgatctgccgatgctttcggtgttgcagtcgattcgcgaccatatcgccacgctcgtctaccccggattcatcgggcgcactcccccggatgcgctgaagtcgttgagccgatatttgagagccgatctgagccgactcaataaggcgaaaaccgataagaaccgtgatgtcaagtgggcttggcaggccgacgaggcccgtcaggtggttgataaggcgttggcccgtgccaaggcggagccggccggcccgaagcatgaggcattgatgaagcaggccgaacaggcccgttggatgcttgaagagttctacgtgtccctatgggcgcaggagcttggcaccaaggggccggcttcgctcaaccgtatcaagaaagcgctggcgtgaccggacggcaaacaagtcgccaggccacgcgccagcgcacgcgcaagccgtcatcacagcgtgggcaagtgcgcggatgcctcggcaatcggaacaggaaacgcaatcgtaggcacggtccgatcaatgctctgaagcgttcctggcgtaaggcgaactggccgacccgtatcaagatggtgctgattcccacggtggcggtggtcgttgtcgtagcgctggtggccgggctggttcgtttcacaaactggcgggcacaggttcgcgcagccgaggcggcacagctggaactgacgcgaacatacgatttcaatccgggcaatattatttcggatggtcagttcttcaacggttcggcgatgagtcaggccgaagtccaatcgtttttggacacacaaggtggctcgctggccgcgatgaccttcgacacatcgaacgagtcaggcgaaggcctgtgcgcggactatacaggcaccaaaggcgagtcggcggcggcaatcatcgaccagtcggcccgcgcctgcaaggtgagccagaaagtgctgctcaccgtgatgcagaaggagcagcatctggtcactgccgtcgatcccagcgactatcagcttatggcggcgatggggttgaactgtccggataccgccgactgcgatcccgcctatgccggattctttcggcaggtgtatggcgcggccaagcggtaccgttactatctcgagcacgaggaacagtacgggtatacggcgcacaatctcaactacatccaatatcatccgaacgcggcatgcggcggcgcacaagtgtatatcgagaacaaggcgaccgccctgctctacatctatacgccctaccagccgaacatcgccgcactggccgctggcaacggtaccggcgattcctgctccagttatggcaaccgcaacttcgcgcttatctacaccagctggttcggttcgccgcgaagctgataacggcagctgaccggtcttgtccgattggactcggccaacactgtcagcgttcgacgtatggacgcagcagggtcgtggcgccaaccgccagcagcgaggcgaaagccagcagacacaggcagacggcctgcacgcagtagatcggtcgaatgtgggtcaatggttccacgccatgacctttgtcggccagcttgccgccgtacaggttgctccacaggcaggcgcagccgtaaatcaccaagccgatgctgatatagcgttcgggcacgccgatttcgtcgcgcatgatcggcgaaagatacgtgtagaagacataggaggcggctgcgccgaagaccacatccgccacgccgagctggatgcggcggtcgaagaacaggcggaattgcctcaggaaaccgatcttcgccggatgcgagttgcgtggcagagacactgccatcgatgccatcagcacggcggtgagcaccgagaccaaggcaaaggtgacacgccaaccaaaggtatcggccacccaagtgccggccggtacgcgcggtgttcgcaggtgcgttcgtcatgggtgctctcttgagtgctctcgctcgtactacaagctgattcgtcggttatgtcaatcgttttttcgtatcaactcagcgacaacgttattcccacctctgcccactacccaccaccacgacacgccatagaaaaccccgccgatgaccaatcatcgacggggtttggcacatgtgcaacgcttgcgattacagcttcggcagatacttcttcagctcgtaaggcgtgacctgctggttgtactcctcccattcctggtgcttgttgtccaggaagtagccgaaggcgtgttcgccgagcacgtcggccacgaagtcggatttctccatgatcttcagcgcctcgtccagcgagcgcggcagcggctgaatgcccatagcctgacgttcgccgtcggtgagctcccacacgtcatcactggtaggctcgcccaactgcatctgcttatcgataccgtcgagaccggcggccagcagcaccgagtaggcaaggtatgggttggccaccgggtcgagcgcacggaactccatgcgcgcggagttgcccttgcccggcttgtactgcgggatacgcagcagcgcggaacggttgttgtggccccagcagatgtagcttggtgcctcgttaccgccccacaggcgcttgtacgagttgacgtactggtcggtgaccgcgcagatttcggccgcatggtacaggatgccggcggcgaactggcgggcggtcagggacatgttgaactcctgaccggcctcgtagaaggcgttggaatcgccttcgaacaggctcaggtgcgtgtgcatgccggaaccgggcgcgtcggccaggggcttgggcatgaagctggcgtgaatgccacgctccaaggaaatctccttgaccaccgtacggaatgtcatgatgttgtcggccatggtgagcgcgtccgcgtatcgcagatcgatctcgttctggcctggccccgcctcatggtgcgagtattccaccgagatgcccatttgctcgagcatgttcacggtggcacggcggaagtccatgcctgggctgcgcggcacgtggtcgaagtagccgccctcgtcgatcggggtcggggccttggaccagtcgtcctggctttcgaacaggtagaactcgatttccggatgcacgtagaacgtgaagcccttgtccttggctttggcgagcgtgcgcttcaacacgtgacgtggatcgccgagcgaaggctcgccgtccggggtcagaatgtcgcagaacatgcgggcggtaccttgcgggccaccgcgccacggcaggatctggaacgtcgagggatcgggttgaacgatcatatcgtcttcggacacgcgggtcatgccctcgatggcggaaccgtcgaagccgagaccctcctcaaacgcggcttccagttcggccggagcaatcgccacggacttcagtgttcccaacacgtccgtgaaccacagacgaataaagcgcacgtcgcgttcttcgaccgtgcgcagcgcaaactcctgctgtttatccatagtcgcctatcgttccataaccgtgttacgaagggcgttaacatctcactgttcgtcacctgcgagtcgcgagatttcatcaacatgccccggtccgcatgtcaggcatggttcaggcccatgccggcacggcactatggtagtgactatgagcgaagatcatctcaccccatccgccaatccgcccgtcgacgtgaccagctggacgcaggccaccgacccgcgcgaccgttcgcgcgccggcatcgccactcgtaccaaggcgccgctggacgcacatgccatatggaaggtcaaggagggccggcgtgaggcgatcagccttttggaggagcagtccgcgattcgcgtaccggatctgattccgctgcgttacaagcgtatgagcgccagccccttcaccttctaccggggcaccgtgctcatcatgaccaatgacctggcttccacgccagtcactggcattccggtgcagtgcgtgggcgacgcgcatatcggcaatttcggcattttccgctccccttccgcccgtctggtgttcgatatcaatgatttcgacgaaaccgctatcggcccgtgggaatgggatctgaaacgtctcgccgcctcggtggagatctgcggacgcgccaacaaaatcaaggagaaggaccgtcgcgccgccgtggtccagtgcgtacacacgtaccgcacacgcatgaagtggttctccgaaatggattaccttgacgcgtggtatgagcacctggacgtggaggagacgctcgaccgcttcgagaccaccggttccaaacgcagccgtgtgctgcgtgaggcggccatgaaggcgctgctgaaggataacgacgcggcggcggccaaactgtgccgttatgagagcggcaagctcaggttcaaatccaatccgcccgagctggtgccgatcaatcagctggatgattacgccgacttggatgcgttgcaggcacgtatagacacgctgttcgagagctaccggcattccctgtacgacgatcgccgttgggtgttcgatcatttgcgctatcaggatgcagcccgcaaggtggtgggcgtgggctcggtgggccagcgcgcgtggacgtcggtgtggatcgcgcgtgatatcgacgatccgatgatgattcagatgaaggaggccacgtattccgtgctcgagcattactgcggcgcgtcgccgtacgccacgcacggtgagcgcgtggttcaggggcagaagctgattcagaatacggccgatgtgctgttgggttggtcgagctttatggccgaggatggccgaccgcgcgactattacgtgcgccagttgtggaatggcaaggggtcgattgatatcgacaatctcaacgcttcgggattgagcgatctgtcacgcatgtgcgcatggtcgttggcgcacgcccacgcccgcaccggcgattcgattgcgatcgccaattacatgggtggcaccgacgaattcgatcaggccatcgcctcattcgccgtcagctacgccgaacagaatgatgaagactacgccgtcttcaaaaagctcctcaaatccggcgacctcccttgctgagccgttaagcggacagcccattgggctgtccgtaggaggggtctgagtgaagcgatagctgagcgaaggtagattaacagtctcgctaaggcgagtcctttgcctacttcgctacttcaagcgcttcctggagcgtgaacgcacgtgcatagagggacttgccgaggatggcagaatcaacaccaatttcagccagttccttgatggcgcgcaaatcgtccagcttggagataccaccggaagccgtgaccttggcgtcggtgcgttcagcgacttcactcagcaattgaatgttcgggccggacatcatgccgtccttagccacgtcggttaccacgtaacgcgagcagcccacggagtcaaggaacttcatggtctcaaacaggtcgccgccttcgcgcgtccagccgcgcgccgccagtgtgtgaccgcgcacatccagaccaacagccacgcggtcgccgtacttcttgatgaccgaggcggtccaatccggattctccaaagcggcggtgccgatgttcactcgggcggcaccggcctcaagggccgcgtccaacgaagcgtcatcgcgcacgccgccggacagttcgatgttcacgcggtcgccgagctcatgaacgatttctcgcagctgatcgcgattgttgcccgtaccgaaagcggcatcaaggtcgaccaggtgaatccattcggcaccggcctcaacccaagtacgggcggcctcgaacggcgaaccgtaatcggtttcggaaccggattcgccttggcgcaggcgcacggccttgccatcgcgtacatcgacggcgggcagcagagtcaacgacataagaagagcctttcttcagttacttatacacaatttgagctccctcgtcagagggagcttcatgcttttttacagcgtggcgatccagttcttgaggagctgggagccagcgtccccggacttttccgggtggaattgcgtggcggacagcgggccgtgttcgtaggcggccacaaagcgcgatcggccgtacgagcaccagctcacgcgttcgggcgaatcgctcagatcgatgtcgaagcgggacgtatccgccggcttcacttccatcgcggcgtaggagtgcacgaagtagaaccgttcgttctccacgccgttgagcagcaccgaatcggggacggcctcgatcgtgtcccatcccatgtgaggcaccacgtcggcgtccagcaggttcaccgaaccgccgatcagtccgatgcctgcggcatgggcaccgtgctccagaccgtgttcgaacatgatctgctcgcccacgcacacgccgagcaccgggcggccagcgcggatgcgatcatagatcacacggtcgccgtcgaccttcttcagtccttccatacatgcggcgaacgcacccacgcccggcacgactaggccgtcggcctccaacgactgccggtagtcggaggtgagggtggtgtcgacgccaagattggcgagcgcacgcaccatggaacgtacattgccgaaaccgtaatcgaaaacaaccgctgtggtcatctgctctcctatcccctactggtttggttggcgtctattcgatgcgggagccgcgcccgccacgtccgcgcctagtgtggttggcgagaatctgcatcgcctgatcatggtcgagtccagcggaatccaccacttcgaacccttgggtcttgagttggttcagggttacgatgccgagcatcaggtcctcgacgaagcgcggtgtggaggtgaacagcacgggcggcgcgaaactctggccggcctctccctgcacgtacatggccacttcgagcttgtcggcacggttgactgcaagaatcacggccatgccggataccacggtggtcaggtccttggctgcggcttccgggccgtcgccgttcagattcttcagcaccgcgacggccccctgattggcaccgatgcatgcggcggagatgtccgacagctggcagaacgcggccaacagttcggcggaggcaagacgggtaacgatcagcgccaccttcgccttgttacccaacagtccagcgagttcgttgtcgaagccgagcgaggggtcgaccacgtcggccatggcctcgttcaccgcatccgcaacggacccggtgacgtcgtcggtcataggctggccggaatcagcggaagccttatcagccgtatcatcattcgcgtcggaatcggacttcgctgaagcagcgtccgctgttttatcggcatcactggtatcactgacatcgccggataccgaatcgtccgcgaattctttctcgaatccggcgagcgcagcctcaagctcctcgtcggagaagtgcgattcgtccggatcgaacttgtcgtcggtcatcacagggctcccttggtgctgggcacgccgtctacacgcgggtcgatttccacggcgaagcgcagcgcacgggccagcgccttgaattcggcttcagcgatgtggtgcgggtcgcggccggcgagcacctgcatgtgcaggcagatgccggcgtggaaggcgatggattccatgacgtggcggaccagcgagccggtgaaatggccgccgatcatgcagaattcgtagccttcgggctcgccgctgcacacgcagtacgggcggccggaaatgtcgaccacggccttggccagcgcctcgtcgagcggcacggtggcgtcggcgaagcggcggatgcctttcttgtcgccgagagcctgcttcagagcttcgccgaacacgatggccgtatcttccacagtgtggtgcacgtcgatgtcggtgtcaccgtgggcgtggatggtcaggtcgatcagcgaatgcttgccgagcgcggtcatcatatggttgtagaacggcacggatgtatcgatatcggttttgccggtgccgtcgaggttcagttcgaggtcgatgtgtgattcgctggtttcgcggacgatgtgcgcggttcttgccatcatgtctcctgtgtgattcgtcatattggattgcggcgggactcgaatcgcttcgggtctcgccgcaatcggaaagaaatgtcccttatgctgcttccactatacgaagcacttcaacaagggcgttacggaaggtttccatctcctcgtcggtgcccatgcacacgcgcagccaaccgtccggtccgaccacacggatgagtacgccgcgcttcaggagctcgtcgaagatggcttcacgcttgtcgaagtgcccgccgaacagcaggaagttcgagccggattcggccacttcaagcggctggtccttgtaggtctgttccttgagccatgcggcggtggcctcgcgggtttcgcgcaggtgctcgacacggctcagctgctcgtcggtgtgttcgaaggcggccagtgcggcggcctgagtcacggcggacaggtggtacggcatacgtacgatacgcacgcagtcgatgatgcccttggacgcggccaggtagccgactcgcgcaccggcgaaggcgaaggccttgctcatggtgcggctgacggccaagttcgggtggtccttgatcaggctcacggcgctcggggtgccgggcttgcggaattccacgtacgcttcgtcgatgacgagaatcgggtgcacgccctcgcccgcgccgaccacttcagcggtttcgcaggcggcgagaatacgttcgatatcctccatcggcaacggggtgccggtcgggttgtttgggctagtgagcagcaccatcgagggcttgacctcggcgatggcctcaagtaccttgtcgacgttcagcgtgaagtcggcgttgcggtgggcgagcttccaaccggtgaaggtgtcgcgggcgtactccgggtacatggagtacgtcgggtcggcaccgagtgcggtgcggcccgggccaccgaaagcctggaacagctggagcatgatctcgttggagccgttggcaccccacagctcgtccacgtccagacgggtaccggattcgcgggccaggtaatcggagaatgcctgacgcaattcgatgtgctcacggtccgggtatcggttgagtgtgggggcgatttcacgcacacgcttggcgatggtgtcgcatacggccgggtccggcgcatacgggttctcgttgacgttcaggcacaccggcacgtccagctggggagcgccgtacggctcctcaccgatcaggtcgttgcgcagcggcaggtttgcaggaatcgagctcatcgcagaccggcttccttctcctgctcgcgcagggtggccttgtcatacggatccttgacgaagcgggagagcacgcactcgccgtgggcgggcaggtcctcggataccgcgaaggcgttgatgcgggcggcgagggccttgaggccttcctcgtcgtattcgatgacttcgaccggcttcatgaaggtgtgcacgccgaggcctgcggcgaagcgggcggtgccgccggtgggcagcacgtggttggagccggacatgtagtcgcccagcggcaccggggagtacggaccgcggaagatggcaccggcgttcttgatgcgcttgacgaccgcatcggcatccttggtctgaatctcaaggtgttcggcggcgtaggcgttggccgcgtcgatggactggtcgagaccgccggtcagcacgatggcagactgggtgccggacagcgacgtgtggacacgctcggcgtgctcggtacgcggcacgcggtacttgaggctctcctgcaccttgtcggcaatctcggtggagtcggtgaacagcacggaaccggcgagctcatcgtgctcggcctggccgatgaggtcggcggccagcaggctcgggttggcggtttcgtcggcgatgatgccgatttcggtggggccggcaaccgcgtcaatgcccacgaatgcggagaccagcgacttggcggtggccacgaagatgttgcccgggccggtgatcttgtcaaccggatcgcacaggatgtcgccgtcctgcggctcgctgcccttggcgccgtatgcgaacatggcaatggcctgagcgccgccgaccgcgtatacctcgtcaacaccgaggatggcgcaggtggcgaggatggtcttgttcggcaggccttcctcattgtcgcgggcgggcggggtggcgatggccagcgattcgacgccggcggcctgggccggcacagcgttcatgatgacggagctcgggtagacggccttgccgccgggcacatacaggccgacgcgctgaatcggaatccagcgttcggccacgcgggcgccttcggcgaggtcggtgtagaagtccttcggcacctggttggcggccacggcgcgggcgcggcgcaccgattcctcgatggcggcgcgcacttcggggtcgagcgtggtcagggcgtccttgatcgcctcgaccggcacgcgcaggttcttgggacgcacgtgatcgaacttctcctcgaagtcgcgcagggcagcggcgccgcgttctttgacatcgtccagaatcggacgcaccaaatcggtggcttcggaagtacccattgcagcacgcggcatcgcggcaagcagttcggcacgggacaggttctgaccacgcaggtcaatgattcgcatgatgttctcactcataacgccccatcgtagcaatgtgcgaggcctaagcggcgaggaacgcccatgttcacccgtatcgtgagattatcgtgcgtgatgtgggttcgtgatacaggttattgacgcacgccaaatgcccgagcggtctcatcgataatcggcatgtcatgcacggcgacgtgactcacttcggaccatcgcgggccaatggctaattgctcaaccaaggcttgcactgcgtcgctgctgccttgtgcttccagctcaaccgagccatcgcggcaattacgcacccagccccgtacaccaagccgacgtgcctgagtcaccgtaaaataacggaatcccacgccttgcaccagtccggtgaccactatatgtttgcggaccaaattcgccgattgcctcatgatgctcagttcctaatccatcgttcgcagcattgggtagaggctcaggaatcgccggtatgcgtcggcatatgtgcgtgcggtgtcaggattcggctggtatacagtgcattcgcatactgattgcagcaggtctggtacattgaataccaacgaggccattgccactgctggcagaatatcggcattggcgaacacttcaataggatgctccaacacatcggccagaatctggcaccacgcattttctctggctccgccgccaatcagggaaatctcggtgggtttggcgtcaaaactttccataccttgacgaatggagaaggccacaccctcaagcgcggcacgcatcatgtctgccttggcggtgtctggatcgaggcccacataggcaccgcgaatattcggattcataacagggaatcgctcccccaccagatatggcaggcatagcacaccgttggagccgggtttggatgtttcgataagacgatgcgcctctacgtaatcgccatcggagaatacgccggtaacccatttatgcacgtcaccggcgttgaggaatggcacggcattcacgaagccttcttccacgccaaatgccagattcgcagcacctggcttgtcagtgaacggctcgggcgaaacggtggcgatccagcctgaggtgccgatattgatgttgtattgaccagggtggctgacaccgctggcaagtgtggtggcacccgcgtctccaatgcccgcgtataccgcagttccggcggaaaaaccggtgcgttgtgcagcggattccgtcactgtgccaatgttgtcttgcggattgtgcaggtgtggcaatatggtcatgtcgattcctgcgacctcgcataattcggcattccactggccattacggatattcatggccccagctgtggaacacgccgccacatcgcccacgcattcgccagttaattgggcgatcaagtagtccttggaactgatcaatacatgacgaatgcgcgcgtacgtttccggctcgtgttcacgcagccacatcaacttgggcaacggcaagcagccttcgagccggttaccaacggtgttcaggaaacgttctgcaccgccctgatatgtctcggcgagttgcttggcctgttcctcggctcggccatccgaatacagaatggcattgcggacgggattgagctcgccgttcaaagcaataacatcctgcatctgaccgctgaaaatgatgccacgaatgcgagtcacattgaattctgactcggattgccgcgcctgctcaatcatgtgcctggaggccgagcagaaagcttgccaccattgatcggggctctgctcccgatagtcgccgttgataataaggtcaagttcgctactcgcactagctacaatgcaaccctgcccattaactaaggcacccttcaacgccgtggtccccgcatcaaatgcagccacatattccgtagtcatatcgttcatcgtagcgctgaaaaaaaaagaatcattctttgccagcaaaacgcggcttattgcatcgtcttgtttctagaatgggaaattgaacgaatactacgactagtgaggcattatggcaattcaatcgacaatcatgctgaacaacggcactgtcatcccgcaggtgggcttgggcgtattccagacaccggatggtgatactacagtgaacgcggtgcagacggctctggagaatggctaccgccatatcgataccgcaatgatttaccacaacgaggcttcagtgggtgaaggtattcgccgtgctggtgtgccgcgcagcgatttcttcttgaccaccaagctgtggaatgacgatattcgcgcacgccgcggcaaggatgcattccaagaaagcctcgaccgcttgggcgtggattatgtggatctgtatctgattcactggccggcagacggctggcagcaggcatgggacgacttgcaggagatttatgcctccggccgcgccaaggccattggcgtcagcaacttccaaaagcatcatatcgatgagctactgacccatagcgatgtggtgcctgctgtagaccaggttgagtcttccccacaattcaccaatcaagagcttattggccagctgcgtgccaagggcattcacactgaagcttggagtccgctcggcggcaccggcggtaacctactcagcaacccagtactggccggaatcggtgccaagtacggcaggtctgctgcacaggtagtgattcgttggcacatccagcgcggcatcgtcgtgcttcccaagtccactcatgccgagcgcatcaagcagaacttcgaggtcttcgacttcaacctatcggtcgatgatatgaccgccatctccgccatcaacaccggcaagcgcaacggtgctgatccggacaatttcaatttctagacctttatcggtccagatacgcaaagagggaactctccgtcattggagggttccctcttctatatgctttcgattcggccacaccctaggtgcgagagcctatgtcttgtcggtgtcttgtcttgttggtttcgggtatgcgaaagccccttggggcgtgtgctccaaggggcttcctgtacgtgtggtgcggcggcgtgctactctcccacaccctgtcgggtgcagtaccatcgccgtgccaggccttagcttccgggttcggaatgggaccgggcgtctcacctgggccatggccgccgcaaatcttctcttatacggtcagacgctggggtctgccggcctgtggcggcctgggaaccggacagcggacgcggatatgtcgatgtttcgtcttgtggccagacaatgctcattgccgtctggtgtcgtttgcaggaggaagatgcggtccaaccgccaggggttggaatgttagtgttgcctttcgtccgttagtaccggtcggctccacccctcgcggggcttccacgtccggcctatcgaccacgtgttctgcatggggactacaggaactcgaaggttccacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcagcattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatgactgttcgaggttagacatccaatgcgaacagagcggtatttcaccttacggctccgcgcgatctggcgaccgcgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctcccacagcaagtgtgttcaccatcgggggtctcccttaaaccgaaggaacgggagtgatttgccgagttccttgaccaggattcgctcgatcgctttggtattctctacctgaccaccagtgtcggtttggggtacgggcggctttgagcctgacgccgaagcttttctcggcagccgggatcaccggatatcgggccataaggcccccatcatcgcacctcggacccatgcgggacggatttgcctgtcccacgccctgcgtgcttgaccacggaagaccacctccgcggccggctacccttctgcgtcactcctgcgctgacctactacaaggatcggtcccaacaggccagggcatcccgcccccgaaggagcagtaagcccggacccggaggttagtactccaagcctcggttttggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctctcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaagggtggctgcttctgagccaacctcctggctgtctatgcgactccacatcctttcccacttagcacacgcttcgggaccttagacgacggtctgggctgtttccctttcgacgacgaagcttatcccccgccgactcactgccgggatacgcgtcaccggtattcggagtttggttgctgttggtacccgatacgggcccgcaagcatccagtagctctacccccgggacgtaatgacccgacgctgcacccaaatgcatttcggagagaaccagctatcacggaatttgattggcctttcacccctagccccaagtcatcccccggttttcaacccaggtgggttcggtcctccacgcggtcttacccgcgcttcaacctgctcagggctagatcatcccgcttcgggtccaggacacgcgactcaaacgccttttaagactcgccttcgctacgcataccccacacgggttatgctcgccacatgccactgactcgcagactcatttttcgataggcacgccgtcaccccacaaaagggctccgacggattgtaggcgcacggtttcagagactgtttcactcccctcccggggtacttttcacctttccctcacggtactcgttcgctatcggtcagacaggaatattcaggcttacccaacggtctgggcggattcgcacggggttccacgggacccgtgctacttgggagacgcgatcggcagaccatgcgcgttcaggtacggggccctcaccctctgcggcccggtattcaacccggttcccctgacacatggttttctgcaactgccggccggcccgtcggagccggcgcacgcgatcccgcaacaccccgcgcgcaacccccgacgggtatcacacgcgcaaggtttggccatcatccgctttcgctcgccactactcacggaatatcctttcctgcaggtactgagatgtttcacttccctgcgtacccccggccgaagccggtaccgacccatgacggtcggtgggttcccccattcggaaatcctcggatcaaagccctgttggcggctccccgaggcatatcgcagcctcaaacgtccttcatcggtcctgtctgccaaggcatccaccatacgcccttgcaagcaacacacaccacgaaagtgcatggccgcaagattcctctagcaaattcccagacgacaaatcatcacactaaaaatgatcacaaaacgatcgaaacgaacaatagagttcgattcgaaatcaacagcaaaacaaagattcaaaaactcttgttttgctcgcgtccactatccagttctcaagccaccacgcaccgccacgccatcgcgccggcacacggccggcccccaggcacgacgggcatcgaatcgcgccaggcaaaaagcctggggtggcgatccgggagcccaaaagcgcatccataccaccccggcacccaccgcacgaccggcagggcaaagccaacgacgtcttccacaccagcaaccccgccgccatcgcaccatgcgacgcgcggggcgcacaccgtcggacgaacatccgactgaattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcataatccgctggcaacacggggcgagggttgcgctcgttgcgggacttaacccaacatctcacgacacgagctgacgacgaccatgcaccacctgtgaacccgccccgaagggaagccgtatctctacgaccgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactctcgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggaacatccggcattaccacccgtttccaggagctattccggtgtatggggcaggtcggtcacgcattactcacccgttcgccactctcaccaccaagcaagcttgatggatcccgttcgacttgcatgtgttaagcacgccgccagcgttcatcctgagccagaatcgaaccctccacaaaaaaacttcatgaaaagcatccgaatagatgactctcaaaacaaaaaattgacgagcacgtccttaaggaaggacgccctcaaaaaacctcacccctcatcaaaccctcccgggtacccaaccaccacgacaggcaatcaggcgaggaatgaactggcaatcattgactataaagaagtagtacaaacacgctcttgagttctcaaaccaccaccactcacccacctcgcagctccccggaggagaaccactcgctgagcggcagcaaggaaataacttacacgcattcacggactcgcgcaaaccgggcacgaaaaaacacgccagaatcgttgcaacgacagcgttccatcggcgtgtcgaaatcagcttgaatcacgccgttaccatcaggatacgccggctttttatggggctcacgtaacgaaatcagatgttcaccggcgtgtcgcaacaatttattccacgttcaactcccctcagtccgatcacgcggacggctcacccgcaaaaagctctcgtccttatggctcgactatcgtctcgccttcgtctaaaaaaacagtccaccggactgtttttttagacgcctcagcatcaaagaggggagccaaagggggattagaaggtcaggcgcatctgatgccagaccacgtcaccgtgagtggactccgaaatgccctcgtcctcatacccaaattgcgcatagaatccgaccagccgatctttgcaggtgagcaccaggcctttacgtccagctgcacgagtgtcttcaatgactttcctcatgagtgtactggcgcaaccgcgatgctgatacttcggcgcagtatccacgccgaaaatcatttgccagtcaccttgagggttgtgctgcgcggcatcctcgtacatgtcatcggtcaagtcacgccgatcggtcgcgaaaccgttgatgaacgccatgacgatctcgccatcaatcaatagccagaaacattccggataggtctcgattcgggcgcgcagggacgagcggtcggcggcctcggcggccgggaagcattcggattccatggcggccagcgcgtccagatcgtcgatggtggcgtggcggattaactggggatcagaatcagtcatgtttttgtccttctcttaacactccgttgtgagcaactctcctcaatcacgcttcgcgtgctggctcccctcaccttgaggggagccagatggatgtcagattacgcggtattcgcgtaacagggtggcaatatcggtgccgtcgagtttcttgagcaccttcttgaccacggccttttcaatgaagttgagcttcatatcggtgaccggtgcaccgtcacgcaatttgacggtggcgttgagcaggttgcgcacgtcatagacgctaccccacacttcaggcacgccgcggtccacgccgagcaacgtgtagacagcttccataccggtgcgcatcgagtattcggtggtgaaaatcgtgtcgcgcggggtctcggcgaactggccaaggaatgcgaagttcacggcaccatcgggcaccacgtccgggcggtcgccggccgcgcgcggcatgaagaacgcggtgatgtacggcatcatgaccggcacggtgttggcgtggtgctttgcgagcgcctcgatcttgtcggtcggcacgcccatgtggtaaagccactcctcgcaaatctcttcaccggtgcattcggtcatcggcttcttcacatagttgccgggcttgtccgggaacaggccgtagacccatacgcacagctggtccttgggctggtcgcggaactgctgctggcggttcagggtccaactcatgagccagttggagtcctgcacggtgacgatgccgccggtgacgaccttgccggagaacgggtcgcgcttgcagatcttctggatgtacggcggaatctcgccgtccagggtggtgacggtggcgctcatccacttggtggcattcggatcggagcagaacttctccggatggccaaagctcgggtcctggtcggcgatacgcttccacatatcccagccgccaccgggcttcaggtctgggttccatgcggcgggcgagttctgggaacccatggtggagttctccacgcaaccgccgttggtgatgaacaccagatcgttctcggtcaggtcgatggaggatttatcaccctcgtgatccacgtcgatgcgcacggcaagcttcttggtgggcgtgctggcagggttgcgcttgaagaagccggaggtggcctgaatcttctggatggtgtcttggcctacgccggtgtgctcgcgcttggggccggctcccccgccaatcgcgaattccacgttctcgaccttggtgttgtagcggaattcgacgccgtgcgattccagatacttgaccatcggcagaatcatcgactcgtactggttgtagcgggtgaaacgcagcgcggaaaagtccggcaggcctccgatgtgatgaatgtagcgcttgatgtacagcttcatttccagcgcggagtgccagttttcgaaggcgaacatggtgcgccagtacagccagaagttggagttcagcacctcatcatcgaagaaatcggtgatcggcttgtcatacaggtcttcgtccggggtgaagaacagcttcatgatttccatcgaagccttgtcggacagcccgaacttgcccttgagccccgcgtccttgccgagattcttggtggcgcggcacagcgagtagttcgggtcctccttgttgagccagtagtactcgtcgagtacgctgacgccttcggtttcgatggagggaatcgagcggaacagatcccacatgacctcgaaatgattgtccatttcgcggccgccacgcatcacatagccaaggccgggaatatcaagaccgtcacaggcgccgccgggtaccgggtccttctcaaggatgtggatgttctcgccaggcatctgaccatcacgcaccagataacaggctgcagacaatgccgccagtccggtaccgatgatgtatgcatgcttgttgtccacgtcggccggcttcttcggacgtgcgaaagcctcataattgccgctgctgtagtacatattccgcctccttggggcagagttgacacttcatcaactcttcttgaatagacatcatgtcgcattattgacgaacgcgccataggcaacgttcggcgttctgccgcattcgccaataccttgcatctacggttttcgaggcctatgttggctgttggctcataactattgaaggcatacaggcatactgaggatgcggggtgcttcaccgaaccggatgattgataaggtcccgctcaatccatgccatgaccaaatcggcaagtcggtttacctccgcttcggcgagttcacggcctttgggcagatgatgccatttttcgatgcatccgcggcagcatgtggcggtagcatgctgagcggtgaataccggatggccgcgccatggcgtctgcctgccgtcgttcttcggttcggctgcgcctatgcggtctcgcaacatttctcgcgcatgacgatcgatggtcgccttgcctttggtgcgggcataggctcggtctttgtcggtcaaagcgaatttggcgcggaactgcgaatgagacagccgttccagcatcgtggcaatccattgttgctcgtcatcgttgttaccagtatccgccatctccatgcccatacgttccacagtagtcgcgcacatcgtatggtggcacacgccttagctccctctgatgaaggagcccccagcaaagccaggtgagggagaggccaggggcgaaacccgccaatcaggcggcaggcaagcagctggggccaaacagaatcttgatctcagcaaacaacgaagtatctcgcttgacgcggaaacgatcgccaaacgtgagcacctgagcgttacccttctcatccagcaccgcaagatgtacttcgcagtaaccaggatgattagcgagcacctgaccgagttgcatcatgcgttggcgctccaacgccaccggcggcagcgtgatgaccaacggacgttcatcctcggcttccaaggtcggaatctgcatttccgtggctctcagagaaacggtttcgtcgcgcaactccacttggccacgaatctgtacgatggcgtccacggcaagttcggcggcggccgcttcatagaccttgccgaagaacatgcattggatggagctttccatgtcttcgatggtcacgatggcccaggggttgcccttcttggatacgcgccggtccacattggtgaccaaaccagccaacgtgacctgctgtccttcacccatcgttttggctcgatcaaccagatgcgcgatggacatttcacgcaaggacgcgagaatcgactgcataccggagagcggatggtcagacacatacaggcccaacatttcgcgttcgaagttaagtttggtcttcttgtcccattcctcaagatcgggtacggtcacggaagcgtcgcccatggcctccgctcccccatcctcggcatcggagaacaaatcgaactggccctccgcctgtttgcgcttcagactcaccaccgaatcgatggcggcctcgtgcacggtgagcagcgcgcgacggttcgggtcaatcgagtcgaaggcaccggccttgatcaacgattcgaccaatcgccggttcagcgcggtcaggggcacgcggcggatgaagtccatgaagttcacgaacttgccgcgcgggccttcgcgttcggcgatgatatcggccacggccttgtcacccacgttacggatggcaccaagaccgaatcggacgacgtcgccgactgccgagtactcgtacaccgattcgttgacgtccggcgagagcacctggatgcccatgcggcgggcctcgcccaagtacagtgcggtcttgtctttgttggtggcggcaccttgcaacagggcggccatgaactcgaccgggtagtgcgtcttcagatatgcggtccagtaggagatcagaccgtatgcggcggagtgcgctttgttgaaagcgtagccggagaacggcaccagaatatcccacacggcctgggatgcctcttcggaatatccgtgctccttcataccggcgaagaacggcaccttctccttggccagcacttcgggcttcttcttacccatggctcgacgcagcacgtctgccttgcccagtgaataaccggcgaggattcgggcggcggactgcacctgctcctggtagatgatcagaccataggtctcgtcaagcacctgcttcagaggctcctcaagctcagggtgaattggcgtgatcttctgcaggccgtttttgcgcttggcatagttggtgtgcgaatccatactcatcgggcccggtcggtacagggcgataagtgcggaaatatcgttgaagttatcgggcttcagggttttcagcagtgaacgcatgccgtcggaatcgagctggaacacgccgagcgtgtctcctcgggacatgagtttgtaggtttcggcgtcatcgagcggaatcttggtgtagtcgatggcgggtttgccgttggcctcgatgttcttcagggtgtcgtggatgatcgtcaagttggacaggccaaggaagtccatcttgaccagccccaacgtttcgcacgtgtggtattcgaaggtggtggtgatggtgccatcggtgcgttccagcaacggcgaggtgtcggtgatgggtgcgctacccatgatggtggcgcaggcatgtacaccggtctgtcggatcaggccttcgatacccttggcttcctcggtgatgcgcttggtgtccgggtcggaatcgtagagttctcggaattccctggcctcggcataacgtttggcggcagggtcgaagatgtcatgcaggctgatgtctttgccgccggtggccgccggaggcagcgccttggtgattttttcaccgactgagaattcataacccatgatgcgggcggagtctttcagggcctgcttggttttgatggtgccatagatcacgcactgggcgaccttatcggtgccgtatttttcgccgcagtattcgatgactcgcgcacgaccttcagggtcgaagtcgacatcgatatcaggaaggctcactcgctcagggttcaggaacctctcgaaaatcaggccatgcttgagcggatcgagctcggtaatgcccatggaataggcgaccatggcgcctgcggccgaaccacggcccggccccaccataatgccgtggtccttggcccactgaatgtagtcggcgaccacgaggaagtatccgcagaactgcatctggcagatcacaccacattcgtagtcggcctgcttcaatacgtcgagcggcgggttgccgtcgtaacgcttctccagaccttcctcgacttttttgaggaacagggaggtctcatcccagccttcggggcaagggaatttcggcatgaacgcgccgtcttcgtggtcgtcgaacatcacgttgcagcgttcggcgataacgagcgtattgtcgcaggcgtccgggtggtccttgaacagttcgcgcatctcttcggcggttttgatgtagtagccggtgccgtcgaacttgaatcggtccggatcgtcaagacgggaaccggagttgatgcagagcatggcgtcctgcgcctgtgcatcttcggcgtgtacgtagtgggaatcgttggtggccagcagtggtgcgttgagtttcttggcgatggtcagcaggtcaccggtcacctgagtttcgatgggcagaccgtgatccatgagttcgatgaagaagttgtctttgccgaagatgtcctggaattcgccggcggcgcgcagggcctcctcgaattgaccgaggcgcagacgagtctggatgatgcccgaagggcatccggaggaggcgatcacacctttggaataggtggcgagcacctccttatccatacgcgggtagcgcatgacgcgaccttcgaggttggccacggacgaggctttgatgaggttgaccaggccttcgtcgttttcggcccacatggtcaagtgggtgataagaccaccaccggagacgtcgtcgcggcgctgggcttcggtgccccagtgcacacgggacttgtcttgacgcgcggtttccggggtcacgtaagcttcgatgccgatgatgggcttgacgccattggccacgcagttggtgtacatctcgtaggcgccatgcatgttgccatggtcggtgataccgaccgcaggcatgccaagttcggccgcacgcttggccaaatcaggaatcttcgacgcaccatcgagcagcgaatagtgcgtatggttatgcagttgcacaaagttgttcccgtaatcagccatgcgctccaccataccgtgtggtctgggcgggaaatatttatcgatacgtactataaggcgctattgctgtttttgtgggtggtggttcgtcgttgagccgttgagggagtaagtggagagcgctttccgggtaggatgttttcgaccaagataaacaaacaaccgcaaagcgcctgatgaacagcatattcaaccagctcctcaacgtcaaaggcgtggtggtcgagaccgtgcggatcgtcgattcgcccctgcgccccgagcccgtgctcgaggttcgtgtgcgcccgcgcaggggcatgctccgatgctcaccgctgtggcagacgtcgtcatggttacgaccaaggtggcggcgtgcgtcgttggcgtcatcgggatttcggctgctggcgggtcgaactggtcgccatgatgccgcgcgtggactgtcccgggtgcggggtcgtggtcgcgtccgtgccgtgggcggaaccgggcagccggttcacgcgcgacttcgagtccgagtgcgcgtggctgatgagcgaccaagccaagacggaattgaaccattgggtgttctgggcgtcccacaaccgtatccccgagatagtcgaactcgcgaggaggatcaggagacggcgcccggacatcctcaggaccatccaactcggctactccaacgccaggctcgaggcgtccgacaaccgcatcaaggtcaccatccgcatggcctacggcttccaccacgtcaccaacctcatagcactcgtcatgctccgttgcggcggactcgacgtccgactcccacaacccgcaatctaacccacgaaaacagcagaagcctcaaaagtaatgagtaaatatgatagtctggtcaagtatatatgtatccttgacggagatagttttggctcttgggttattgaccgtgaaaacgatggaacgctcgaacatccaattcagatgccatatgtaagctactctgatatggtgcatcattttatcgatgatatatatgattttatcgaccataacaaggacatggagctgaaccgttacggtgacattctgaatcagaatggccttaaatggggaagcaagtctatgagcaccgcagatgtatcgaatctggatgcacagtgcatcatggcattgatcaccggagctgtccgggcagaacgattctgtgatggtgctttgcttggatttttcaaagatggcagtatccggaaatggctggagcgactgaaagaacttgataatggcagcggaaccgaggtgagataaaggcatggctgaaattaagagcgtaaatgaactgttgagcatgaatctgaatattccggactatcaaaggccgtacaagtgggatattcaaaacatcgacgatttattcctagacatcaccaatgcaattagtgatgcggacagatacagaactgagttcaaataccgtatcggaacgatcatcctgcacagaacaaagaatgacacctacgatgtggtggatgggcagcagagaatcatttctctggtgcttctaaagcaatgccttgaaccgggatttgagtgttcgattctccagatagatttcaccaacaaggtgagccagttcaacattcacaggaactatgcgtttatcagagagtggttctccctaaagagcgaagatgtaaaacgggactttatccatgcctttgagcatattttagaggtcgtcgttgtttgcgtagacaaagtaaccgaagcgttccagcttttcgattcacaaaatacaagaggtaaggcattagacccgcatgaccttctgaaagcgtaccacctccgtgaaatgaaaaagtatccctatgaaatggaacacgctgttacaaaatgggaagcaaaggatactgagaagatcaaagagctgtttgatctatatttgtttccaatcttgaattggagccgaggcattaaaagcaaaccgttcatagccaaggaaatcgacacctataaaggtatcgcagaaagctcaacctattcttacgcacgacgggcaagccgagctatgccgtatttccagattaccgagccatttatttccggcaacgacttctttgaaatggtcgagcattatatgtatctgctccaggatattaagtcggagatctgcaacaatccccgtttcaaggagattaagctggttatctgcggcggcaaggatgtagaaacaccggaagaaatggacaaagtaaagttcggctctgccggtttcggatacacgaagaatctgttttattgtgcgctgctttgctattacgacaagttccataacttcgatgaaatggcagtcaagaagctattttcctgggcgtttatgctccgtgtagatatgaagaccctggggtttgacagcgtaaacaagtacgctatcggtgacgaaaattccagatatacaaacacaatcggtattttctccaagatcagctttgcccggatgcaccacgaaatatccggattgcagataaaggtacggagaggaccggacagcccatccaatagatggatagacttgttgtatgacacgatcaaagaaatcaatggatatggaggtgcggaatgagcaaattagtaactgaacttcatattattggtgaaaacggcaatatgttcgacacagatatggagtacataatccctctataccagagagcctatgcgtgggaggacaagcaactcacccagctgattgaggatattaacgatgttgcggaggactccaattactacattggctccttgatcgtttccaagcagttcggacgatatgaagtagtggatggccagcagcggcttacctcgctgtatttgctgctgaactgccttggaatcaaaacaaagcccacactcacatttgcgtgtagagaaaaatcgaactataccctaagaaacattgaagaactactgctcgaaaaccgcagcaagatcgatatggatcggattgaaccgggaatccaaaggggcatcaggatactatctcacgaattgacaaaggatcatttcgacagggaaagctttatggaaaagctggctaaaattatcgtctatcggattgaggttccggagaataccgatctgaaccgctattatgagataatgaacaccagaggtgagcaattagagcaacacgacattctaaaggccacgcttatgagctatttgagtgatgattctgagaagggcttgtttgcgaagatatgggatgcttgtagcgatatgaccggctatgtgcagatgcacttcatcagcaagaacaatgcggtaagagaggctattttcggctccgaatggaacagtatgccgcctaacagctggcagaaatacaaaaaggctataagtggaacgacacaggaaaccaccggacataaaatctgtgacctgatcgaaaagaacttcaaggttgaagatgatgaaggctatgtggatggtgatgtgcgtgttcgctttgaaagtgttattgagtttccatacttcctgctgcatacgctgaaggtctatgtgagtctttacggtgtcacccatgaaatagcaacttcaaaaatcgtggatgaactcttggatgataagaagctccttgatgcgttcaacagagttgtatcctgcggcataacggataccggcaggatcgcagacagcaaagaagattttgccagagggtttattatttgcctgctcagaaccagatacctgttcgataagtacatcataaagagagagtacgcaaatgacagcgctgatggcgaatggagcttgaagagcctgtatgtttccggacagcaatcgaagaagaaagcatattacgggaactccgagttcacccgttccggcgaatggacatgtacaaatgattggcgaaccaagaccaatattatgatgcagtccgccttgcgtgtttcctacacttccccaaaggtaatgcactggattaccaaactcttgatatggctttcggaagctgattgcaagaatatcaaaaatgatgccattacaaagtttgataaagttgccgaaaacatcgctattgatgcagtaagggaaaacttctttcaggtttgttcgaacggcgtgtatgcgatgggtgtcaatactccgcatattgtctttaactacctggattacttgctgtggaatgacgaccggaacggaaagaagaagaaatacagcgactttgtttttgaatttagaaattccgtagagcattggtatccgcagaatccatctgagggaacattcgagcaatggaaggatggtgttgaccagtttggaaatctctgtatcattcagagaaatgtgaactccaaattttctaatatgtctccggaagcaaagaaaagtacatttaaggatatgatagtcaaggggagtattaaacttcgcattatgagtgaactgacagaaaaaaacggcgacaaaccagccagcctttactggaaggaaagggcgtacaaggcgcatgaagaagaaatgcttggccatttgaaaaaagcttgcaacattgagtaagcaaagaagccatagcgacaactccaggcgagagagtgacagctatggcttttctttacacttcagcgttgaaatgccaaaccttggcgggtatttctctgttgttgccgctgatcttaatgtggtcggtatagatgttcaatttccaatggttgtactcattggcgttgtatcttttacattcctgagttagatatgatttcagaacctcccactttaccatgaggatgttcctactcttcaagcggagcacaacaagggctttatcggtttcgctcagaacatgggcttgttcttctgtaatatcaacccaataaaaaccttgcggatgcatcttcgactgaggggtgaagaatgtgatggtttcgccattctgttttctccctctaaacaagattttgaggcttctgctgttttcctgagttctaaatagaagcgcaacacctaaacctcaactccctattgaacacatacacggatccgccgctacctgcccaagaggaccagtctcgacggcctgacggacgccgacctgcaggccatcgtccaggagatcaacgacacccccatgaaggtcccggactgggaaacacccaacgaggcttggtaccgcgagctcggcaagctaatgtcgaggacaagccacccaaagacgagcattgcacttacaaattgaatccgggccagccactcgccaacaacgtatcggtccattatatgtcagcaacattctgaactatcatgaaccatcaagtacaactaactactgagaaaatccaatcttgcgagaggaaattatgcggcggtgatgctatttctgatcatcgtgcgccattgaacgcggctaataggagaaacagtctggaattgtaaagacctcaggatcgtaagggcctctctgtccagggtcaacaaactacaaattctgcgatcctgtatcatacaatcaaagttaattcgttctaaaccataatgatcgaacaatctctgtaacaaaccgccccaccggctaagcatctctatcaggttgctcggcgacgccatattccacacagtcatatatcttttatccgaatacagaggtatgcactgtgaagctctgactatttccgccttctttatgcccgtttctttggaggcatccgctatatgccaaacatatgcgtatggcggatcatgcaggatacatcggattagctccaacatatcataaaggcgtttcttggaccctttatcgcattccagagccgcgctagcgaacccagatctttcaccaccttcacaatgtataatccgaagctcatgtctttcggtatccactttgggccagctccgattggctttcatcaaaaggtttagaccgtcaataatctcattgatacagaactcagacacatccttcgtcaaatcactgagcactcgtatatgaatatcgcaatccgtcttctccgtgaatatatgattcacccaacgcgcgccagttatcttatactcagagaaacgaagcatacaatcatctatatttcttcgtgcactactcaactgagcgagcatctttaattcatctaatccaatgcggcaatgagtgcttccacaactaaattgtattgtcgatatcccatatttaggaaatacataacacaagcggtcagaccaagattgaaagcgagcgaaagtgccaggaggcaatgacctagcaccaacgtcacctccaacttcaagaggacagcagccaacccctctcccattctcatcctgcagatcaagaccattactctcatttagatagctttgaaacgcatagcacaaagacatcaaaatggcgatggccgcacggtcataagcagattgaaaatcagcagtcgcctttccgttcacatcggcctgcaacacgcagcaatcagcaacatattcattcgcgctgtcagaaggacgaagattaaactgacatagggccacaccaaaatgctccatatatgtcaggtgctcaaaatacttctctattgcaacaccgatttcgccataaagcgttcgcgcaagctcaatgggaattcttttaccttcatcccggattacgttcatggtcacggacacggctaatcaactccttcattaggcaatcagcagctgcagaatcaaacactgtccgagcatcgaccgaatccgattactgtgacctctccgcccgaatcaatttggccatcgaacatcatgccccaaacaatcatggcatcaggttgaacgcaggcacgtatctcatccacagcacgcgttactttctggagtttttcatgagccgaacaagcgaaagagatgcagacggcgttcatcatcttcaacgaatcatttgagaatgatgccattgcgcgcttcgcggcctcaactattccatccgtaccttctgcttggccagcgccggaccaagccagatcgttgccgcccatcgccgctttgatatcggaccaatcaacatgtatgtacgaagaattcatatcagatatatcatccaatacccgaaaaccagcgtttaactttttcgccatctgcaactcttgcttgtccattttgactccttatcgagagctatcaatactcctcacaatatgcacgacaagcaatcaacagtagatatctaccggaatattgaagatgaacaagctactaacgtttagctgaaaacgagtcagttaccgaggccccggcattgatcacgaaatgtgaataatcctgtgtccaatgagccctacaagccatcgccgtactacagcatatccagaatagcgatgttctagggcctcggcgtagagagcttgttgttgagcgtattcggtgcggagacgctgagaccagtctttgactgtttcacccgggcgcattttgtcggttttgtagtcgaagagggtgatggtcttggcggttggatcaaggaaatagccgtctatgatacctcggaccacgattgtgtcgtcacattgctcagcaacgttgccgctgtcattcttcgtgttgggcacgccaccagccatgccgctaccgttcaccttggcattaagccggttacgttcaatcaacatcgagaatggctcttcccggaacagagtatcccgatgagctcgtatttgcgccgatagcgggcaattttctccagtgacaaaccagagcaagccttccagctcgcgagtcagcacaatatgagccacttgcggcgtgatgacatgattcgcttccagacggtcaacaatgtttctcagctcggcttcgcactgctcacggaacggctcagtaccccaatcaaagagttccagtacattgtggaccgcagtacccacctccgaagcagatggctcaacgtcggataccttcttcataaagtcaggaataaagaacccactatgcgcttcccgcctttgcttccaatcatctagattgtcttccagcatggcaattggcgcagccgcgtcatcagacggcaatacagccagcgaatcagtgtcatcagatatagattccgcatcatcaatcatccagctgcgagccttggaggaactcactaccactggcatgcgcggaggctcatcaggcaatcgcaaaccagtcacatcaatacgtttattgatatagccatacccgtccgttcgctcattcatagtggtcgtcggctcaggcgcagcactgcagaatcgaatcgtaatggccctgcccgtcgccgccatagccggcgctgtttcctgtagtcccgcagcaagattccacgcacggacctcattagggcgaagaatcgcagacgaatcatcatccgcatctccagacgccagcaatgatcctagaatccaatagagataattggggctaccactattcttgaccaccgttcgtggatctatggtgcgtccatcgccgcttagcgcgatgccttgagccatcgtacgcaaattcagattgccatcatcgttctttcctggacggtacgatcccgcgataatcaacttgcgttcggcacgagtcatcgccacatagagcaaacgaagttcctctgccgcctccaactccttggcccgcgaatcaatcactgcgcgctggaaagtatccactcgaacatggttacgttggtcaaccaacgataaggcaccttcgccatattcggcaacagccccatcctcattccttgtctgatgagcaatcgtgcgaacgacagcggttctcgatccggtcagcagattattgctggcacccatgagtatcacgacgggccattgcaatcccttggatttatgaatcgtcatgatatgcacggcgtttttggtaggcactgttgaagcttcttcaccggagccactcgcggaccacattgttacggcatcaaggaatggttgcaatccacgctcctgagctacagcaaatgcatcagccttttctacaagcaagcgcaggttcgcctgccgtcgctcaccttcaggcatattgcctgcgaaatcgaacaagccagaaacggcatagagatgccacaacgaatcagacagagagtgaactcgcgcataatcgcatgcggcatcatagattcgcaggaatgccgatatctttgcaagcaacacatcagaagaaagaacagccgattcatcagcttctcccccactctcagcaatccgccgcataacgtcaaatagccagcctctgttatgcagacgaatccgcgccaaatcatcatccgtgaaccccatagtccgtagcaccgcaaccaacggcacatcctgatgacgattggcgataatacgcaaccaatccaaggcgatctgtatctccggctgacgatacaggtctccaacgccctgtacttcgactggaatgccgacacgatatagtcggtcagccaggtcggcaaaatgagtagcgccacgagccagcaccgcgatatccccatatgaatactgcgcgcgaggcccctcgcagagctcctggacacggcgcactatcatgtccacctgtaattcgtccttgccggcgcgaactgtcggtgcagtgtcagtgccgttttcatcagccacaacatcagcactcaagtcaggtgccgcgttactcaccaacaattcaatggcttctgcatcgaatggtttaccggcttgctttgccgagccgatttgcaactgttccttcaggtaatcggtcgcacccatattcggcgtcatcagtcgggcaaataccgtattcacaaaagtgatgatttccggcaccgatcgatagttcacccacaattcccggcgatggctcgcatccgtaacactattgcagatatcgccgaactcctccggcgaggcatcacggaacccataaatgctttgcttcacatcaccgaccatggtaagtttggctgcatttcggctgatttcgcgaatgaatcgattctgcagggcgttattatcctggcattcatccacataaatatatcgccactgagcaccgatacgcttggccacgtcaggctgctgcatggcatccaatgcccagaaagccacatcactgaactccgctacggactcctgctgtttcacaagcgcatactgctggtcgaacgtggtgatgagcgcaatcaatccttcgagtcttcgcgcagcgacctcatcaagcgagtccacttgttcagcggtaaaggccagtttcgattgcaaatcagaaacgatccctttaatgccccgcaccgtttccgccaagcgacggcccagttcactgtctttgggtacggcgattgccgtactcttaagaatggcagttttgccgacagtaatgcgcttgggcagtacgtccaatggattggcatcgataacacgagcacgaactgcattccatgattcgctacgcaagtactgaggcaaatcgcatatcatccgcaatgatttgactaccgtatcttgctgcgcggtgtgcgcatcgtggcagctggcgagcgcctcatcaagacacgatcgcaattcggcaagaggatgttctgccatatcaatccagcctcgaaaataacggtccaaatattcattgccgtattcaccaccaacgacctgattcagcgacgcaatgttgaaccggtatggttcggcgagccggctaagccaaccgatgcggttgggcttggtgagtgccttgtcatacaggctcatcatggtggcgcgcaagtcaccatcatgccggggcccttgcatgttgtccaacacatccatgaaccgcgcgtgcattgagttgcgctcgtcataccacgattcgaataacgcgtcgagtgtttggcctctcagccggttcttcatggcatcatcagcaagaatctggaatcctggagccaccggcaatgtatcggcattgcgatccacgattcttttggagagcgcatcaatagtgctgatttgcacggttggcagatcgttcaaggcaacggagaatacggtttgcgcatggtggcaatcgtgcagaatcgtacgcgccagttcgctgtcgtctccacctaattgatagtccgtatccaagagcacgagtgaacccggctggcatccatgattgcgccgcgcatacagaatggcgtactgcaggttctgttccaagcgccggcgaatttctgcggctgcggcaacggtgaaagtaataattaacgattcgcggatggatgaatgcgcttcgtctgcattacggttcagcaagtccagcagaatatcctgcaagagttgagtggttttgccggtgcctgcggatgcgctgatgacgtaaggcatggtgtttgtcggaaaatcgtccgagagattatccgcatcttccgacctaggtaatgcatcaacatgttctaccatgccttgcctccttcagatgtattattcatatgaagagccgcttctttgagctccagcaatgtcactgctgtctccacctcgaatatgttgctattcaacacatcccacgccatgatgtcggccacatcgctgtaggcaagaccatcacggccgtcaaccaaagaacgataagggcgcaccggcagtttgccgtccaatatgttctggcaggcacccactattttcccgtgcacataatccgctatgccacgaaattcttccgcactcagttgttcgataccgatgccggtttcgtcggattctcctataagcacgccactgttcggcatatcaaagcctcgccatacgtttctgatgcgcatgttctgagcacttgaatcgtcacttggctcatcgaacagactcgttgatccatcgtctgcgctcggcaacatgttgtattggttattcagcgcgatgcgttctcgaatggttgcgctgggtttaatcgggagaaagaacatgcctgctactggcattccggagttgtgctgggcggcagaagcatacgtaaacagctgaagttcatggccgtagtacacatttgaagcgcggccgccatcattgcgagacggtttgccgaacaacgtacgggcagaagacttatagtccagcacaacaatgccggcgctctctcgcgaaatattggtatcgcgaattaccgtatcaatgcggtcgaccttgccattgatacgcaatgcaaccgggatttccttgtccctcgccctaccgattaattgttcccctgaatatggcgactgccatgcaccggtcgttcctccaacgttgccaaatacttgctctacacacgtaggcgtaagcatcgtctgtgcggacgataatgcctcacgttgcgcagcagcatcgacggcaaaatccatcagcgtatcgaccagctgacgatgaatcatacgcatacgattactggaccgcagcacctccatacgcgggtcttcgttcagcaccgtccactgattgcagcctcgatccagtctggaatagtcggcgataagctcttgcatgtctgttgcagtgggctgaggtggtaagccgttcaaatctcgttcgttcttgtgtcgctcgatccaggcattgaccgcatgttccagcactgcatgatagaacgtgccttcaagcgcggcatcaaaagcgaacgcatttgccacgttaactttcaatccgtatttcaggaaatactcatacggattgcgatagtacgtttctattgccgaaaccgatgcattgaacacacgagtcgagatcgaaggatctgcaccatgagtgcgataaacgcgatgcacataatccggcctagtgaacaaccgatatgccagttcgcggtcaaggggacgatactctgtttcaacggtcggcacagcgcgtttgctcgctccgatgatttcgctcgtatccgatgtacccgtctcccattggctgatatatggcgagcatgcttgtgcagcgttacgcagactctttggataggtcatagacaactgctgcgttgcgctggcaacaacaccgttaaaccatagcggttcttgcccggacctacgttccaccgtaccggaaagtacattccacgcttccaaagttttgccttgggaagtcaggaactgtgacaaatccagccgctcgccgtcatcgagcagaccggtctcatgcggaatcgcaggcaattgagattcactgcaacccagaacaatcacatatctgtatggatgtaaaggcgatgacatcggcaatacgtccacggcgctggcggagaccggacgcgaatcgattgactgcgcggcgagcgtcgaagctagatttctagcaaagattcctacatattcagcaaaataatcgttaccgagctgttgaaccatgtcgtcaaacgcattcatgatgacggtccaaactggcgcggatccttcaatggtttgggcgtattcggtaagaaaaccaaccatcccgcctagagcctcccgcacggttgcgctaggccgcggccgaaacacatcagcggcttgctgaatcagcgaacgaatcttctgcaaatgtgcagcgaacggtatgtctgtatcgatccataccgttgccggattgttggagttcagctgattttcaatgtcatcgattgccgttggagtcaagttcagataccggctgaagataccggaacgcagtatgcgcaggatggactggggttgaagttcgtaggtcgcggaatcaagcagtcccagaatcgcatcagcgaacggatggtcaagcatcgtactggacgcggcaatattaatcggtatcccctgatacgtgaattccgatgcaatttgggcttgatatgaaccaaggtctcgtgaggtgaccagcacatcaccgtatgaaatttctggattgtccgcgatgaacttcttgatggacgctgccgcatagcgcacttcggcagtagtatccggcatcgcacacactgatgtagaagcggatgaagcgaaaatactggacagcgtatttcggtttccatcatcgcgtctctgcaatgcttccagataatccggatcagaaccggcaccaaccatcaccgtcagatgcacgtattgcgcaagtgtatgaactatcctcatctccgaagcgttgaggtgtgcgaaaccgtacagatagaaccagcgattactcccatgccgctgtgcccatgcacatatggtttcatgggcggctccggggaatgtataccgtttacctaaccgttgctccaccagttgcagcaaagagccaagcaccgaaagtcgagcattcgactgatgagcggccagagcaagcacctcttcagcactgaccccatcattatgcaattcaacaatttgcttggtgaactggtcaatagcctcaaacgagtcaccaacctgattacgcaacgattcattatcattcagacacttcgctacgtaatttctcagcgacatcatgctgattgatgggcgaatgtaccttccataatcctggttgccgataatcgagctcatcatgcttgccagagaatggacacccacattcatccccggttccagacgttcgcggaattccggtcggaccatcgactgcagtacttgcttttccacatatgcgcgcaagcttgccggtgtcagaataacgaatcgcccacggcaactatccggaaaatctgcttccgtacatccggcaccatcagaaaggacatgatcaatcagggcatgaatgtcatcacaccctcgctcgggccgtatcaccatgacactcataccttaccctccccagtgagttgtatctgttctcagcatataactgacgcaacaaatatccgggacttcgcgcatgacactttgcactcttacgcaagcctagtgatttcgtagtatcacattgccgtctaagcacacacatattgttcaatcgcacgtcctattggccatttgaaagactcacactggagctgttgccgagtggtttgatcccaatccgaaccattagggacgacttcatctgtactcttttgcgcacaaggacttgcatccattacatcctgcaataaatcaccctgtccatgggattgtgctgctctgtattgcctttccgcctcgataaggtcattgccacattgggcaagagccttcctgcaggggttgacgcaatcaaaagcaccggctctaatgaggtaattgacattccctgcattgcaatgttccaatgaaacacgacgtataaaatcattaaaactgcgataggcactgcctttattacgggttgaaacgatttcttctgccaattgttccgaaatgccccgtatcgcattaaaaccgagctgaattccatatgccgatttctcatcgtcaccggtactggaatacgctgtcgcataatattgagattgattaatgtttggcattcttacatgaatacctaaacagtacatttcttcaaatatactttccagtttcgctctagcgccatcctcgttataactattcaacattgcggtcatgaattcgattgtgtataacgttttcacataggcgacacggtatgcgaacattgcacgagcaacagcatctgcgcggtcggcacctctgctatggcatatgtcaattagctccgcaaaagaggtaagcttctgctgcatcagttcgctcttcattccatccaagaatggaataccggccgtatagcccgcggacagtaagtcatacacacggctctcatccaacgaactgcaagaatcgtcccatacttgcggcacattgcaatccggtatgaatcgaagggcatcctgcaccacctgcaaaactctcgaacctgcaatacggagacgaggaagcccaagttcatcacagccttttgcatcaaacgcggtgctttctgcccccgaaggaaaacgaacaatggacgttacttcggcaaggggcttgttgcaaagagccaacacatcactgcgaacggaacagtcatatatacagtctttcaacccatccgcaatagacttcttggcgttatcctgcaaccaaacctcagccgaggatgcatcccagaaccgttgatatccgcatacatgcgacacatctttcactgccttggcatcgttaaaacggctgtatgcaattacagcagctgcataaccattcccatatcggtcacatagatattgcaatacccgcctggacagtccccgttccgtttgcaaaacagctgtaggaaagactgaatcttgaaaatcagtaaagggtaaatcgtattcgatgggatcaatctcactaatccccagcgcataggcgacaaggctgcgagccaatatccccttcccgggcccgaccaaatgcccctcttctcgcaatcgattcgtacaatatgcgacggccatcaagtattcttcagcatgggtttcacgaatcacagccatttcgtgttgagcacgattccacactgaatccggtatgcttccatacttcgtttgcagccatccttcaacttccccttgaagaatttcactcgacgctcggccatcagcaccaacatgctgcggcattaatgagccatcttccgctacacaaaatccggtatcgcaccgctctgctatgagcaacgtattgtcgcaggcttcaggcacatcggagaacagagaccgcataaccgcagatgaacgcaaataatactcctcgctttcaaacttgaaacgatgaggaccatccatcacatcacctgtttcaatgcatatacgcacatcatgttttagactgtcatcacgctttgcataatgcacatcactagttgcgactaacggcgcattaattcgtttcgccagttccactagatcattcctgatttggtgctcaatggacaaaccatgatccatgatttctataaagaaattatctcgaccgaaaatatcctgtagttcaccggccattcgcaacgcttcatcaaattgtccaagcaacaatcttgtcggaatggctccagacatgcagcccgacccacaaataagtccttttgcaaatgatgacaagacattgttatccatgcgaggataacgcgagaccagaccttcgagattcgccacggaagatgctttcatgagattgacaagaccttcatcggactctgcccatagcgtcaagtgagtaaacagcccaccaccgctgacatcataaggatcatgaggcacacaagtaacacttcttcgagtattcctctctttccacgaattatcccaagatacgcatctcgtatccgtgcggccagtttctggcgttacgtatgcttcaacacccaaaatcggcttaatgcctcgctgacgtcctgctttccagaactccatcaaaccgccgacactgccgtgatcagtcagaccaattgctggctgacctaatcgttgcgcttcactcatcagctcgctcacagtagagacaccatctgccagcgaatagtcactatgtacatgcaaattaacgaaatcccgcataagagcaccgcctccatagtcatggttgcttcgaattcgaatcggctgcatgttcagtttcctgccgcgctacaatcaacggtaattatctactggttcttgaagcagtctcgatactcagcgagaggaacatgatggccgtctcatcgcaacaagcaacaccttccactgcgcagattgtcatcgagattctcgaactgctggatgcgcatacagaccgcgagcacgggattactgccactgagatcagcaagcgcatcagcgtttcggaaaagaccgtacgagggcatctcaaggcgttgcgtgacatgcaaccattcggccgtcgggtggagcatctggagcgtcgagacctgctctctgctgaaagcgctgatccaaagccgggatggtacattgaaccggtgtttgatacggcccagatgcgtctgcttgcggacggcgcggtaatatcacggtctgacagcgaatatctgagcgaccttatcgccaaaatctatacgttcgcgggcaagtcgggccaattgcgcggtctgaggcagctcactacgccaaagaattacaacaccgagtttctcaacaatatcgaaatgctcaacgatgccatcgaacacgaacgagtaattcgattccgttactgcacctatgacattgatggcaatctggttcctcgccgcgacaatgcgggtgaaatcaaagaataccaagccgatccgtaccatctgatgtacaagaacaacaaatactatctgatttgccacatgcatcagcatgacagtctctcgtatctgcacgtagaacgtttccgcaacctttacgtcgaggagactgatcatgcgctcaatcgctcactggatagcttcagtccgattccgggaacgccgttcaacatcgaagagcatatggacgaacgcccttaccccatggacggcgcagcagtaccgattcacctgcgtattaccggcacgctggagcccttgtacgactggttcgacaacgccaaggtcactcaaatcagcgccaacgaatacgacgtgcatatcatggccaacgaattagcgaccttgtggtgggcattgcaatatgccgattcgcgcctcattgaagtccttgaaccacaatccttacgcattatgctgcgagatactggcgaatctttgctagaaaagtatcgagactagctagtcccgctatattctcaccaacgctcagctcttttgtcgacactcggcaatgagggcggcacagagcaaaatgacctgggcgacgaggttgaaccaaatgagcacgccgatcaacgcggcgaacggggcaagcatcggattccgggaggctccggctaatagtcgcgcaccgagaagctgcattgcggaaaccgtcagagatcccagtaacgcgccgagtatcgtgaatcgtccggctttgatgtgggagaccacgcgcagcagcaacatgaacaacgcgaaattcagcgcgacgccggtaccgaaaccggtcatctccaaaagcacggtgccgggcaacgaactgctggggatgccgccccattgcagcagtcggcgtacgatgccgccggacaccgtaccggccgcggtcgaaagaatgaacagtattgcgatggcgatggcggcaagcgtatcgcgtaaccttgcgacgacgatattgagctcgtcgccgcagtcgtcgaacatggcccgtacggcgtggcgcagcgagttcatccagccggtcactgtccaccagaatatggccaacgtggccagaccggtccacgtcaatgcgcttgacatggcgcctagcgcggaagacgtcagaaacgagtcggccacaccgggaatgacttcacgcaccgcgtcaatcagcatctgctgccaatcaatgttgccgaccatgataaggccgaacacgctcaccgcaatccagacgccggcaaaaaaggcgaacagcagaccatatgccagaccattcgccagcagggggccgctccgcgacacataccggtcgagcacgcgcccaggcagcgaacgtgcccacgcgtccgctcccctgtcaatcgcactcttcaacccatgcatagttcaactgtagctgttgccaccgttgttgaaacagcatggcgcgaaatcgcatttagccagctcaaacgatggcaaccatcaacgcccccactcaattgttcagaatcggataccatatgagtattcaattcatccgtcggagtgcaatgtcagcagtcctcaccaactgatgtcttgctaacccgctggccgccctagtatctactgtttcttgtggtcttcgttcaacagccagtcaagcgcgtatatctgtcggatgccttcgtgggagtagggccgttcgtcatccagcgtaatcagcgtcttgggatagttgtcacgcacggcgcgcagcgaggacggctcccgatccagcgtcgccgaatcgtgcaccgattcgctgacctggtagtaccgacgtccgcctggcccgttcgtgacgaagtcgatctcgctgccggagctctgtccgacatatacgtcgccctcgcggcgcatcagttcgaggaacaccacgttctcgaggaggcgtccgatgtcccgcacgttgttggagcacaggatacgtcgcatccccaagtccacggcatagtacttcttttcctgcttgagaatcctcttgcccttgatgtcgtatcggtgggccgggtagaggatgaacgcgtcgtaggccgcgatcgtcgtcggaacgggcacggtcaacgactaggaaacggtttttatcagcaggagattctgcaatccggatggcatataccgcccggcttcattactgctttggctcatttctgttcacttcacgctggagtaccgagacacgttgagcggaaataccggtaattcacgtacggttaccgaccattggcctgaatggtactcagcatcagcagtcacttggggtatggtcatgacggagagccatcatgaccgatctctcgttattctgggatgaatccggcgaagccggaactgaatctaaatattaaaacgcatgatgcacacgtcgcggaattagtccaccagaacttcggcatattcggcaggttcagcgggttcgatgtgtcgggcacgcatggcatcgagtgcggcagccaagtcggccgggtactgggaccggaccgtggtccagacgcgggtgcggggatgacggaattcgagcttcatggcgtgcagccactgccggtcaagtcccaaggcctcagacagcaccggattggcaccatacatggggtcgccgcacaggggatgcccaatcgaggagaaatgcacgcgaatctgatgagtacgtccggtctccagattcacggataccagagtggcctcatggccgaaacgctccagcacatcccagtgcgtaacggccggtttgccggccggagtcacgcagaagcggaaatcggacactttggcgcgcccgatcggcgcctcaatggttgctttgttctctttaagaccaccctgcacgagcgcatgataggttttctttacctcatgctcggcgaactgccgacgcatctcggtgtacgcaaggtcggacttgcacaccaacatcaagccggaagtgcctacatcaaggcgagaaacaatgccctcacgcccggccgcaccataggaagtgatatgcacgccgcggtcacgcagtgatccgagcacggttggaccggtccagccaaccgaggcatgcgccgccacgcctacaggcttatcgactacaacgacatcatcgtcttcgtagacaacggccatatcagttgcgataggctcaggctcggcctgttcctccgccaaatcaaattcgacggtctcccccgcctgcaatgtgctggaccgcgcaacttcacgtcctaaaacgcgcgcctgcccggagtcaaccagatcggcggctttagatcgtgaaatacccagcattttggccacggctacgtcgaaacgcttacccaccaatgcatcgggagcagggactattcgactcattacttggcgtccgcctccggctcagactgtagggattcgtcggattgctcgatgagatccttgtgtgagaacggctcccccataagaatcagaatcaccaggaccacaccggcgactaccagatagatatccgccacattgccaacggaccagccatagttaaggaaatccaccactttgccgtcgaggaagccgtcagcgtacataacacggtcaatcaggttgcccagagcgcctgcaaacgcgaaagaaatcgccaccgaccatttcatggagacagtgcgcaccccagccacagcaagggccacgcaagccacaacggccaacagactgattacccaagtagcgcctgatcccatgcccaaggacgcgcccggattacgcaccaaggtgaaggacagcagtccgggaatcactcgaatggtctgaccgttggataacgcggccatcgcccaagccttggtgagctgatcgacaatcagcgcagccgcggccacacatgcaaagacggccacgcgggtgcgcagccgtccctgttggttcgtcatacgacctgtacctgcctacgctcagttggtcttggacgaggtctggtcgacgtagttgttcgactcggaaacctgcgatgccagctggccgaggtactcggtgaggcgggcgcggtattcagtctcgaactgcttgaggctctggatgttgccctcgacgaccttggactgagcctgaaggttgtcgcgcacctgctcggcatacgtatcggctgcagagcgggtgttcttgtcgtacgcatcagccgcggaacgagtgttcttgtcatactcggcggcacgctgctgtacttccttctcgtagttgtcagcgtcatcgtgctgagacttggagtagttgtccgcatcctgacgagtcttgacggagtatgcgtcggcctcagaacgggtgttctgggagtaggtctcggcatccgcgtgagtctggtcacggtaagcgtcggcctcggagcgggtacgatccgaataggtgtcggcgtcggaacgagtacgagtggagtagtcgtcggcctcggaacgggtacgctcggagtagttgttggccttggtgaccagatcgttgtacttgttctggctggcctcggtgatttccttggccttgttcttgcccttctccacgtactgatcgtgcagctgcatagccagggtcagcatggcggtggcgcgctcgggctcggtgcccggcatggaagcggcgccagcgatcttctgcagagaaccggtctcggtgctcggctcgaccttagaaacctgagcacgaagctggttttcacgctgcttggcttcttcgagctgacgggacagctcagcgatctgagcggactgctgctgagcggcggaaccctgctgctgagcagcggcgagctgacgggacagctcctcgttggccgcgcggaactgatcacgttcctgctgaatggcggcgatctgctgaccgacagcctcctggtcaccggaggcctgagcagcctgagcggtgagctgatcgatttgagcgttcagctgatcgacctgacccttgagctgctcattctgggaggacagcgcgcggttggattcctcggcttcgctgagcttggcagagacaagctgtgctgcctgatcattgccagcctgaacggcctgctgggcctgagccacagcgttcttcaaaccagcattctccgactcgagttgctgcacctgaccggtaagatcggagatcttcgcattaaggttggtcacgtcaggacccagagtctgggtggcctgaccgccggctaccgcctgacgtccaagagcctcgacggtttccgtgacctgatcaaggaagtcatcgacctcgtcgacatcataaccttccttgaatcgaacagtctggaaggtgtgctccctaatatccttcggcgtcaacagagccataaatcttgcacctcgctttggggcatcgcccgcacttacgttggtctcaagtcagaatgctatcacgaccccatcgtttcagaacattcgacgtgggtttttatgccagatatatgcctccggcgggtcaaaaacggcctcagaacactatcagaacaacactttccagtaccaccagcgcaaaatacagcacaatgaagctgacatcaagataaatcgaaccgagcggcaatgggcgaatatagcgacgtagccagcgcagagggggttcggtaatggaatacacaatattgatcagctgggccaccacaccacgtggataccagtttcgtgcgagaacggagacccagtccagaatcatgcgcacgaacagaaccgtgatatacgcgttaatgagccatgcaagaatgcggccgatcagagagaacactaaggaaagcatgctgacagactaacaaccgcgcatgaaaagtttgctcggagcacaataagaatcggccgactccttgctgggagtcggccgaataccgatataacgtcgaatgcgaaaactactgaaccggtcagtcagcgaacaaatcgtgtgccgaggctggttttgtcggctcttcgaccttgatgttcacctgcgccgggctcaacaggaacacgcgcggagtgacacgctcgagggaaccacgcacgccgaacaccacgccggcggagaagtccacgatgcgatatgccacggcttcggccacaccggtgagattcagtacgaccggaacaccgtcacgcaatgcgcggccgaccagttgagcatcctcatatgacttcggatggatggtggtgattctgttcacacggccaccggggaacggcttggtagtcgacgatgcggcaggcgcggtggttgacgccagcggcgtgaccgtatggtcggaatcaaatgcggacttcgaagccggcttctgctcctcgtcctcctcgatgtagtcgtcctcatcgtccacaacgtcactcatgcccagataggacatcgcgtttttcatgaacccagccatggatcaatcctttcagcgcaggaagtcagggatgtcgagatcgccagccggatcgttcacggcgatattcggatgagcggaagtcggatcatcaaaaggcaacgatgcggagtcaccgatagccggtgtgaatgccggttgggcagtggcagcgggctgtgcagccggtgccggtgctggagctggctgtgccacgggagtcgcaggatcggcggcggttggcacaaccggcgtcaccgtgctctgagtgtcgtcatcttgagcggcgacggggtcaaaaccagcagcaataacagtgacacgcacttcatcgccataagcatcgtccagagcaagaccccaaataatctgggcttcagggtgaatcgccttgcgcaccagttcggtggcagcagaggcctcctgcaacttcaggtcggtcggaccggcgatgttgatcagcgcaccgtgtgcgccttcgatgctttcctcaagcagcggagagctgatggcgatttcggcggcctgcgtggcacgatcctctccccgtgcggaaccgataccaaacagcgcagtaccagcaccacgaagaatggagttcacatcgttgaagtcgacgtgaatataggagttcatcgaaatcaggtcagtgatgccctgaacaccggcaagcagtgcggtatcagcggtcttgaaggcctcaatgatgccgatggaacggtcggaaagctcgagcaggcgatcgttcggaatgacgatcagcgcgtcgacttccttgcgcaggttgtcgatgccgtattcggcggaagcggaacgctgagggccttcgaagctgaacggacgagtaacaaccgcgatggtgagagcaccctgttgatgagccgcacgagcgacgatcgggctggcgccagtaccggtgccaccgccctcgccgcaggtgacgaacaccatgtcggcacccctaagcgcctcttcgatatccgactggtggtcctgggccgccttggctccacgctccgggtcggcaccagcaccgagaccacgactggacttatcggaaagggaaatcttgacatccgcatcagagcgcagaagatccttcgcatcggtatttaccgccacaaattcaacattctgtaatccctcggcaatcatgcgattgacggcattaccgccggcaccgccgacgccaacaaccttgatgttggtcttgtcgttgaactcattctgcgcgatctcgctcacgtttggctcctgtcacttcacggttacacccaagagtagcgcaaacaggctactcttggagggaaattcacgcgcagaatggcgcgtgttgcgtgtattttcagtattttctcagtaactggcgtccattgggtcgtcaccgaagagcgcctcacgctcttcgtgggtggtggtacgcgattccaaccagccatacggcaagtgcaccttcttggcgaaacgcacgcggccgcgcggtttgtcgaccacgcgtggcgggtattcgatagtcgggtcgagcttgccgatctcgcggtccacatcggccaggctctcgcattccataaaggccttgcgggtggagccgcccaccgggaatcctttcagataccaggcgatgtgcttgcgcagatcgtggacggccatcatctcatcgccctcataaaactcggtaagcagctcggcatgacggtgaatcacgcggcagacctcgcccagattcgggttgagccgttcgggattgccctcgaaggcgtttttgatgttggcgaacagccacggccggccctggcatccgcggccgatggccacaccgtcgcagccggtctcgcgcaccatttcgagcgcatcctcggcaccccagatatcgccattgccgaataccggaatgttgaggtgttccttgagctcgccgatgcgggaccagtcggaatgaccgccatagtattcggcggcggtacgggcatgcagggttacggccttgcagccctcctcctgcgcgatgtgtccggcttcgaggaaggtctcatggttatggtcgatgccgacgcggatcttcgcggtgacggggatgcccgccggctcgcatacggcgaccacgcgctgtaatagctcagtgaaaatgtcggttttccaaggcaaggccgaaccaccgcctcgacgagtgaccttgggcaccgggcaaccgaagttcagatccacatggtcggccatgttgccgtcgaccacgattttcgccgcctgttcggtgatggaggggttcacgccgtacaactgcagtgaacggattttttcgcttttggcgaaatgacagaggcgcagtgctttcgggttatgcgccacgagggctcgagcggtgatcatctcggccacgtagagtccatcgggaccatattcctcgcaaatcacgcggaagggccagttggtcactcccgccatcggcgagagcaccaccggggtcggcacggtgatgttgccgagttggaccggggcgatatgcaccggggtcccggggcgcgccggcgcgtccgtacgtgggtcgaggttgtcggtctcgtgatgctcggtgagcactgtttcggattcggattgtgccatgtgattcctaagaaaataagtaggggctcccctgagagaggagccccggcgtctatcgccgccacttcgcctacaaacagcccactgggatgtcttccttacggctcagcccacagaggggagcccaagttgtgcgactccggcttagtacaggccgccggcttcctgaacgccggactcaggccaaggctcaccgcccatttccacaggcttcaggggcacgcgggtgcgcttctcgccgatgcgggcggccacgtaatcggccaccttgtcaagagcgacgcgctcctgggccatggtgtcacgctcacggatggtcacagcgtggtcctcgagggtgtcgaagtccacggtgatgcacagcggggtgccgatctcgtcctgacgacggtaacgacgaccgatggcaccggactcgtcgtagtcgatcatccactcgttgaagcgcaggtcgtcggccaggttctgggccacggtctgcagttcaggcttcttgctcagcggcagcacggcggccttgaccggggccagacgcgggtcgagacgcagcacggtgcgcttgtcaacgccgcccttggtgttcggggcctcgtccacatcgtaggcgtccacgaggaagcacatcagggagcgggtcaggccggcggccggttcgatgacgtacggcacgtacttctcgccggtggcctggttgaagtagctcaggtcttcgccggagtgcttggagtgcgcgctcaaatcgtaatcggtacggttggcgatgccttcgagctcgccccagtcggaaccctggaagccgaacttgtattcgatgtccacggtgcgcttggagtagtgggagagcttctccttcggatgctcgtagtggcgcaggttctccggcttgacgccgaggtcgatgtaccagcgggtgcgggcgtcgatccagtactggtgccattcctcatcggtgccgggcgtgacgaagaactccatctccatctgctcgaactcacgggtgcggaagatgaagttacccggggtgatctcgttacggaaggacttacccatgttggcgatgccgaacggcggcctggaacgggaagaggtcatcacgttcttgaagtccacgaagatgccctgtgcagtctccggacgcaggtagtgcaggctgttctcgtcctcgaccgggccgaggtgggtgcgcagcatcatgttgaagtcgcgcggttcggtccactggccacgggtgccgcagttcgggcagacgatgtccttcatgccgttttccggcatcttgtcgccgtgcttctcggcgtaggattcctcgagcttgtcggcgcggttgcgcttgtggcagttgagacactcgacgagcggatcgttgaacacgctcacgtggccggacgccacccacacttcgggcggcagaatgatggaagtgtcgacaccgacgacatcaggacgggtgacgaccatggagcgccaccattcacgtttgatattgtccttgagagcgacgccgagagggccgtaatcccaagcggaacgggtgccgccgtaaatttcgccggcggggaacacgaagccgcgacgcttcgcaagggatacgacttcatcgagtttggactgagccacaatgcaccttctggtttgaacggtttggggtctaataacaaccgcttcaggatagccgtatatggtgacaggtcaggcggcattgtccggtatatgttccgcgtctcacgagcggccgttcgcagcgattcctatatcgcaacacctccatattgttcctgttgttttacccttcccgaatttgtgccactgacatcgcgtcagcgtcacaaattcgggagatgttgctcggcggaggcgtctatgtatcacgaatggacggggacgcgccagacctgacgacacgtatcgaacaaatccgtcacgataatgtccatgttggcgcatagcgtcggcactgtaatgcaggggaactcgcatgtggttcgcgagttgagaaaggcctgagcctgacccttagaacctgttggttaagaccatcgtagggagcagtaaatgagcaatagtgcatcatcgtttaccggcgtgtccagcggttataccgccgggactccggttccagccgattcacccatccgtgacaatatcgccgatgccgttcgccgcgtacgcgagacgactccgttggcccagtcattcaccaattttgtgaccatcaatttggttgccaacgcgcaactggcggccggcggcactgcggccatgagtttcctgccggacgacgtgatcgaaaccgcgaaaatcgcgggcgcgaactacatcaacgtgggcacgctgctgccgttctataaggacgcactgcccgaaatcgcccagcgactcaactacttggacaagccgtgggtgctcgacccggtggccgccggcatcggccgcacccgtaccgccattcttcaggccttcaaggccgctcccccgaccatgattcgcgcgaatgcatccgaggtaatcgcgctggcgaacatgtgggggctcaataccgaaaccgtgggggacgcttccgagcaccgccccgccggagtggaatccgtcgacgacgtggagtccgcaaccggcgcggcggtggcgctggcacagtatctgaccgaacagcacgccaagcattcctcccatgacgcttccacccgctgcgccgtggccgtgtccggcatcgccgatctggtgaccgatggcgaaaccgtgtaccgactgccgggcggcagcgcgatgatgaccaagatcaccggtgccggctgctcgctgggcggcgtggctgccacgtatttggcggtctccgatccgttgaccgccgccctgtccgcgtctctgctgtacaaccgcgcgggagaggtggccgatacaacttcgcacggaccgggctcgttccaagttgcgttccttgacgcgctgtggaatgtgaccgccgaacaggtggcggaatccgagattttggtgcagtagtttcagttccctctgatgagggagctcataacagttttttccaataagacttccacaagaaacaacaaaagcaggaataataatgagtaatgaatacccatacgcctccatgcgcgacagcttcgacctgtccgcgtacttcgtggtggggccggaggactgcaaaggccgtccgctgaccgacgtggtggatcaggctctgcacggcggcgcaaccttcatccaactgcgcgccaaggaggccgatgcctctgagctgaccgacatggctcgcgacatcgcgcaaatcatcgaggacaatgagaagtccgattccgtggcctttgtgatcgacgaccgtgccgacgtggtgtggcaggcccgccgcaagggcatcaaggtggacggtgtgcacatcggccagaccgacatggagccgcgcgaagcccgcgccctgctcggcgacgaggccatcgtgggtctgtcggctgagaccgaaagcctcgttcggctcatcaacgagctgcccgacggctgcatcgactacattggcgccggtcctctgcacgtctccaccaccaagcccgaggcttccgtgggcggcaacgacggctccggcaagacgctggacgccgcccagatcaacaccatctgcgttgccagcgaattcccggtggtcgtgggcggcggcgtgaccgcagccgatatggccatgctcgccgataccaaggctgctggctggttcgtggtctccgccatcgcgggtgccgagaacccggaagaggccgcgcgcaccatggtcgaaggctggaaggccgtccgcggcgacaagaagcacggctacgctccgcgcgtcgtaacccacaccccgctactgacactcaggctgctcaggaaggggccgcgaagcccggttccgaggccactgagaagaagttcaccaacgccaaggacgccaaggatgcccagaagcttgccaagcagcagcgcgtggacatcgccgcccgtggttccaagcagcgcgacaaggcgcacatccgcaagaccaagtccgtaccgttcacctatcagtatggttcctacgacctggaagtgccgtacaccgaaatcaagctgagcgacacgcccggcgtgggcccgaacccgccgttccacgactacaacaccgaaggccccaagtgcgacccgaaggaaggcttgaagcccctgcgtctcgactggatccgcgaccgcggcgacatcgaagactacgagggccgccgccgcaaccttgaggacgatggcaagcgcgccatcaagcgcggccgcgccaccaaggaatggcgtggacgcaagcatgagccgatgcgtgccaaggaccacccgatcacccagatgtggtacgcccgccacggcatcatcaccccggagatgcagtacgtggccacccgcgagaactgcgatgtggagctcgtgcgctccgagctggccgccggccgcgcggtgatgccttgcaacatcaaccaccccgaggccgagccgatgattatcggatccgccttcctgaccaagctcaacgccaacatgggcaactcggccgtcacctcctccatcgatgaggaagtggagaagctgacgtgggccaccaagtggggcgccgataccgtgatggacctgtccaccggtaacgacatccataccacccgtgagtggattcttcgcaactcccccgtgccgatcggcaccgtgccgatgtaccaggccctcgaaaaggtcgaggatgatgcctccaagctgagctgggaactgttccgcgacaccgtaatcgaacagtgcgagcaaggtgtggattacatgaccatccacgccggcgtgctgctgcgttacgtgccgctgaccgccaaccgcgtgaccggcatcgtctcccgcggtggctccatcatggccgactggtgcctgcgccaccaccaggagagcttcctgtacacgcacttcgacgagctgtgcgacatcttcgccaagtacgacgtggcgttctctctgggcgatggcctgcgccccggctccctagccgacgcgaacgacgccgcgcagctttccgagctcatgactctgggcgagctgaccgagcgcgcctgggccaaggacgtgcaggtgatgatcgagggcccgggccacgtgccgttcgacaccgtacgcatgaacatcgagctggagaaggccgtgtgccacaacgccccgttctacaccctcggaccgctgaccaccgataccgctccgggttacgatcacatcacctccgctatcggcgccaccgagatcggtcgttacggcaccgctatgctgtgctacgtgaccccgaaggaacacctcggcctgccgaacaaggatgatgtgaagcagggcgtgattgcctacaagatcgcctgccacgccgcagacatcgccaagcaccacccgcacgcgatggatcgcgacaatgcgatttccaaggctcgcttcgagttccgttggctcgaccagttcaatctgtcctacgatccggacaccgccatcgccttccacgacgataccctgcccgccgagccggccaagatggcgcacttctgctcgatgtgcggcccgaagttctgctcgatggccatctcccagaacatccgcaaggcattcggtggcgaggccgctcagcagcaaatcgtgaaggaggctgctgcaggcatcgactccgaggcactggctacggccaaggccaatgtcgataacggcgtggtgtccgccaacgtgctcagccccgaagaaatcctcgccggcatggatgcgatgagcgaaaagtacaccgcccagggcggcaagctctactccaccgcccaggagtaaacctctctggctcccctctctgaggggagccaattattatgcccggtggtgtcttaattcgggacgacgctcgactcgctcgaaggcggtgccgaagtgtgcgccatctggaccgaggccgtcggaagtctccaggaccacgccttcgttgagcgcacggcgcacgatgcccacacggggcttcaacggccacacatcatgcggcactttgcgatagaaatccgtaccgacgagcaacacgtcgcccacatcgaacacttcctgacgcggaaatgtgagctgtgtggtgtgtccgttaggcattacgccaaaatatgcggtgagttccggtgatgcgcaccaagacgccgtcacggcgcagtacatcgttatcagccatgtctcctcccgaacatttcatgaatcaatcgcaatcagcaaaccttccccgtctcaccacaggagcggcaaaacatcaaggaaaaccgctccgaaaaacatcatgggccccacttagaatgaacactatggcacaaattgcaacatctacacttcccgctgttctcgcgatctccggctccgactcgtccggcggtgccggcatgcaggccgatctgaagaccatgctggcctgcggcgtgttcggcatgagcgccatcaccgcgctcaccgcacagaacaccaccggcgtgcgttccattcaggataccaaaccggacattctcgccgaccagatcaacatggtgtttgaggatattccgccggtcgcggtgaaaatcggcatggtgtctgccactgacatcatcgacgtcatcgctgaacgactcaccttccatcacgccacgaacatcgtgctcgacccggttatggtggccacttccggcgccaatctcatcagtgacgatgccattgcggccttgaccggcaagctgttcccgatggccacggtcgtgactccgaacattcccgaggccgaagtgctgaccgatacgctgattcgcgatcaggaggatatggaggccgccgcccaccgcctcgtggagcgttatggctgtgccgcgctggtcaagggtggtcatggcaccgaggatgccaacgatgtgcttgccgagacggatggaaccgtgacctggtttgatggcgcgcgtatcaataatccgaacacgcacggcaccggatgcacgctgagctccgccatcgcctcgtatctggcgcttggcgacacattgcccaaggccatcaagcatgcgaagaagtatctgaccggtgcactgaaggcccagctgaatcttggccacggctccggcccgatggatcatttctggaagtatcgctgagtcctactggctctcctctctgaggggagccaagtaataaaaggagaattatgattattgaccgtaatgccgttactcaggaagtgccgatcgacccggaaaccggcaaaccgtacctcaataccgtggccgccattcaggtgtcggccaatggcgtgggctccgaggtttcgccatacgtggctcaggccgtcgaggtgattcgcgaatccggcctgccgcaggaaaccaacgccctgttcaccaacgtggaaggcgatctggacgacgtgctcaaggtggccggtgaggccgccaagaagctcgccgagcagggctaccgcacttctctggtgctgcacatggatatccgccccggcttcaccggccagctgaccgaaaagcccaagctggtggatgagatcctcgccgacaagcaggcgaagtagcaaagcatcgcttccaccagcaagggcatgctttgttattacacgtttcatggggcggtagctcacccatggggtggtaaaaccctcatggggcggtagtcgaaaacggctctattctgcggaaaggcaaaatccgctaaccgccccatgggccaaataccgccccatgagtgttttaccgccccatgggaatcacggttctgccttctttcgacggggtaagagcgtaagtggggcatatataggagcgtcacaacctctgttatcgttcacgatgtgaccgcaacgcggcgtgccacaaaatcgaacctatagttaagccccatgtagtgagctatctcacaacgattggctcgctacgtagaattcaagacttggatcgcaaacgtcgttcatcccacacaatgggagggcgaacggaacacacagtccaatcaagagttcgctcgccgcaacaccattgagcagttgcacgcgggcaggtttgcaagaagagggctcaaatatgactgctgctgaacagcagatttccggcaatcccgcggctatggaaaacgcacaagcacgtaccaccgtgacggatcaagccaaggttcaggatattatctcgcgcatggatcgcgcacatgaaaccccgatgttccatcgcatcgtgacgctggtcgccgctggcatgctgatggacagcatcgacgtatatattggcagcgccgtcgcctccagcacgttggctacccgctggtccaccgttgcgcaaaattccacctttatgtccgcgggcttcctgggtctgctggtcggttcgctgctggccggcttcgtcggtgacctgaagggccgccgcgtggcttaccaaatcaacctgctgctgtttggcggcttcaccttcctcggcgcattcgccccgaacatggctgtgctgtccctgtgccgtctgggtgccggcctgggcctcggcgctgaaatcgtcaccggcttcgccatggtcaacgagttcgcaccgatgaaccgccgtggccactggtgcgcgattgtctcgctcgtggccaactgcggtgtgccaatcgctatgctgctgtgtgcatggatcatcccccgctggtcctggcgtccgctgttcgtggccatcggcctggtggccgccatcatctggtggctgcgccgcgacatccccgaatccccgcgttggctcgccgtgcgcggccgttacgatgaggccgacgccatcgtcaagcagcttgaggccaacggttccgaaccgatcgacgcagccgccaaggccgacaccagcgacacccgcaacgccggaggccgttcgctcggcatctgcctgcttgtggctgtggttgctgtggccgccacgaacgtgtgctcctacgccttcacttcttgggttccgacgattctggtcaagcgtggtattaacctgtccagctcgctgctcacctccacggtgatgatgctcggtgccccggtcggctgcctgattggctctctgcttatcgaccgtatcggccgcaagcgcacgattgtgccggccttcctgttcactggcgtgttcggtttgatgtatgccttccagacctctaccgtgagcgcaattatcgttggcttcctgctcatgatgtgcctgtacgtgcttatggcttccgtggtggctgtgtacgctccggaactgttcgccaccaaggttcgcttccgttgcgtcggcttcgcgaacgccgtggccaagctgctcaatgtgttgatgccgatggtggtgggctggatgcttacctcgcttggtgccacgtccatctttgtggccatcagcgcgattgctattgcatcgatgctgattgtcggcttctttggcgcggagactgcgcagaagtcggttgggtgatcggtttcctcacagtggaataactgctgataatgtccattcggcgtcttgcgtggtgatatgcagggcgccgttttgttgttctagtaattgttggtaacggttgaggccggtgccggtggataggtctgcgtctccagcggacaatcagcgtctgtgatgtcacatgcaatgccaggagcggcatcaacggtcgaatcatgcggagtcactgcactgtgcgccgcttctcccctgccttcaatcacatcaatgacttgatgcgtgcgatccaatgcgcccatagacatatccgtaaccagcacgtcaggccgcttggtggggctcaggcatcggctgatggccacagcacccaaatcgcaggtctatatcacggcaaaatcgctggacatacgttcgattagcgcgccgaacactttcagcgcatatgggtcattgtccacaatgccgatgcgtatgttgcggttgcgcgcttcttccattacattcaccccttcagtgtgcccgacgccgaactactccgtcctgacacgtcatggtcactatgacaactatcattccacatttcctgcgtgatttacgatggaatcatcatcaatccttgacaaggcggtaaaggaggacggcaatgaaccgtgcacaagcactcagcaagctcaacaggagcgatatgcgcaatgccgccgccgagcgcgggatgcaacgactgttcacatggaaccgcgcgcattggattggcatggttgtactgatagcggtgttgctgctactgcagtggagctcatcaatgtatctcatgcccgacgaggttcttgacagggctgccaaaaacctgttcgtatggttccccggtatggttctgcactggccattggtgttgggaatcaccaacttgatactcggttcgacacgatccggcagtctgtctttcccgttggcgagcgcaatcatcggaccactggcattcggctggaccaatcttcgcttacggccggggttcccataccgttcctgggctcaagggaaagccgcaatataatgaaaacagcgatttcatgcaatgatgcacgagccgatccaagcaaaggggccaaccatgagcgagcaactgatggaacagtaccggttgcgcggacaacgcaaatgccgtaacgcttgtatcgccgccatcgtgacagtagtgcttgtccttgccgtcgccggcggcgtatggtggacggccggcgatggcagcgcattggttcgcaatatgttcaagccgaaggccacgcctgccacgcagccggtagtcaacagcaccgcaaccttcgcctaccgcaccgcaccggaattcctggcgatggaagccggcgaccgaggcaccggcaatgtgaactactctcctgcttcgatgtggatggcgttggccatcgccgcgcagggcgccaatggcacgacccgctcgcaactgaacgaactgctgggctccggttcgctgaccgatagcgactaccaatcgctgctaagttcgatcaacgggcaatattcgggggcgaaatccgagatgagcgccgcgaactcgctgtggattgatgacgactactctcttgccagcgattaccaatccaccgtcaagaagatgttcgaggccgaagtcaccacgttaccgttcgacgatcaggccgccgcaaagatgtccgattggatcgccaagcatacgaatggttcgctcaagccgaagattacgctgcgtgaccgtgaagtcctgtccatcatcaacaccgtctatgcggatggccgttggaaggatccgttcgaagagcagtccaccggcaacggcaccttccacggcgaagccggagatgctcaggtgccgatgatgcaccggaccttcagccaaatggcttacggacatgatgagtacaacacttggcagcgggtggagattccgttcgacaacggcggcaatctggccatcgtgctgccggccgaagggcatttcgacgagttggccggcgatgccgagaagctcagttgggcgttcggtacatgctcgacggcttcccttggcgagggcgcaatgggttgcgccgcggacagtatgcccggatggggcgtctccgtcaactcggtcatggtgaacgtcacgctaccgcgattcaccatcgacagcatgttcgactcggaagccaccatcaaggcattcgaaaaactgggggtgaccgatgcgttcagtgcaggcgacgccgacttcaccaagatgatcgacaccggttcgcacggcgagaacctgtatatcggctcgattctgcaaggcacgcgcatcgaggtgaacgaagccggcgccaaggccatgtccttcaccaaggtcggcgcagactccgttagcgcgccggtggacaacgtcgagttcacggtggatcgcccatttctgtattcgtacgtcaccccggacggcataccattattcatcggtgcggtgcgcaacctcggcggagtcggtggagaaaactgatactttcctggcagtccgtcaattagggtgtatcgtttgacgcatggttacgatgaaggaaatcgcgaacaaggcgggggtttccgtctctacggtatcgctggtgctcaacggacgcgacgaggggcgcgtaaagtccaaaattgcggacaatgtgcgcgccatcgccaccaagctcggctaccagtcgaatccgctggccagttcgctgcgtacaggcaggacgcacatcctcggtttcatcagtgaggaggtggccaccaccccgtacgccggcggtatgattctgggcgcgcagaccgctgcaagccagttcggctatatgctcatcaccgtgagcaccgacggcgagaacagcgagagcgaggaaatcgccgcactcaagcgatacggcaccgacggctttctgtacgccaagatgtcgaaccgcatcacccatgtgccttcctcgctggccaagacgccactggtgttggtggatgccaccgactcgcttggcaaaatcccgagcgtggaaccggacgagttccaaatcggctacgacgccaccaccagattggttaaggccggatgcgcacgtatcgcctatgtgggttgcttggagccgctgattgcgcaggacgatcgtttggaaggctatcaggcggcgctcagggacgccggcctcgactatgacgatcatctggtcgtcaatgtgctcaacaacgggccggcactgaccgcagtcagcgatttgttcgatgccgagcatccggacggattcttctgcttcaacgatgcccgcgcctggtatgtgtacgaatgcgccgcacgccgaggactcacggtcggcaaggacatctccgtggtcggcgtggacaaccatcgcgtgttcgccgaaacgctggaaccgatgctcaccactgtggaactgccgcatttcgagatgggctactgggccgtggccaagctggtgtcgattatcgaaggacgctcgatggacgacgtctcatggccagcgaccacctcccctgccgccgatcgacgcgccgattccggcgaagatccactgcacgctgatcgaaaaggcctcggtgaagtaaccgagtcccacacgatttctcaaggcctccgttcagcacggaggccttttgcgtgtcgaacggatacgacacgccgatttacgtcaatcgattgacgtaaatcgattgacgtcgcataataattactacgcaacaacttctacaaaggcacggccgcccgagcagaagcgttacataaccaataaccaaccaagtagtaatcaaaggatgattatggcaagtgcaaccaaatctgcatggaagaatccttcctatctgcagagctctttcggcatcttcatgttcttctgctcctggggcatctggtggtccttcttccagcgctggctcatctcaggcgttggattgaccaatgctgaagtcggcaccatctactccatcaactcgctggccaccctggtcatcatgtttgtgtacggcgtgattcaggatcagctcggcatcaagcgcaagctcgtcatcgtagtctcggtaatcgccgcctgcgttggcccattcgtccaattcgtttacgccccgatgatcctcgccggtggcaccacccgctggatcggcgcactcatcggctccatcgttctgtctgccggcttcatgtccggctgctccctgttcgaggccgtcaccgaacgctactcccgtaaattcggtttcgaatatggccagtcccgtgcttggggctccttcggttacgccatcgtggcgctgtgcgccggcttcctgttcaacatcaacccgctgatcaacttctgggtcggctccgcattcggccttggcatgctcctcgtgtacgccttctgggtcccggccgagcagaaggaagagctcaagaaggaaaccgacccgaacgcagcccccaccaacccgtccctcaaggaaatggtcgccgttctcaagatgccgaccctgtgggtgctcatcgtcttcatgctgctgaccaacaccttctacaccgtgttcgatcagcagatgttcccgacctactacgccaacctcttccccactgaagaaatcggcaacgccacctacggcaccctgaacggtttccaggtcttccttgagtccgcaatgatgggcgtggtcccgatcatcatgaagaagatcggcgtgcgcaacgctctgctgctcggcgctaccgtgatgttcctgcgcatcggcttgtgcggcgtgttccacgacccgatcaccgtctccatcgtcaagctgttccactccatcgaagtgccgctgttctgcctgccggcattccgctacttcactctgcacttcgacaccaagctctctgccacgctgtacatggtgggcttccagatcgcttcccaagtgggtcaggtcatcttctcgacccctctgggtgccttccacgacaagatggctcagattctgccgaacaacgacatgggatcccgcgtgaccttctgggtcatctccggcatcgtgctgtgcgcgctgatctacggcttcttcgtcatcaagcgcgatgatcaggaagtcggcggcgacccgttctacaccgacaagcagctgcgccagatggaagcggccaaagcctgaaaggaccaccatgactgacttcactcccgaaacccctgttctcacccccatccgcgaccacgctgctgaactggcaaaagccgaagccggcgtggctgagatggccgccaagcgcaacaaccgctggtacccgaagtatcacatcgcctccaacggtggctggatcaacgacccgaacggcctgtgcttctacaagggcctctggcacgtgttctaccagctgcacccctacggcacccagtggggtccgatgcactggggccacgtctcctccaccgacatgctcagctggaagcgcgagcccatcatgttcgcaccgtctctagagcaggagaaggacggcgtgttctccggttccgccgtcatcgacgacaacggcgaccttcgcttctactacaccggccaccgttgggccaacggccacgacaacaccggcggcgactggcaggtgcagatgaccgcgctgccggacaatgacgagctcacctccgccaccaagcagggcatgatcatcgactgcccgaccgacaaggtcgaccaccactaccgcgacccgaaggtctggaagaccggcgacacctggtacatgaccttcggtgtctcctctgcggacaagcgcggccagatgtggctgttctcctccaaggacatggtccgctgggaatacgagcgcgtgctcttccagcacccggatccggatgtgttcatgctcgaatgccccgacttcttccccatcaaagacaaggacggcaacgagaagtgggtcattggcttctccgccatggggtccaagcccagcggcttcatgaaccgcaacgtcagcaacgccggctacatgatcggcacgtgggagccgggcggcgaattcaagccggaaaccgagttccgcctgtgggattgcggccacaactactacgccccgcagtccttcaatgtggaaggccgtcagatcgtctatggctggatgagcccgttcgtgcagccgattcccatggaggatgacggctggtgtggccagctcaccctgccgcgcgagatcactcttggtgatgacggcgacgtggtcaccgcgccggtcgccgaaatggaaggcctgcgcgaggataccctcgaccatggttcgatcacactcgacatggatggcgagcagatcatcgccgatgacgccgaggccgtggaaatcgaaatgaccatcgacttggctgcctccactgccgagcgtgcgggtctgaagattcacgccactgaggacggtgcctacacctacgtggcttatgacgaccagatcggccgcgtggtggtggatcgtcaggccatggccaacggcgatcgcggctaccgcgccgccccactgaccgacgccgaactggcctccggcaagctggacctgcgcgtgttcgtggatcgcggctccgtggaggtctacgtcaacggtggccaccaagtgctgagctcctactcctacgcctccgaaggcccgcgcgccatcaagctcgtcgccgagtccggtagtctcaaggtggattccctgaagctccaccacatgaagtccatcggactggagtagctctttcacctccctctgacgagggaggttttttgtgcgccctgtcgttcgccttcgcctatactgatggacggcatataacacgatccatcacacgaccggcaggcgcgcaggctcctcaccttactgttccacgccccggccgcaagcgccaccagcaaaccggactggcgcggaaagcaaggtgacatcccatgtccatcgccaagcgcctcaagcgccgcatgcccaccgtcatcgccgtcatcgtattgctggcagtctgggaaacgtgggtggatctaggacatgtctcccccacgatgatctccgcgccaagcgagattttcgccgccaccatcgaaacatggaacacgctcggcccggccgcggcaatcaccggctatgagggcgtggtcggcttcctgtttgccgtgttcttcggcattatgatcggcattgcactgtactgctcgcacacgttcaacgcggcgttctatccgctgcttgccgccgcacaaaccatgccgctgatttccatcgccccgttgttcctgatttggttcggttttgagatttccggcaaaatcgtaatcgtggcggtattcggcctcttccccatcgccgtgcagactgtgcgcggactagaagcagtgccccagttctattccgacgtcgcattgacctgcggcgcgaccccggtctggacgctctggcacgtgaagctgcgcgttgccgcacgtcagatctatggcggtatccgagtatctgccgcatacatcttcgccacggcatccaccgctgaataccttggcgcacgcaagggccttggcatctggctgcaggctgcctacaattcattccgcacgccgctgatcttctccgccaccatcgtcattatcctgatgacatgcgtactgatgctggcggtaaacgccagcgagcgcatcctgctcggcccggccggcgacgacgaagaccccgacgcggaccagtagttcttttttaccgtcaaaggcacgagccggcagccaggaccgactgaacgaggcggcttctcatgaggtctccaaccctgtctctataatggaacagctttaccagcgtgtggcaaaccggctttcccgagctttcatagggaatgtcgggggcgctggtcgaacggaaatcaaggccctccatatcgttttctgccgacttccgttcgaagcaatcccagagaacgatagagagacaacgaattagggaaccatcattatgaagaaaagccttgtatccaaggccgctgccctcgtgggcgcccttgccatgactttcggtttcgccgcatgtggccagaccaacaccgccgactcctccaactccaacacctccgacctcaagaaggtcactttcatgctttcctgggcacccgataccaaccacatcggcgtgtacgtggccaagaacaagggctacttcaaggacgccggccttgacgtggatatcgtggccgtggcccaggccggtgccgaacaggccgtgaacaacggtgtggccgacttcgccctgtccaacctgaccaacgtgggcgtctacacgctgaagggcgctcacatcaagcaggtgctgcaggtgcagcagaagccgagcgccatttggtgcgcactggcgtccaacaccgccatcaagtcccctaaggatttggatggcaagaccttcgccaccttcggctccaacgagtccgatgccgtggtgcgccgcatgatccaaaccgatggcggcaagggcgaattcgacaaggtgaccgtcggcacctccaccttccagaccatggaatccggcaaggccgatttcggcggcttctacgccacgtgggaaggcgtgcaagccgacatgtacggcccgaagctcaactgcttcaccgagcctgactatggcgtgcccggcaacgccgacaccatcggcatcatcaccaatgacaagaccatcaagaacaatcccgacctggtcaagaagttcactcaggccactcaaaagggttacgagtacgcgtacgccaacccggatgacgccgcgcagattctcgtggacgaagcccctgacgccaacctcaagcccgaattcgtcaagaagagcatgcaggttatcgtcgacggccagtactggggcgatccggccaagatcaaggacggctctttcgtgctcggcaccaacgacttcaagggcgctcaggaatacttcgacttcctggctgaagaagacgcatacaccgacagtcatgacaagataattcatgaggccccgcaggccaaggaccttgccaccgacgaattcatcggcaagtaatttccgatattccgagtttgaatctacgcaaaaatgcgtccttcccatgaggaaaggacgcatttttgcgtatcggccgataaggttattcatagcggatcacgctaacaaggagacgattctatggtccaatgtcctgaccgcattattgccagcatagatacgggtgttgatgatgcgttggcgttggcgtatttgttggggtcgacggatgagtgcgagttgggtggcgtgattgccagttatggcaatgtggatgcgaacacggcttatgccaatacttgcgcggtgcttgatttgtttggtcgggcggatattccagtgtttttagggtctgagcatccttcttgggctgatgcgtttattcctgatgcagggtgtgcccagttccacggggatgatggactggggaatactcggctggcagggtccggggctctggctgatggagctggtgtgcctggtgatgatatgtctggtgatgatatgtctggggatgacatgtctgtggatgtgcccgatgaggttgtttctgttggcgggtatttggcgggggatgttcatgctcatccggcgttgggtgcttgttctcgtgtgaaccgctctcggtcggtgggccacccccagtcgactatgccgacagctctcgccagcgggggcaaaaggagatgctccgttgatgctgcggatgggattgagtatctgattgagcaggttcgcgagtttggccgagacgttaccgtgctggctaccgggccgttgacggatgtggatgcggctattactcgagcaccggatattgcatcgaaactcaggctggtgatgatgggcggtacgcttacccaacccggtaattgttgggatgcggtagctgagacgaatatcatccaagaccctgaggccgcgaatcgtgtatttcattccggcgcagacatcacaatggtgggacttgatgtgactcaccagtgtttgctaccgcaatcggcggccgaccggtggcgtgcgacggggaccaagcgcgggcggttcttggctgatctcgcggacttttccatcaaggcaaatttggaagccgaccccgcactgttctctggcggcatgccgttgcatgatccgttggcggcggcggttgcacttgattcttcactggtcgattgttttgatcttgcgttgcgcgcggagaccaataccggtgatttcaatggagtacgaggccggaccaccggagacccggttgggctggtgaatcattccatgccgcatgtgcatgtggcacttggtgtggattcggaacgttttttggatgagtttgtagagaggatggctgaggtgtgccggtaactcccctcagtccgctacacgggcagctcgaccgcaattacggacaagctgccgctcgcattcttctggcttgactctcgtctcgccttcgcctacaaacagcccaccgggctgtttgctttacggctcagcccgtcagaggggcctaacaaggactatttcacaccgccgaatcggcgatcgcggtggatgtaatggtcgatggagcgccatagcacgtcacggccgcagtccgggaagagttcgggcacgaagtcgagctcggcgtaggcggcctcccacggcaggaagttggaggtgcgctgttcgccggaagtacggatcaccaagtcgcaatcgggaatgtccggattgtacagatggtcggcaatcatcttctcagtcacacggtcgccggaaatcttgccatcgcgcacttcgcgagcgatggcggcgcaggcgtcggcgatttcagcacggccaccatagttgatgcagaacaccacatcgatgaccttgttgttcttggtgcgctcctcggcggcttcaagctcgtcgatcaccgacttccacagcttggggcgacggccggaccagcgcacgcgcacaccccactcgtccatctgttccacacgacggtggatgatttcacgcgagaaacccatgaggaagcgcacttcctgtggcgagcgcttccagttttcagtggagaacgtgtacaggctcaaataccgtacaccggcttcgatggcaccggcgatagtgtcgaacaccaccggttcggcggcctgatggccattggtgcggaccatgccgcgctgcttggcccaacgaccattaccgtccataatcacaccgatatggcggggtaccttgttcttggggaagtcgggaatacgagcggggtcgctgaacggagctgcgggaatgtccaacgacgtgtaatcaacgttctcaaaagccatactcatgaatctatcaagcgcagcgaacgaatcgggcgttcgaggtaatactcccccaatcttcaaccaactcctgcacaacccgctccacaggcgcggcatcaagcaccgaccaatcgccacgaatcagtgcatcgaactggtttaacacgaacggtgcgatacggcgcgcatcggtagtgtggtcggcttcgcacatcacgccgccggacgcgatggacaggtacgccggctccgccttgccgcataccacgcaagtgcccaatcgtggcgtccaaccggccaaggccaaggcgcgcatcacgtaggagtctcctatggcttgcggggcgtgggattgtttggcgagcgcgttcaacgcgccgatgagcagccgatattggttcggcagctgctcatgttcggtgctggcgagtttatcgatagtctcaacgatgacgttggcggcctcatacgccgcataatccgccgcgatcggagcaccataagcggcgaccgcttcagcttgggataccacgtcaagcgagcggccttcagcgataagcacatcgacgcgcatgaacggctcgagcctggcaccgaagcgtgatttggtgcgacgtacgcctttggcgaccgcccgaatcttgccatgcccacgcgtcaggatggtgatgatacgatcagcctcgcccagtttggaggtgcgcaacaccacaccttcgtctcggtacagcgacatctcatctcctttccccgcgacgcccggcagactccactcaatgaagtagtcagtaaataaacagaccccagaaagcgaacaccaacagtatgtacagcatggtgaaggtcaccagccagaacaggattcggcccagacgggtggaggcgagtaccgggtcggcaccggtgacgatgtctcgaacggattcgcgacgagggggtatctgaatcaggccgcggacggaagcggcttctatcaggtgcataaagacgcgggaccaagcccatagcaccagcacggacaccacttggatgaccggccagctccaatacatgacacccggcgtctcggtaggtgcgccaccccatgcaagtttgaccacgcccatgatcacctgcccgagtccggcgaagaagatgagcaatgtggcaagagtggtgagggtcaaagtcagcagcgcattgccgaaaccatgtgcgaaaccgagtaccacaggccgttccggtatcagcatgcccgcatgtttggcctcgcgcttctctcgccgccatcgggcatccgccgcgattttgcgacccagcgccaccagtgccagcacgatggatgcgagcagcagcagtaccaccgtgacgtgcagaatcacaccatatatggtgccgacgcgtcttgccttcaaagcgcccggcagaccgattgattggtacagattggtgccggccaccttttcactggtctgcgtgagtccggcggaagtgccgacggcccagtcgatgagatcgtccacataggcgtccgcaaacggggtgcccgcttcggactcatctcccaaacgcagcacatggttggcgaccgggtagctgcgcacggtcacattccagttatcggctttgtgggcgttgtagagaatcgcacgcacaccgtcgacctgcgccgtcatcacgtctttcgaaccgtaagccacataggtgggtacggcgtaggcggcgggtttgagtgtggcgaggtcgaaattgttcagtccgaacaggccggtgtccgcgctgaacacacgttggacgatggattgatagccttcgttcgcgccaacaagggtgaagtcctgggtgacgaaaaatcccagtgattggcgtgggctgaacaccatcgggctcagaagaatctggaaggcgacgtccggatcgtcctcgagcagatacgaggagatccatgtcgattcggaggtggcatagatgccgaccttggcctcgtctacatcgctttggtctcgcaggtattcgatgacctgatcataagccttggctgaggccggataatcgcggttgatgtcggtggtgttccagacgggtttgtcgagcactgcggtcacaaagccggccgaagccataccggaggccacgtcgccaaaggagttgtcacaggtgccgtatccggcaccgtgcatgaacaccacgccggggcgcttgcctgatgcgttctgaggttcccgaatcaataccttgatagcttggacgccgtccgcattggccttgccccgagcaccggactccttggtcagattgccgtcgctggtcatgttcagcgtgatgtatcgctcggtgacctcatacgtgccttttgccggcagcgtttctccggacgggttatcgaaggtgacttcggtatcgtcggtgagcgtggccatcgactggccggtgggttcgatgttccaaggcaccgtggtcagattggaaatggagaccagcacgccaatcaggataatgaagatgggcaggctgaccatcagccggtggatgctggtccacggcttggatcgaacagtcaggcgatgctcttcttcttgcggcacgtgcgctattgtaatctgaccgcgatatttatgccgagggcctattcggccgaatcagtgaccggggtgctggattgggaccacgaccgggccggtggaattgacggggacttgaccgtcggcctccatttgggcggcgatatcgttcgctatggtgagcagcgtgtcgacgatctggtcttcgggcacggtcttgatgaccttgcccttgatgaagatctggcccttgccattgccggaggccacgccgaggtcggcttcgcgtgcctcgcccggaccgttgacgatgcaacccatgacggccactcggatcggcgcggtcacgtccttcaggccttcggtgacggcggaggcgagctggatcacatccacttgggcgcggccgcagctcgggcaggagatgatgtcgaacttgcgggggcgcaatcccatgtattccaagagtttgcaacccaccttgacctcttcggccggcggcgcggagagagacacgcgaatcgtgtcgccaatgccctcggccaagagcgcaccgaacgccaggcaggatttgatggtgccttgccaagcagggccggcctcggtgacgccgaggtgcagcggccaatcgcccttggaagcgagcagtcggtacgtttcgaccatggtgatgacgtcatggtgtttgacggagatcttgaaatcgtggaagccgacgtcctcgaacatgtgcgcttccttcaaggcagaggccaccaatgcttccggagtcgggccaccgtatttggcgtagagttccttgtccagcgagccggcgttcacaccgatacgcagcgagatgcccgcgtcggtggcggccttgcagatgtccgggccgacttcgtcgaacttacggatgttgccggggttcacgcgcacggccgcgcagccggcgtcgatggcctggaacacgtatttggactggaagtggatatcggcgatgaccggaatcggcgatttgcggcagatttccggcagtgcgtcggcatcgtcctgactcggcacggccacgcgcacgatgtcgcagccggcggcggtcagttcggcgatctgctgcaacgtggcaggtacgttggccgtgagcgtgttggtcatcgactgcacggagatgggcgcgcccccgcccaccggcaccgggcccaccatgatgcggcgggacttgcggcgcgggtgcaagggcgattcgctggtcaggtcgaccggatcaccggttttgcggaacggcttttcgatgggattttccgtattcaaggtattcatcattgcttgtttatcaggtcgtcggcgcgtcggcgggcttcaagctcaagctggttcatttcctccacgtccgtgaacagcgggttaccacgaagctcggcgtccatctggtccagcacggctttgaccgtgtccacgatgccgaggtatggcagacgatgctcgaggaaggcatgcacggcctgttcattggctgcattgagcaccgccgtatgcttctcggaggcggccaggcagtggcgggccagttgcacggcagggaacgcctcatcgtccaacggttcaaaggtccaagttgcggcttgcgtccagtcgcacgcggcggccacattggtcatgcggtccggcgcggacaggcccagcgcgatgggcagacgcatgtctgggggcgaagcttggcaaatcgtggcgccatccacaaattcgaccatggaatggacgatggactgcgggtgcacggtcacgtcgatgcgttcaggcggcacgttgaacaagcgggacgcctcgatgacttcgaggcccttgttcatcagtgtggaggagttgatggtgacaaccggccccatgttccacgtcggatgatgcagcgcctgctcgggagtgatgttctccatgtcggcacgtttccagccgcggaacggtccgccggaggcggtgaccacaagcttggcgacttcggcgtgggttccggagcgcagggattgccagatggcggaatgctcggaatcgaccgggttgatttggttctcgcgcacttgcgcgctgaacagcagatgcccgcccgcgactacggactccttgttggccaatgccagctgggaaccggccttgagcgccgcgatcgacggttcgagtccgatggagccggtgatgccgttcaatacgacattcgcaccggagccggccatggcgatgaccgaatccggaccgccggtcacgcggacaccttgtgcgccggcctgtgcgagagctgcttgcagcgctggaaccttggtctcatcaaacaccgcgacttcggacacatggaactgtgcggcctgttgcgccagcagctcgatatgtgctccgcccgccgccagaccggtgacggtaaatcgttcaggatgacgcgagatgacgtcaagtccttgggtgccgatggatccggtggatccgagaatgatgacagtggagttggaggctatgctcactgttccttcttcgtatcgtcattgttcagtgtggggaacgacaggtcggggatatccgaatcgaagttaccgccaagcgggaacagcagcgggaacgaatcgctggaatcgtgcttatcctgtgacggctgagctgcttccgtgtcatgggaggcggcaacgtattcagatgattccgcagccggacgggagatcgtgctgtctgcaggctgactatcggatacgcgaaccggaatggagttcgtgttacgatccggcttgctggtgggagcaaaggagaccggcatagcagcggacgcagcctcgtcagcagtgctattcacaggctgtactgccggggcggagggtgccggggatgaaaccgaacccggtacctcattcaatttcagcgcattcggtgcatcaaggctgggcatcttaggagcgaaggacggtgcatccactgccggaagttcctgagaaaccgcagccatgtgggcgagagcggccaaagaggaatcgttctgcaccatatccacgggctgttccgcgaacaccgacggggtcgatgacggagctgcgggttcgtgagctgcctgtgccggagcaaacgaggggacgctgccagcggtcacaccggaaaccggcgcggacggggcactgacgggaggctcagccgcagcaactgcggtaggagccacggaaggcgtctcggagacgggcttcgccgcagactcgttggacgcatgcaccgggtatgctgcgggagcaaaggaaaccggctgttccgcattggtgctattggtgcttgtggaagcatcgaacgatgcaggagccgacgcataggtgatcggtgccgccgcggccggcgctgcgggagcaaccggagccggagcagtgaacaagctctgctcggcctgatgcagggcatcgaatgattcgtcatgagcaacggcagccggagcaaaacgttcgtcagttgccgggcgctgcgttccggaagcgaacaacggtgagacgccgttcgcttgaacggtcacgttcgtggcggtctgggcaggagccgcaggctcgccggacacgaaatcggccacacgggcataggattccaagcgactcagcaactgtacgcaggcgttcaggaagtaatcgacctgtcgctcgtcatagcctttcttgcccttgcgctgggtgaagatcacattgttgaccgtattcgcattgagatcggccaaagaccgtacatcgtcttcggtaacgccgtcaacgcccaatgcggccgccgccttgtccacaatctggtcgaccagacgatccacctgcttcttatcgtacgaaggctgcttgggcgctccggacttgaagcgttcgcgctcgttacgctccgcatggttctggacttcgtgatacagcttctcggtcttcgccttccacgtcacacgcccgtgctgtgcgatctcccatgtggtctgcttatcgaccacggcacgttccagacgtccaagcgcggcgtcaacctgtgcgatcacatagccgttcttgcgcaaatcaaaggacacgttctgaatgtcatgctgggtgagattcatgccctcgctgtcatacaaagcatgggcgcgctccaggaaagcgtccacctgagcggggtcatacccccacttgcgcttgcccgcacgtgcgatgcccgacttgccgtccccttcacgaagttcctgcgccatcggctattcgacctcctgctggatataaacactctgccacaactttacgtgactattgagacgcatctgaccaagaagaccgaaattcacgattttgtagcagtactgccggtttccttctgcacgcatctcattgagatttcagaacccttgccgaagactgtcagggaatatcgtcacagcctatatccgtggaatgaggggattccatgaagcgatgaaaaatgaaagtgggcaatgagggactcgaacccccgacatccaccgtgtaaaggtggcgctctaaccaactgagctaattgcccgcaaatgacaacaatagcgtatggccagcactgcgcgacacgtggtgtcgcatacgcgtgccgtagcgctcaatcgcaatgacattcagtcacgcccagcagcactacgcagcacacgacgccggtcaacacgcttaaagtcaagcgtattgattgaggcttatcagcggcccttgccgaatgcgcgcaggcggatgccgttccagtccgagctgacggtcagcggggtggcggcgttcataccggcggtctgtgcagcggactgcacggtggacgagctggcggcacccgggcggccgggcttgggagtcagtatccacagcgggccgtcattgcccagtaccgcgtaggcgtcaacgatcgtatcggacaattcgtcctcatcatcgccgtcgcgccaccatacgatgacgccgtccacagcggagtcgtagtcctcgtccacgagatcctcgcccgtgagctcttcaatctgggcacgaatggaatcgtccacgtcgtcgtcccagagccactcctggacgatatcgccgggctcgaaaccaaattcttcagcgttctgtgatgccgtttgattcacaggggacacattagcaagtcttcgcgaacaaatgcgttaacgcggccgaaaatcgccgcattgtgggcagacccatgcgagtcgtctcaccagaaacaacgactggccgcgcgtgtcatgcctcgcaatgaggcaaatcgtcggcctgccccttgccgatggccaccaacgcctgatacgcctcgttcagcgtggcgaccttgacgtcgcgcagaccatccggcacgcggcctgccacatccaaacaattcgacgcgggggccaggaaccatgtggcgccatcgcgcttggcgccaagcatcttcagctctatgccgccgattctgccgactttgccgtccttgtctatggtgccggtgccggcgatggtcttgccgccgctctcgttggcgggggtgagtttgtcgatgagaccgagcgtgtacatcatgcctgcggacggcccgccgatgctgtccacgtgcatcgtcaccttggcgtgttgcaatgcactggcgtcaatgtccagttcgtccgcatgggctttggcatacgccagaccgacggcactggccgaatcctgggaaccggccatgtcttgttcgactttcttctgatactggtccgcactctggcccaccggtaccgtggcctcacgcggcatgacctccacctgcggattgccccaaccccagacggcctgcgcgttgatgatcgggtacccgggcacgccggacgcgttcaccgtggtcagcagcagcttgccggaatccttatacgtcgtcacgccggtaccagtgatgtcgataaccgcaccatcctcaactttgcccagcacatcctgggtgggtccgggcatctcgatgacgtacgggctgggcagcagcagaatcaccacaccaagcaacacggcgaatgcaccgacgaaatggcgtttcgaacgagcggccgcataggcccgagcacggctgattccacgagataggcgcgaatcatgcttcacttcgaacgatggcatgtgctcatctcccgcttccgaatccgcagtcgggctctcctgctcctggacgaggtctggttcctgattcctgtggcgtgcaaacataccctacagtgtaagcggagggccgaaatcggccgaaaacgaacataaaccgaaaataatgctcggccacaagcgaacaggcccgggcagaccctacacttggggtaacacaccgcggcaaagaaggatacgcatggacgacaacgcgattcacgagtggctgatcaaatgcttcggccccattcagggtgagatggcctggcagcagatcagccagttgcctgaggagatccgtgaacagctgatgagtcaggaccccagccgactgcccaatccatctgaagtccagcagatgatggccgcgttcagcgccggcggactcaacacgatgggtgatatgcagcgcactgtcgaggaagggccgatcaacgtcaagctcgccaagtcgattgccttgcagcaggccaacgcctccggttctgcatccagcgtgtccgccgtggatggcgaggcggctcgccgcgcgatgagtgaggcgaacctgtggctggataccgcctgcgagttcaatcccgcacccggcgatccggatgtgctgacccgcgccggctgggtggagggcaccatcgaccagtgggcgaagttcgcagctcctgtggccgagtcgatgaacgacgctttggcttcggtgatttcggagcgtcttggcggcgcgttcggcgatggcgagattgccggcatgttcgccggaccggtgccgattccgattcccgacggtatgaaagacccagcccaactgatgaagctgctgggcaacacgtcctttgccatgcagttggggcatgcggccggcaatctgagccatgaagtgcatggcagcttcgatcagggcatcgcgttgctgaagaacccggctggtggactgattgcccagaacgccaccgaatacgcgaagatgctgaacggtgaggcttctgcggccgaggccgacacggccggcacttcaaccgactcggtcaatccgttctccacatccaccgacgcttctgccaatcccattggcttcacttcggccggcaacagcgatactccggcaactgacggtaccgcccaagtctccggctctgatgcttccgccgatgccgccgacgccgccgcgttcgaggctgcgctctccggattcgagaccaccgagaaaatccccgaatctgaagtgctttccttcctggccctgcaggaaatggctcacgcccgcctgtatgcctcggtaccgtggctgatgccgcgtttcgaggcgctcatcggcaagtacgcacgcggcatctccattgatctggatgcgatggaggaacagctgcgtgacgccacgtcaatggatccggagtcgatttccggcgcggtgaatctcaccaaggtcggcatccccgacactcccgaacagcgcgaggcgctggcttcgctggaatcgctgctggctatggtcgagggctgggtggattgcgtggtgtggcgcgccggtatggcccatctgcctcatatcgaacagttgcgtgagatgatgcgccgcgagcgcgcgatgggtggccccgccgagcgtacgttcgaaagtctgctcggtttgcagctgcgtcccaagcgcatgcgcgaggccaccgggctatgggagatgatcaccgccgccgaaggccctgaaggccgtgacgccaagtggtcgcatcccgatctgctgccttcgctgcctggcgacaagcccgcagatggcgcgtctccgtcatccgacgccccttcaggttcttcttccgatgccaacggttccgcttctcaccctgccgcagatggcaagaccggcgatatcgattgggatgccgaactgtccaagctgctcggcgaagatggcgaagacggtgaaaacggcaactcggaggatacgcaggcatagtcaaccggccttcagccaattcccgctcctgaacgacgttcaggagcattcagtatgcattacagacgcccgtcacaaaaatcgtgatgggcgtctgcgctgcactccataaccatccttggtccgtgcatacgacaaatgcagcgaatcctcagctcgggtgatgcccacatacataagccggcgttcctcttccagcgcatcccccgtttccggcgaaccatacggcaagagcccttccgaacagccgatcagaaacacgtgcttgaattccagacccttggatgcgtggatcgtggaaatcgtaaccccgagatcgtcgtttgcggcaagtccggtggcgtccaaacccatcgcctccaatagtgcgcgtttggacgcggcatcgtcggcgagcgcggatgattgccatcccgaatccttgcggacgcgatatttcagtctcgcagcgcgcaaggcggcaccgaataccggctgttgggcgttgatgcgggtgaggatcgcgcaatcggacggcttggccccgttggcaaccaaccgggctatgcgtgccgccacgccctgtgcctcttccatatcgctctcataagcggttcgggtaacgcgcgggccggattcacgggcggaaaccagtttcaggtaatcctcacggttcggcgcggccgcaagcacccggttggcgaggttcacgacttccggcgtcgaacgatagtcggtgttgagattgacatcggcggcgagcggcccgaattcatcggcgaaacgcagcagatcccagctggaggcaccggcaaacgagtagatggtctgggccggatcgcccacgacgcatacgttgcggttcattgcgctcttgccgtcaggtcctcccccgcccagccacagggtcagcagcctgtgttgcaggggcgagacgtcctgatactcgtcgacggtgagccagccgatggtggaacgaatttgggcggcggcttcgggaaaaccatccatgatatggcatacgagcagcagaatatcgtcaaaatcgatttcgccacgcgaggtcttttcctgctcgtaggcgctgtagacgtcggcgaaccgagcggtgtcgagtccggcgggcggctgcctatgggcgatggcacatgcccgggcataatcttccaccgccaccaacgagattttggcccaattgatttcggcgagcacatcgcgaacggtcagcggatcggcatcggtacgtgcggtggcgcggatgatcgcgcgggagacgacgtcacgctgatcttcgatcacatgcggaaatggagcctcgcatatgtctgcccagacgctgttgagctgatgcaatgccgctgagtggaaggtcgcggccgtgactccggcagttcccgcacccaaaccggaacgtccagtacctccccctacgccgagctggcccaatcgtgcgcgcatttccgccgccgcttttaccgaaaaggtgacggcaagcacccgctccggcttccatgccccggtggcgcaggcataggcgattcgccgcgtgaccgtgcgtgttttaccggcacctgcgccggcgataatgcgcaccggcccttgcaacgtagtcgcggcggtacgctgccgctcatcgagcccctcaagaatcccctgcgcctgttccatgcgtccattgtggcacgattcgcgctcacggcacgactcatgcctatggctgaatcggactcacgacaaaacatcgccagaatcatgcgttttgcgtgtcattctgcggtgcgaatcgccacggatgtattagtgtggaagggtgatgaaacgtagcgattatatgttggcggcactcgcctcagccgtcctgccgaatctgggggtggccggcgtacgcgagaacgtgcaggccagcgcaaccgacgaggccaaaggcatcgatcagaccgtgatccaagatgcctcaggcaagttgtacgacgtatacgccactaataccaaggaagggcgtacgcgtctgattcgccgtgtgaaagcggcgcagacactggcagccgcgcgcgagcctggtggcctcggcttcgatatggaccgtgtggtcgcgttcgccccgggagacgtttcccgacccggccagacggccaccgcacaggccgtggggcagcagacccaggcggagtccacaccgctgaccccgcgcaagcccggtcccacaggcgagacgaccgtgatgattgccgtccaccgtgatggccaggcgcggcctctcgacctgttgacattggatgactgcgcggccgtcggcaccgccatcggagccattcatcgcctgccttcgacttttctggccaatgccaaatatccggtagttaccaccggtcagattcgttcgcagctgaccgcctggattcgccgcttacgctccgccggccatgttccccaagaaatcaccgacagctgggcgcgcatcatggacaccgagggattgtggtcgttctccacctgcacggttcacggcggattttccgacggcgacttcctgttctccggttccaccatcaccacggtgaccaactggcaggatatgcaggtcaacgatccggcacgagaccttgcctggattttcggcaagctcgacgaatcccatcgcaacgccgtgctttccgcatacggccgcatgatgggctctcgacttgacgatctcatcatgctcagggccaacctgtggctgcagatggaacaggtgggcgaattcattcaggcgttgaaccgtgcggacaacgatcacatcatgcagttcaaggcacaggtcgaacgactcgcacaccagttgggcgtgatcaagcacactccggcaccggccccagccgcagggtcggccgccgcctcgtcaacgaagcccggtttgccttccacaatcaccgtcggcacattgttgcaggacgaccgtcatcaggcacccgcacaaccgcagcagtccgacaccggtaccgcggcggccgaggtctcggacgacacgcccgatcccgatcgcaccggttccgctgacatcgtggccgctggcgacgtggatcttaccccggaagtcgaacccgatgctgaccggaccgccaatcacccgcaaacgaatgtctccggcatcgcaaccggtacgggatcgaccaaaccgcagccctcacatggcgcttcccattcttcggtgacgatcacgctgaaggagctcctcagtatgaacgggcatagcggcacgacgtcaaccgacgcttcccctgcgtctcaatccgccgccccgaccgacgatgcggtgaatgacgatactccggacagtctcgttcagtacggagcctcgagtgcccaaaccacggtgattccgctgttggagcgggaagaacgcgctctgcgcgatgcccgtgccgggttggacgggtatgacagcgagggcaatccgctggccgaatcgtccacatcatccaaataatgtcgtgtgcggtgttccgcgccacgccgagcgcgtaacaccgcacatgacgacgcagacacgcggcacaatagagtacagaacctcggccggcgacggccacttaccatgatgttcgtcacaaagacggcagaacaaggagccttatatggatatcgaactgggcattcagaacgtggcacgaccggtgaacttcagcaccgacgaatcagccgacaatgtgagccaggccatcgcgcaggccgtggccgacaacgcgacgatcgatctgaccgatgacaagggccgtcgcatcatcgtgcccgccaaggcactcggttacgcgatcatcggctccgaaaccaagcacgccgtcggcttcggcacgctgtgaccatgaatcgcgcataagcggccttgggcattatctcaaggccgcttttgtattgctgaatcaccgatatagcggaagcacgccgcgatgaacgatctcttcgacagtggcctcgtcggtgaggttctcccccagtttgttcggtttgcctttgccatgccagtcagacccaccggtgaccagcagctggtgccggcggcagatggtgagcagccgttctcgttgctccggtgaattgccacggtgccatacctccagcccgtccagtccttcgctgatcaatgcctcgatctggtcatcggacaacagtctgcggttacggctcacatcaccggcatgggcgatcagaatcacaccgcccgctcccttgacggcggccaccacttcatgagaggtcggcgaaggcgtgggaatatagtatttggatgaggcgctgaccgcatccgcaaacgcttccgaacgagtccgatatacgccggcactcaccaaagcatcagcgatgtgaggccggccaatggtggttttgctaccctccttgacttgggcgagcacggattgccaggtaatcggataatcacgagacaacaattcgaccatgcgctgcgtgcgttgcaaccgtgcggctcgagtattggcgaacaagtccgcgatgtgctgattcgtgggatcatactggtagccgagcatgtgcacggagacgttctcatccgtggcggtgatctcggtgccgcggagcaacggcaaaccgaccctatgagccgcggcttcggcctccggccagccggcggtggtgtcatgatcggaaatggccacgcccttgagtcccaatgccttggattgttcggccaacgtggccggcgtttccgtgccatccgagaaggcggtatggcagtggatgtcccacccgacggcgggcggttccaaaggcatcacatatccagtcataccttccatcgtaacctcatttcagcattcccacgcaaggcgcagacaggtcgtcaccttctgccaacggccgaaaccagacattcggcacccagctgacaaccgcagaggctaatctggagcgcagcgctatcgaaagggacatgatgactcgtaacaccgcaaccgacacatcatccagcaccacgaacaccacgccgcttggcttggcggaggcacgaccgttgattggatggcgccacagtgccacttggacatatctcatcatgctgattgcctcggcagtggcgttgggggcctcgctcattctgtccgctgagactttgcaattggctcggcatccggagtccgcactcggctgcgatctgaactcggtggtgtcctgttcggcggtggcccagtcctggcaagcggaaatcgcgaagttcggcgggctgagctatccgaacgcgttcttcggcatcgccgccgaatcggtgttcattaccatcgcggtgatcggtttggcgcgtgtgaaggtgccgcgttggttcgcgacctgcacgtggctgggcggactggccgctttggcttactcgtactggctgagcacgcagtcgctgttcgtgattcacgcgctgtgcccgtggtgcctgaccctgatgttctccaccaccatccagttcatggcgttgagccatgcgaccgtggccgtgcagggattgccgtcgcgtaaggctgtggcggctgatgatagcgacggtgaggctgaggtcgcggcggtgccggccggactcaataagtattaccgcctcaacatcgacctcatggtcgacatactgtggatcgtggcgatcgtggtactcatcatcgtcaccgaaggcgcggccctgttcgctgcctgattcctttacaacaaatcgatatcggcgaccagcgtggctgctccggtcagctttacgtcgctgtcggtgacgtccacgcgcagggtgccgccacgtacggtgatgtcccagtggctgatgccggtcttggcccgcagcacaatgcctgtggcgcacaggccggtgccgcaggacagggtttcgccgcagccacgttcgttgacgcgcatcgtggcttcacccacgccggtgctctgatcgatgtcgtcgacccgcacgaattccacgttctggtcggattcgatgaccggagccaccactggtttggtgaccaaatccagtgattcaaccactggcagggacgcgaaggcatcctcgatcaccgcgaccacatgcgggttgcccatatccacaaacgtaccgcgcgccgagccctcagtgccggggatggtgacctcgtaggcgtcggtttcgccgatcttccactcccccatttcgacctggaacacgttggctccgtacggcctcatattgccgcgtggcgtcagaatcttgacgccggcacgggtgccgaggcggaacggctcggtggagtcggccaccccctcacgctgagcgaacaaggtgatggcgcgtgtaccgttgccgcacatctccgccaacgatccatccgcattgcgatagtccatgaaccatttcgcgcccccggccagtacgtccgaaagctgatcatcgcttaaatcagacacgaaatcaggccgtgtcaggcgaatcaggccgtcaccgccaatgccgaagtgacggtcgcacaggaatcggacctcatcggcggtaggctcgaatttgccggacttgtcgaggtataccacgaaatcattgccggttgcgtgtgtcttggttactcgttgcggaagactcatggctttcagagtactctagggagcgaaacaacaccgcaaaacaatcggctttgtgatcggtcgcggcaacatacggttgcagtcatggctatagggaggattcaggcatgagctcttcggctccaatcggcgtattcgattcgggtcttggcggtatttccgtggctcgccaaatcgccaaggatatgccggccgagcatgtgctgtattttggtgattcggccaacgcaccgtacggcatcaagacgcctgaacaagtgagggccctgagtttcgatattgtcgaacggttcgtgcgtcaaggcgtcaaggccgtggtcatcgcatgcaacaccgccacttccgccgcggtgaacgatttgcgcgaacactacgatattccgatcatcggcatggagccggccctgaaagtggcgtgcgaccgtggtgacgtgccttccgacccgcatcatattccccagagggtgattgtggcggccactcccctgaccttgcgtgagcggaagttcgccaaactgatggatcgattcgattccaacaacacgattttcaaggagccttgccccgacttggtggagatcgtggaatccgggcggctcggcgaccatgacctggtgatgcgcacgctgcacggctacttcgaccagtacgacatggagcatatcgactcggtggtgctgggctgcacgcatttcgtgttctaccgcgactacttccgcgagctgctgcccgaacgggctgctgtcatcgacggcaatgagggtaccgtgcgccatctgggcgtggtgttggagtccctgggcaaactggcacccgaagacgcgaccggcggcgtggagctcgccaattccgatccgtccgaacggattgccgagttgtcacgcaaattgctgaacgtatgagccgttcttggctcccctctctgagggaagccaaggaagaaccagacaaattcacagcacactgcccatatcgttgtccgtgcagcacgcgtaagctcataccagattcaagtgaacagggggttggtatgacaaagacggcgatgattgatgtcggcggcgggttccgcgcgattttcggctgtggtgttatggaccgcatgctggaggacggcatcgacgtggatatgtgctacggcgtttccgccggcgcggccaatatgacctcattcatcgcacgccagcacggccgcaaccacaccttctacaccaagtacgccttccgcaaggagtacgcgagtgcggaaagcttcttcaagaaccacaactttgccaacctcgactacatctacggcacgctgagcaatcacgatggcgagaatccgttggatttcgcggcgttcgaggccaatgagaccgggttcaccgtggtggcctgcaatgccgaggacggctcgaccaagtacttcgacaaatcgcgcgtgcgttttgatgatttcgacatcatcaaggcttcgtccgccgtgccggtggcctgcgagccgtatgtggtggatggtgtgccgtatttcgatggcggcatcgccgatccggtgccggtgcagaaggcgctggaggacggctacgatcgcgtgattctgattctgtctcgcttgcgtgacgaagtgcgcaagcagcagaaggatttggctccggcccgcatcctcgaacgctcccaccccgccgcggccgagaagctgcgcatgcgctacaagacctacaacgacgaactcgaactcgccaagcattacgaggcagaaggccgcgtgctgattctcgccccggaagacctctatggcctcaacaccctaaaaaagaacttcgagggtctggaaatgatgtatcgcaagggatacgcggcggccgaggccattccggcattccttcaggcatagcgatagtgaagtccctcgcttggagggacttcactatcgatggatggggattcgcaaacggggtgattacttcgtctcggaagcggtgagcatggccttggtgacctgctcgtagagatcctgataaccgccgggcgtggaggcgggcagcaccacggtcttggtgttgttcgattcggacagcgagcgcatcacgtcgaggtactggttgaacagcaccacgttgttcacgtcgttgatgttcatgcccacagcctgcagactcttgatctggtcgacgataccgttggcgatctcgcggcggtaattggcctggccctcaccctgcaagcgagtcttctccgcatcggcggcggcttgggtctcgatctggatacgctgggcctcggcacgctgacgggtggcttccttttcacgctgggcggcattgatggagtccatcgcgttcttgacctgtgggctcgggtcgatggcggtgatcagcgtcttgaccacggtgaagccgaaacggctcatttcggcgcccacggtcttctgcacgtcgaacgccacatcgtccttgcgagcaaaggcatcatccaaagacagtgcggggatagcggaacgcagcgcgtcctccatgtaggagcgcagctgaccggccgggtcacgcagctcgtagtaggcggtggccacatcgttcgggttcacgcggaactgggtggaggccaccacggtgacgaacacattgtcaagagtcttggtttccagctgcacgttaagctggttgacacgcatgttggttttcatggcgatgcggtccacgaacgggatgcggatatggatgccggcgaactggaccttaaggaacttgccgaatcgctcaatgatgtaggcctgctgctgcggcacgacgaagagtgcggcactcagcagcacgatgagtagcacgatgataatcagcggaccagcaaagaatacggccatgatgttttcccttcacccacgtcggaaccgccctcggcctcgactcgtgatttccatcgtatcagcgttcaaaacaaagcggtagacatcgtacgcatatgtgtacaactgttcactatgtgtgcatgctggcttcttataaaaaagtgcggcatccaatcagtatgctgcggccatgcctgagccgacagccacggcgccgataccgtcctccagcgcggcaagccgcttttccagtgcatcgacagtgggattggccacacgggagtactcgaagccgtcgatgtcaccgcccgcgagcgcatcgccgcgcgccgcgtcacccaggtcgaatgcggccgaggcatagattggcggcacagcggcacggccgttatccagcggctcgtagccggcgtggatggcttgcgttcggaaatcaacgtccattaatccttcttcctcatgccgctctattgtggcgggctcgactctattcccgaacttagcaagtcatggtacgcgacaccggcacatcggtatcgcaattgtcaatgcgcgcttataagcaatggctatagaatatccgccgaatgccggaacacaccaagctgcccagccctctttcagcacctcggccgcaatattacgctgcctcaaataattcaaagccgcgtcaatccgtaccggttcaccatcgaaaatggccacgatgccccctatcggggtatccgcgacgatgtcgatatctccaaagattatgttgacatcgatgccgaaccctttagtaatttgcgacaccaacgcttcagaaacttccttggacacatattgcatccggaccaatcgttgaccttcagacaatctcatcaaaagggagtcatggttctcttttcatatctggcgataacgcatatcaaatcagcaatcagcgcaaagacgctcggtcactccatccggataacaactttgccgtttcgcctaaggtgtcgatgacatggtcaaccggtgcgtcagaaagagcttcagcatagttctcgatgcgatagtcgaaataacgatcggcgcccagcgcgctgctctccgaaagcaccgggacgaacgccgtcagcattcgtaacgccttgggagcgctcaaacgcgcggggctcatcacagtggcacgcggaaccggcggtgccgaacttgcccgcaccccccaaggaaatcactctgctcgatatctatcaggcagtggaatccacgaacctcgatgatgtgatcggcatccacgagagaggaaatcacacatgccccgtggctcggaatatccacgacgttctcaaagatgcgtatgctccagtggccaaagccatgtcggattccatgagggaagttacgcttgccaatatgcttgccgactaccgaaatcgcattggggtcaaagcccggcaactggaacagtagtgggcaccgaagcgtaagccccctactctctgatccgcataaacagataagacgtgcgccatcaagaccgatcgatgacgcacgccttatgcagctcagaccacggattcctagtcagccagcagccccagctcctgcagcttgttcctgatatccactgcagagggttccacttggaacgagccgtcatcgtaccgcaccaccggaatgtgcatctggccgctgatcgccacggcacggtcggcggcaccttcctcttcctcgatgttgtgccaagtgtatgccgcgcccagtttgtcgagagtgttctttgcctggcggcagtcgccgcaccatgtggcaccgtagacgtcgatggtcatatcaggtcctttctttgttccgccgcgcttgacttttacgcggtgcactatcaaaccgtattcatcgtaacggggatgctgtgatatcgcggttggcataatgcgggcggtccgcttaaccaccccagtcggctacgccgacagccctctgccagcggaggcggaaccagagcataaaaaaagcggcgccggtgtggcacaaccgacgccgctccccaggagtagaaaaataggcagaaaagtattagatcaggcaaacaccccgaagtcagctgttggaacacgtcgaagtcggcatgccgatcgatgtaacgggcgtaagcgatatcgaacgcctggccgagatcttcgatcagatcgttggcgtcctcgatgccaacggcgagacgcaccaattcatcggtgatgccgatcttcagacgctcctcgcgaggcagttcgaaatgcgtcatacgacacggcagctcggcaagagactccaccgcacccaacgacacagcaagacggaacaggtgcaggttgttgagcacgtcagccggatcaacgccaggcacgacctcgaagctcaacacgccaccgacccccttgagacctttggcagccagacgctggtcgcctgcgccgggcagacccgggtaatgcaccgccttaaccagcggatgcaccagcaggtagcgggcgatggcattggcattctcctgctgacgatccatgcgaagggccagcgtctgaatgccgcggcgcaccgcgtcgcactcagcaggagccaacacaccacccaaacggttctgcgcgaagtacacgcggctcgccagatcctcaccggaaacgaccaccagaccggcgttcacatcagaatgaccggccagatacttggtggcggagtgaatcaccacatcggcacccaaagcaagcggcttctgcagatacggggtcacgaacgtgttatccacaatcgaaagcgccccgaaacggtgggccaccgtggagatggcgcgcacgtcgttcaccttgagtagaggattggtcagggtttcaaagtagacggcttgggcaggcacgatgccgttcgcgcggtcgcccttgacggcggcctccaatgctgcgatgtcctgagtgtcgacggcctcaacgatgattccccagcaagtgaagaactcattgagctgggaatacgatccgccataaatattgtcaccgaccacgatgcggtcgccgggcttgaaaatgctcagcaccgcgtggatcgccgcgagaccggaggcgaacgcaaaaccacgcgttccttgctcgagctgggcgatctgctgttccaggaagtcacgtgtgggattgccgctgcgcgcatagtcgtaacggggcatcgcgtcgaccctctcgaaagcatatgtcgttgaattgtagatcggcgggttcacggctccggtgttgttgtctccaaccggcagtccgtggacgagctgagtattgaacctggtcattgcgcacccccttaaagtgttgcgtcatctgcgcgaagccgttccccgcgcggcacgattacgaccttaacgcaaaacgccggcccgaaggccggcgttgctatatgtgttggttatggacgggtataatcagacctctccgtcctgcaagaatggacggcctgacgaccggcccaacacacctcgccgctgccgcggctcggcgtcgcctacggacagtccaccggactgtccgtcagacggctccgccttctaccacgatgtcatcggggttgacttcgttgccgtagaccggctccagagtctcctggtaatccttgtggaagaagttgtctttgccgagcttgacgatctcgtcgttcacgaagttcagcagttcggtgttgcccttctgcactgcgggcgcgatggtgtcgtcgtcaccaaggtgggtgatgccgaccttgaagcccttgttggacttggcccaggcgagcacctcggtgttgtcggtggagaaggcgtcaccacggccgtccagcagcgcgttgtaggcatcggcgtactggtcgtacttctgcagcttgacgttcggcgcgttcttctcgaaccaggtttcggcggtggtgcccttagcgatgatcagggtcttgccgtcgagctggctgacatcggtgatctgggcgctctccggggagaccacaccaagcgccaccttcatgtacggcttggcgaagtcgactttctccttgcgctcatcggtgacggtgaagttagcgagcaccagatcgaccttgttggaggtgagcacgtccacacgggcagccgggtcaaccgacgtgtattccggatccacacccagatccttggccagctgttcggcgaagtagacgtcatagccctggtacttgccgtccttgtccacgtagccgaatggcgccttgtcggagaagacggcaatcttgatcttgccgctcttcttgatctcgtcgaggctgcgggccttggcattggcgctggagctggtgccagtgtcagaggacttcgcttcgctcggggtgcctgccgacggaccgcatgcggccatggacgccgccattaccaatgccgcgcctgcggcaatcagtgctttgaatgatttcccaaccttgatactcattgggttctccttctcttgttgttattgatatttcttctcaaatacgtcgatatgacacaatcgaatcactcgaattcgaaggtgtgcaggaactgctgcgcacgttcggtttgcgggtgttcgaagaacgcctgcgcatcatacgattcctcgacgatgtgcccgccgtccagcaagatgatgtggtcggcgatggctcgcgcgaactgcatttcgtgggtgacgataagcatcgtctgcccggacttggccagttcgagcaccacgtcgagcacttcacgcaccatttcggggtcgagagccgccgtaatctcatcgagcagcagtacttccgggtgcagaatcagcgcacggcaaatggccacacgctggcgctgaccgccggacaattcgtgcggccaagagtccttgcgatcggcaagtcccacgcggccaagcaaccggatcgcttcagcctccacctcggacttatcgcgtttctgcacgagcaccggcgccatggtgatgttgccgagcaccgttttattcgggaacaaatcgtagctttggaacaccatgccgatacgcgtgcgcagttcactggaccggtcggatcgtccggctcgttccgtgccaggcttgccggcatcgatcacctgattgttgatggaaatcgtgccgccctgaatcggttccagaccggcgatggtgcgcagcagcgtcgacttgcccgagccggaaggacccagcaccacgagcaccgaaccatgctccaccttgaaggagatgtcatccagcaccggcttgtcggcattcgcatactgtttgaccagatgattcacctcgaaacccttgcaggtcgtttcgggttcagtcattcgaccacctcttttccagtcggcgggccacaatggacagcggccagcacacgatgaagtacataaagaaaatcacgccataaatccacaaggttccggtcgggaactggaatcggttcgcgtcgataatctgctggccgaccttgatgacctcgaccacaccgagcagcacggccaatgatgtcgttttgacgatacgtgtcgccaagtttacggatgccggcagcatacggcgaacagcctgcggcagaatcacccgggagaaggtctgccacgggctcaaccccagtacgtagctcgattcgtactgcactttgggaatcgactgcaatgcgccacgcaccagatcgcccagctcggcgcctccccacaggatgaacaccagcacgcaggcaccggtggcatcgagattccaatcgaaccatcgagcaaaaccgtagtaggcaaggaacagcaacgccagctgaggcataatgcggatgaagtcgaggtagatgcgcatcgcggcccggatcacgggattcttcagtgtcatcaaccagcccatcaacaggccgaccgggatggacgcgcctacggatacgccggctatccacacggtgacccacaggccttgcaacagacgtgggaatacgcctggctggagcagtatttcagcgccgctcataatcgaacctccgctccaaccatgtgccgaagatggaaatcggcagcagaatcaccagataggccacgaccagcatgaacaacgactcataggtgctgtaatacatgccgatcagatccttggccatgtacatcacgtcggcgagcgcaatggcggagacgacgctcgattccttaaacaggaagatcacattggccactacgccgggaatggcggtggacactgcttgcggcagaatgactcgggtgatggtttgcgtggaagtcagtcccagcacgtacgcggtttcgcgctgcacgttgggcaccgcttccaatccgccgcgcattgcctcggccatgtaggaaccgcccaagaatccaaggccgactatcgcgcaggtttcggcggaccatactacgccgagtttgggcaggccgaagtacagaaagtacagctgtaccagcaatggcgtattgcggctaagttcgatgtagattctcacgatttgccgggcgaccgggatacgcgcgatttccacgccagcgcagaccagacccaccgcgatggcaagcaatatgccaaacacggatatgaataaggtcatcaatgtgccgttgacgaagaaaggcgcgtaacgctgcacgaacgaccaatcgaatgtcattggacgcgctccctcctttgcttctcgtttcttctcctgcgcataaacggtcttagccacccatgtacgatttcggggccgaacatacctgtcccccctgccgtgtcatcgtagagtatcagaacacgtggcacggccgctgcgctatacgcattacttatgggacgttactcgatgggcgaacatcagggcattattgtcgcccaaacggtggatacactgaggctatgaagatcaccaaagctctgacccgtttgaccggtcccgaaaccgctccggtgttcgtgctgttgcacggctggggttccaatgaatacgatttgcccgatctgctgaactattgcggtgccggttcggctgattatgccagtttgcaggcacccatcgcctatggcatgggatatacatggttcggtgcgtgggcgcatgaaggtgtgccggagggcgaatcattagacaagcaggcgactgaagccgcccaagccattgatgcatgggttgcggagcatattcccgccactcggccggtggttgccatgggattctcgcagggcggcctcttggccgcgcatcttttgcgatgcaatccgcaacggtatgcggcagcggtctcctgctccggctggttggctccggggccggtctctggagacgccgagctggctgcgttgaagccgccggtgttctacgggcatggtgctgcagacgacatcttcccgaaagccgatgtgacggcgatgggtgagttctggcacgagcacggcacgttgaccgaacaagtgtatccgggcatggcccattccattaatatgccggaaatgcgcgatattcaacggttcttggagaccaacggattcattcggccgcagatttggtagtcaccacctcacatggcgtagtctacgtgggcgaattcagggaccttataccatttgacggggtagccggcaccgtgggcgcagaagaccgagtcggggtgttgtccagatctgcttcgggatcgtaagcggcggctgcgatgatctgttcggcgtcatggcatggcttgtagccgccgaaagtggcggagaaacggccatggccgtgcgtgtactggttcacgtccatcgcatagtcgcgcatctcggacaccggcgcctcgccttcgatcacggcgtattcgccatcggtgaccggggattcgaaggtgccggccatgcgctggatgtcgctcatggcacggccgatcatgtctgctggcacttcgagccggaaccggtaccacggttccagcagtcggcagttgccctcccctgcggtgtccggacggctctcgaccggcgtctcgggccggccactgactccagctctggcttccataagcccctgacgaatcgcacgataggtggcttggcggaagtcgccgccttcggtatgcttcagatgcgcgcggccagccaccaaagtcatcttgatatcggtgagcggcgcgccaacgagcacaccgagatgctcacgctcggtcagatgggtcagaatcagccgttgccaattgcggtccaaatcgttttcggacagggccgaggccacagtgactccgctgcccggctcccctggttccagcaggatatgtgcttcggcataatgacggagcggctcgaaatgacctgcgccttcgattggcgcagtgatggtctcacggtacaggatggagccggggccaaacgacacatccagaccgaaccggtcgtgcagggtctgctggatgatctccagctggactgcgcccatcaattgcacatgaatctcggccagccgttccacccacaccacatgcaacaacgggtcttcgtcttccagctcacgcaatgcggtgatgaccttatgcaaggtcagatcatcgaactggggacgggccggcgagctattgtccgccgcggtctggcgagcggtgtcgttctcctcattgcggccggttcccgacttggcggcatcatgctcggcatcgtcctgattcacgctgttatggccggcgccaccgcgtttggccgctcccgaggtgccggccgtatcggattccgctccggcgggcaacaccgtgtaggtcaacacgggttgcagcgacggtgattcggcgtccggttccgctcccagcccttcgccggggaaggtccgcgtcagtccggtcaccgcacacaccgatccggcaggcacctcggtgaccgtctcgaatttggcgccattgtagacgcgcacctgatcgactttctcggaccataccgtgccatcatccccctgtaccggcgacggtgctgatgacgccgcagcgcacgaggatgaagagacgatctccttggctttgagcgcaccaccggtgacgcgcagccacgtcatacggttgtgctggccgtcgtgggcgattttgaacacgcgtgcggcgaaggcggccggccattcacgttcgcgggtgaacgtctccagcccgtccaggaattcctcgaccccttcgagtttcaatgccgagccgaaatatacggggaacagttcgcgtacggcgatcatcgctcgcaatctgcccacggacagcgcgccatgttccagatagtcgttcatcgcctcctcgtccagggtggcaatgtcttcggcgaacgcgtccaacggtaccgcgctgccctcagtggactgctccattgccggcagcggatatatcgcatcgctcaggcgtttgcgcaactgtgccagaatggcctcgcggtcgaatccggcggcgtcgcacttgttgacgaagatgaacgtcggcacaccgtatctggccagcagacgccatagtgtctcggtatggccttgcacgccatccgtgccggagaccacaagaatcgcgtaatcaagcacacgcagcacacgttcggtttcggctgcgaagtccacgtgccccggcgtatccagcaaggtcaggcgcaggtcgccgtgttccaccaatgcctggtgcgcgaaaatcgtgatgcctcgcgccttctccaaggaattggtgtccagaaacgcatcgccgtgatccactcgccccaatttgcggatctcaccggtacggtagagcagagcctcggacagcgtggtcttgcccgcgtccacatgcgccacgatgcctgccactatctgtttcatcagctgtgctcccttcccgatgcgccgcgcaattgccggccgcctaaccaatatatccgagaaaatccgggagggaaaaattgtaccgacagaccgggctgccggtacaataagtcaccgaacaccgactgatatgaggagcctccgtgaccacttccggcattaccgttttcggccaaccatcccagcccaatcatggtgccggcgggcgaatcgccatggacgatgccgtcttccccaccgattatgtggcgctggatttggagaccaccggcttttacccgaacagttgcgccatcacggaaatcggtgccgtgcgcgtgcgggaggggcatatcgtcgatcaattccagcagctggtgaatcccttgcggccgattccgcgtcagatcaccacgctgaccggcatcaccgatgcgatggtggccgatctcgatccgattgacgaggtgcttccccgattcatcgcatggctcgctaccccggctgccggtcccgccgttgagccgattgtcggccataacgtcagcttcgatctgcgattcctggattacaacacccggcatatcgccggctgcggctttgcctgcgcggattatgacacgatgcagatcagccgcgccctgttccccgcgcagcggcatcaccgtctggccgacctgatcgtacgcttcggcatcgcggacaatgaggagcaccgcgcattaagcgatgccatccaaacccagcagtgcttcgaatggatgcggcattacgtcaccgagcatcacgaaaccgaagcaatccgctggaagcaggcgccggccaaaaacagcgccgaaatcctccaccagcagttggtggtaaagaggtagtttacagcccgtattccttggcgatgacggaccagaggtcggcagcggcctgatcgacggtttcgttgacgatggtgacgtcgaattcgctttcggcggcgagctccaccttggcggtctccaagcgacgggcctgctgttcggcggtttcggtgccgcggccgatcaggcggcgctcgagctcttcgaagcttggcggcgcgatgaacacgtacaccacttcgaggtcgagctcggcggcgcgctgcttgacgcggcgggcaccctgcaggtcgatttccagaatcgtgggcacaccggcggccagatgttcctccacaggcttgagcaatgtaccgtagtgggccatgccgtgcaccacggcggtttccaggaactcaccggccgcttcgcgggccaggaactcgtcttcagtaaggaaccaatagttgacgccatcaacctcgcccgggcgcggagcgcgtgtggtggcggagacggacacccacacttcggggtggtcggcgcgcagcttggcttccacggtgcccttacctactgcggtggggccagtcaggacgattagacggccagcatgggtgttttcagtcatgggttcctccggagatgatgtggtgtgcagcgattatgaatccaatgtggtaacggctcaccggcgagatgaccggtaactgctacagccccgacgaacagggaagaatatgaatcgtgatgcgacgtacgcgatgagatagacacgtacgcatgccgcgacatctgattccgttctgattactggttttccgagccttcgacagtggcttccatcagcgcctgacgtacgtcaagcgcaatcgactcggtggcttggctcagtgcggcgatatccggcccatgcgaggcgatgaagcgggacacggtgaccagcacgttgccgcgcgtaccgcggaacacggttttcagatccttggcctcggcaccctgccaaccgtaaccgggggaaagaatcggaccggtgaacttggaggggtccacgccggaatcctgcatccattggccgatggtggcaccgatgatcagaccaaccgagcccatgccttcgatatccacgttatgcttctgcgcggtggaggcgatgccgtaggccacggtacgtcccttgtaatcgccgctctggcgcaacgcggtctgcagactcatgccttccgggttggaggtcagggaggcgatgaacacgccgcgtccgttttccagcgcttcggtaatcaggccgttcaacgaacgcgcgccatagtacggcagcagcgtgatggcgtcggccagcaacggtgcaccgggcttgaaataggcgtctgcgatggcggaaatcgtggtggacaggccgccgcgcaggcaatcgacgatggtgatgacgcccatttgtcgtgccgcgtagagcacgcgctcgagcgcttcgaaacctttggctccgtagcgctcgaacatcggcgtctggaatttgactgctgcggcgcgcccgttggcggcctgcagcatacgcatggagaagagttcggcgccttcggcgtcgacgttgtatccccagtcggtgaggagcttgcgatgcgggtcaatgcccacacacagcggcccgtatttggccattgaattgcttaatcgcagaccgaaatccgaacgttgtgcctgcaattcctcactgctgagtgtagtcatcagaactcccgtcgctccaattcgaacagctgcttcgaatgctcctgaatgctcatgatctgataatcattatgcttcacggcctcgatagcgagcagtgcggcctggaactcggtgatggtggtgaactgcggcagatcggcggcaatggcggcggcacggatggagtagccgtcggaacgggagccgcgcgagttcggcgtgttgaggatcatgtcgatcttgccttcctcgatgagctgaaccacgttcttgcccacggatccggcagcgtgatgcacctcgaccggggcttccggatcggtgtccacgcgggtgctgatcttgtccacgatgttcgactcgatgccgtaacggcgaagcacggaggcggtgccctcggtggcccagagcttgaatccaagctcctcgagacgaacggcgatcaacggcagctgacgcttgtcggtgtcgttcacggagatgaacacgttgccgtgggtcggcaggccaccgtcgtaggcggcgagctggctcttggcgaaggcgtgcgggaagtcacggtcgaagcccatgacctcaccggtggaacgcatctcaggtccgagcaggatgtcgacggtcttgcccaccggggtgcggaagcgcttgaacggcagcacggattccttgaccgcgacctgctggccggggtggatgtcgccgccgtcgcccttaggcagcagcagaccgttggcacgctgatcggcgatggtttcgccggccatgatgcgggcagcggccttggccagtgccacgccggtggccttggaggcgaacggcacggtacgggaggcgcgcgggttggcttcgatcacgtacagcgtgttggccatgaaggcgtactgcacgttgatcaggccctgcacatggcagcccttggcgatggcgtaggtgccttcacgcaggcgacgaatctggtcgtcggacagggtggacggaggcagggtgcaggcggcgtcaccggagtggacaccggcctcctcgacgtgctccataatgccgccgatgtatagttcctcgccgtcgaacagtgcgtcgacatcgatttcgatggcgtcttgcaggaacttgtcgatgagcagcggggaaggcaggcggccggagaccacggtatcggccttggcctcggcaagtgcgcggtccacgtacttgttgagctgcttgtcatcgtagacgatttccatgccacggccgccgagcacgtagctcgggcgcacgagcaccgggtaaccgatgcggtgggcggcttccttggcctcttcgaggctcagggcggtgccgtaacgcggggcgttcatctccgccttcttgagcacttcgccgaacagctcacggttctcggccaagtcgatggattccggggtggtgccgagaatcggcacgccggcggccttcagacgcgcggccaaggacagcggggtctggccgccgagctggacgatgacgcccttgaccgggcccatcttcttctcggcctcgtagatctcgagcacgtcctcgaaggtgagcggctcgaagtagaggcgatcggacatgtcgtaatcggtggacacggtctccgggttgcagttgaccatgatggtgtcatagtccttgccaagctcctgcacggcgtgcacgcacgtgtagtcgaactcgatgccctgaccgatgcggttcgggccggagccgaggatgatcacagcctcgcgttcgcgcgggcgcagctcggtttcgtcggcgtagcagctgtagtagtacggcgtggcggcgtcgaactcggcggcgcaggtgtcgacggtcttgtagaccgggcgcagaccgtaggtccagcgcagttcgcggatggtgttctcgccttcatcgcccaaaccacgcaggtgggccacctgcacgtcggacagaccggcgagcttggccttcttgagcagcctcggggtgagggtttcggcctcgcgcaccgtcatggcggtctcattgatgaggaagatctgcttcaggaaccacgggtcgatcttggtggccgcgaacacctgctccaacgtggcaccgccccagatggcgcgcatgagctgcaggtaacggtgttcggtcggggtgtggatggcctcaagcagttcggccacttcttcggcggacggcttctcgccatcccaattgaagcccatgtggcgcttgtcgatggagcgcatggccttgccgagggactcctggaagttgccggccagggccatggcctcgcccacggacttcatggaggtggtcagggtggggtcggcgcccgggaacttctcgaaagcgaagcgcggcaccttggtgaccacgtagtcgatggtcggctcgaaggaggccggcgtggactgggtgatgtcgttgcgaatctcgtcgagcgtgtagccgagggccagcttggtggcgatcttggcgatcgggaagccggtggccttggaggccagtgcggaggaacgggagacgcgcgggttcatctcgatgacgatgatgcggccggtgtccggatgaacagcgaactggatgttgcagccgccggtgtccacgcccacgccacggatgatggcgatgccgatgtcacgcagcttctggtattcgcggtcggtcagggtgaagcagggggccacggtgatggagtcaccggtgtgcacgccgaccgggtcgacgttctcgatcgggcagacgaccacgacgttgtcgttgcggtcgcgcatgagctcgagctcgaattccttccaaccctcgatgccctcttcgatcaggacttcgtcggtgggcgagtaatggatgccggcgccggcgatgcggtgcagctcctcctcgttgtgggcgatgccggagcccaggccgcccatggtgaagctcgggcgcacgaccagcgggtagccgaacttctcggcgatcttgtcgacttcctcgatgctgtgggcgatgtcggagcgggcggattcggcgccggcctcgtcaacgaccttcttgaacagttcacggtcctcgccacggtcgatggcttccagggaagcaccgatcagttcgacgttgtacttctccaggacgccggcctcgcccagcgccatggcggcgttgagcgcggtctggccgcccaaggtgggcaggagcgcgtcggggcgttccttggcgatgatctgctcgaggatcggggtggcgatcggctcgatgtaggtggcgtcagccatctccgggtcggtcatgatggtggccgggttggagttgacgaggatgacgcggatgccttcctcacgaaggacgcggcatgcctgggtgcccgagtaatcgaactccgcagcctgaccgatcacgatcgggccggagccgatgaccatcacggatttgatgtcggtgcgcttcggcatatcacttaccttccttggagttgttcttcataagttcgcagaaacggtcgaacaggtaggccgcatcgtgcgggcctgctgcggcctccgggtggtactgcacggagaatgcggggatgtccacgcactgcaggccttcgaccacgtcgtcgttcagatcgatgtgggagacgaacaccttgccgtacttgccgttttcaaacggcgcgtcgacctgcttgccgatcggggcgtcgaccgcgaagccgtggttgtgggcggtgacctcgaccttgccggtggtcagatccttgaccggctggttgatgccgcggtggccgaacttgagcttgtaggtgccgaagccgagtgcgcggccgagcagctggttgccaaagcagatgccgaagaacgggtagccggcgtcaagtacctggcgcagcagctcgatttcgggaccggcctgttccgggtcgcccggaccgttggagaagaagacgccgtccgggttcaggttctcgatttcggcgaaggtgatggtggagggcaccacgtgcacgcggcagccgcgttcggccatgcggtgcggggtcatgcccttgataccgaggtccacagcggccacggtgtacagcggctccttgccttcgtactcgccgcacggttcgatggtgtaggtctccttggtggacacctcgtcgtacaggctcagaccctgcatctgcggggtgttcttgacgtcttcgagcagctgctcgatggtcttgagcgcgccggtggcctgatcggtcagggcgtcgccggagaagatgccggcgcgcatcacgcctgcggaacgcaggtggcgcaccagcttgcgggtgtcgatgtggctcaggccgacgatgccgttcttggcgaggtcgtcgtccaggctgccttcggcacgccagttgctcacgttcggagagggatcacgcacaatgtatccggcaacccagatgcgggaggactcagggtcttcgctgttgacgccggtatcgccgatgtgcgggaacgtctgcacaacgatctggcgatcgtagctcggatcggtgagcgtctcctggtatccggtcataccggtggcgaagacgatctcaccggtcgtctcgccgagggcgccgtatggctcccccacatatacctgtccgtcttccaaaacgaggactgcatcgtccttgtcatacatcggaattgcgatggtcccggactcgttctggctcaccaaaacccccttatgtttttcgggtattcgtaccaaggttaacggccagcgcagactcacacgccgttggacgcaaagtctcacccccgctggcggggctgtcggcaaggtgccgacttgagaatgtacggcggcacaagtgtccgcccatgaaaaagcctcccgaatggggaggctgaacaacaaatgactaatcgaccgtcggctgaatctcagcggacggggcagcaggctcgtcggatgcaccggacgaatcgggcgaatcggaaacatcgccctcatcggtcggctcggatgcggcggcagcggaatcggacgattcctcatcggcctcttctgccacggactccggtgccggtgctgcattcttggcggtgcacaccgcagacagcaggccatggatgaaagcgggcgaatcgtcatcgcacagggtcttggccaatgccagagcctcgtcgatggcgaccttgtccggcacatcatcggtgaacagaatctcccaagcggcgatacgcagaatgttgcgatcgaccacgcccatacggcggaccttccaacccgtggagtgttcgtccagggtcatgtcgatctgacgacggtgctcggccacgcccttgacgatttcaatggcatagtcgggaagcggggtctgggcaccgggatgtgcgatgcgctcgtcaagcagggagagaatatcctggcttttttcgtcggcttcgtacagggtgttcagagcccttttgcgcgcggtggaacgtgccatactgctgctgtcctagtcctttatacggtcggtcgtctgttgaggatgcggagatcagttgttctcgcggccggtgtaggaaccgtcctcggtgttgatcttgacgcggtcgccctcattgatgaacagcgggacctgaatctcggctccggtctcaacggtggccggcttggtgccggcgttggagcggttgccctgcaggcccggctcggtgtgggtgatggtcaggaccacggagcccggcagatcgacgctcagcggggtgccgtcgtggaaggagaccaggcagtcggtgccttcgagcaggaacttggccttgtcgcccagaagggtcttcggaaccatgatctgatcgtaggtggtcatgtccatgaacacgaagttgtcaccgtcctcgtaggagtactggagagtgcggttgtccacggtctcgaattccatcttcatgcccgcgttgaaggtcttgtcgacgatcttgccggagagcacgttcttgatggtggtgcgcacgaaggcggggcccttgcccggcttgacgtgctggaacttcatgacggtccacagctgcccgtcgaggttcaggacggatccgttcttgatgtcgttagtagtctgtgccacgttattcacctatttcaaattcaaactagcttaggcaaagcccaaaaattgcctcggctattatgccacaccgggtatacaggaagtgaacgctggggtttcccatgtgcccccggctagactggatgaatatgcgatccttcttcgaagccatatccgtgtcctgcgtcatccccgcgcaatcgccggcggacgacgaacgcacggtgttcgagaacctgtcctttgctgtggagcgcggcgagatcgtcgatctggtgggaccgtccggctccggcaagtcgagtctgttgaccgcgtgcgcccggctcaacccgcatgcgcacggcgcgttcgcccttgaaggcaagggcagcggcgagttcacgccgcagcagtggcggcgggatgtcgcctacctgccgcagaagccgattctgacgggcaagaacgtggccgaggcgatccgcctgccctggacgctcgcgattcgcggcaagggcggcaagggcgagcatctgctgcccgacgagcgcatccgcacgacgttggacgcgatgggctgcgaggacatcgatctggagcgcgccccgcacgacctgtccggcggccaggcggcccgcgtggccctggcccgcacactgctcaccgatccgaaggtgctgctggccgacgaggtagatgccggtctcgacgacgacaacgcggccaaggtggctacaatcatggcggacgcggccgcacacggcatggcgatcatccgcatccgccaccgtccgccggacggacgggccacccgcacgctgacactggacaaggggcggctgaccgaacacgagatgacggatccggcggcgcaggacgcgaacgcggtgtctgccggcgccgatgaaaatgaggagacgcaggcatgagcggcgatctgggcaattcctacaacatcgatatctggggtctgctcatcgcgctgggcatggtggccgtggcggccatcatcagcgaactgatgcacatgggcatcggcaagaccctgatgtggtcatcgtgccgcgcattggtgcagctgtgcgccatgggcttcatcatcggctacgtgatccggtcgaacagcgtatggatggtgttcgccctgatggcggtcatgctggtggcggccgtgcagatcgtgatgtcccgcgcacgcggcatccccaagggccttgccgggccgatcttcctgagcctggtcatcaccatgctgctgatgctggcgctggtcaccgagctcatcgtgcgcccgcacccgtggtacgcgccccagctggtggtgcccctgaccggcatgctgctgggcaacaccgtaaccgccttggcggtgggattgagccgtttctacgagagcatggaggagcggcgtgacgaggtggatatgatgctggcgctgggagcgaccccatgggagtcggcccgcccgtccatcgtctcgtcgattcgcctgggcctgctgcccaccaccgcctcgctggcgtccagcggcatcgtgacgatcccgggcatgatggccggtcaggtgatcgccggcggcgacccgctcaacgccgccaagtaccagttcgtggtcctcgacgccatcgccgcgctgaccctgctggccgacggcctgatcatggtcatgatctaccgcacctgcttcaccgccgacgaccaataccgcccgcccgaagcgcgctaatcagctaagctccctctgataagctccctctgacgagggagctgtcgaacgcaacgagactgagcgagagaccaccctacgcgatggtgaccagcgtgccgtccggcacctggtcatagaaccattgcgcgtcggccacagtcaggcgcacgcagccgtgcgaggcgggctggccgagtttggcaccctcctccggcagatagtcgccgaaggcctcgccggtcggcaccgagtggaacaggtacgaaccgtagaactgcacccaatagtcggcgcccatgccttcttcggcattgtagaagtgttcgccgcgtgtatcgatggtgtacgagccgtgcggggtggcgtcgtcgacgccggtactggcgatcatcgtataaatggtctggccaccggacttgacgtacacccgttgtttggcgagactgacctccacgctcaggtcggagtactgggataggtcgggctgtttgccggtcggccccttccagtccacgctttgcgcggctttgtcatcgccgttctgcgtgttctgcgtcttccgcgacccgccctgtttgccgctatcgggaacctgcttgcgggtaacggccgtgggctcgttcgccgctgcggttgcggcggcggatgcggtgtcggctcgcggccagctgcgctgcgccgccgcggtctcgactccggcgccgatcaggcagaacaggatacagcaggcgaccactccgcgccgaatcgcgtagacccgatcgtgactccaattcacgttcaacgtcggcagcctcaccatatgcctcttctcaccacaaagaccattcgggtcgattgtaaacaggcattgcgacgccctacgcctcggtttcagccgtgatctcgactgcaggaacggcatcgtccggggaatcttcgcccgacgccggcaccgtccagcgccgccgcagcagcatccacaggccgatgaagcacaggagcccaccggtacggtggtagacactcatctcctgagtgagtcgctgcacgcggtcggcaatctggcgcgtacgggtatgcgatttgacgatggagaaacgtgagacgcacagcatcgcgtagtacacggcgctcacgatgaacagcacggacatcgtccacaatcccatcgccagtttgacgatggccataatgccgccgagcgttgtggagaaggcgacggccagtgcgactttgtcgttgttttccatggcgcccaggatgttcagcgtggtggatttgccggcgccggatgcgccgaggagactgcctggccattcctgcaaccggtcctgttccccggcgagccggatatcgactccatcgccgatccggccgaacgtaaacgccgcatccttctgaagcagttctacgtttccggcatcatcggcacattccgtgcagcgctaagcggctcgatcatgaccacccccaccgagatcgggcactttgtctccgaagaactgctcccccgcatcgcgccgcatatgcaaatgccatcgcaatcggaaacagcgcagcagccagcggcatcaccgcaagcccagtagcgaggtcaacccacagctggcggcgcgggaaacaggtcgcgccgcccagtacgcgaatccggcgagcttctaccgagtcgcgaggaagaagaaacgcgggaaggggaagatgatgctgccgtccgactgtgtggggtattcctcgcggacctgggcgaacacttcgccctcgaacttcttgcggctggcgtcgtcaagcgcctgcagatacggacgcatgccggtgccgcgataccagtccataatcgcctcatgcgagggcagcgtgtgcatgtacgtgaccttccacatgcggaaggcgctggcatgcgcatgcagcagctcccagtattcgggcggcgtgaggttgtagaactcgcgttgctgcggcagcttgtccgcgaacgcgggcgagtgcacgataccaccgatgatgcggtgaatcggctcctcatagttcatcggcgtctgcacagccagcactcccccgaccctgagccgggcgagcagtccgggaatcagatgcggatggtccggcacccattggatgcaggcattggagaagaccacgtcgaagtcggccggcagctcgtccagccgcgcggacacgtcgcacagctggaaatcgatgtcgggataggttttgcgcgctgtctcgatcatgaccggcgagctgtcgacgccgagaatcttggcatggggatagcgctcgcgcagcacggccgtgctgttgcccggcccgcagccaatatccagcacgcgcgtgacgctgccgtcgtccggcggcagctgcatcgccagatcacgcgccggctgcgtgcgctcccgtttgaatcgcagatactgttccgaatcccaggtaaccatgctccccacgctaatcagccattcacatatcggccgatattatctcacaattcagccgagcagggcgtcgcggcgggcgatgagcccgtcaatcgcggcctcgccttcgatgacggtgaaggtcagggacttgcgttcgctggcctgcggggcgatggcgtgcaggtcgccgcgctgctcgtgccagcctcggccgtggacgctggagttcgagggttcgaggccgaccacgtagtcgcccgcacccgtcgacttccattccatgaagtatgggaagaggctggcgtcgaagtcgatgacgactccgagtccgagcttgcggttgaccacggcggcgaagctgcggccgttctcgtcggcggcgagctcgtgcaggtacacgctttcgggactgatcgtcgcggaaggattcgttggtcacctcatcctcgaccgtgatcgacagccggccgtacacgctggtgattgtgcgacgcagtacgaggttctcgccgcggtattcgaactggcagacgtcgagggcgcggtcggccatggacacgaaacgcaacggaccgttcttcacctcgatggccttgaggccgtgggctcggccttcctagtattcgatcgggcgcacgtaggcggcctgctgaaggctgcccatatgggccagcatgtcggctcgcgtgctgtgttctgtggacgtcatcgtcgtcaccgatccttgatatttatgcctcacgcctgcgcagcggcggcatccgcggcgtcgttcttcagcgcgcgcagcagggccttgttgcgggattcgatgatgcgcttgccgtcctcgccctgccaggagaagaagccctggccggttttggcgccgagattgccttccctgaccttctcggcgagcagcgggctcgggccggtgccgttgtccatatcgtcgaacaggtaagtgctgatgttatagaacacatcgaggccgccgaggtcgatgctggcgagggggccgaccagattccagcgacggccgagactgtacttcatcacgtcgtccacggtggccgcgtccgcgatgccctgctggacgatgtagaacgcctcacgcagcacggccagttgcaggcgattgcccacaaagcccagcgattccttcttgatcttcgccggcttcttgccgatcttggccatgaggtcgaaggtgatgtccactaccttcgggtcggtcttctcacccggcaccacttcgaccagcggcatcaactgcgcggggttccagaagtgcgccaccacgaagcgctcggggtgccccatcaccgactgcagcgcggtggggctcaggccggaggtgttcgtggacagaatcgcgtccttgggggcggcgtgctccacttcggtccagacggacttcttgatgtcaaggttctcggccacggattcgatgacgaagtccacgtccgccacgccgcttgcatagtcggcgtaaccggtgatgcgggccagcaccgcgtccacggtgtcgccgtccttgagcagtccggcttcggcgaagtcctcggcatccgaacgaatcgccttcatcgccttctccagcgaggcctcgccgcggccgaccagatgcaccggatatccggccaacgcgaactgcaacgtgatcgcgtggcccatggttcccgtgccgacgttcgcaatcgtcttgatatcgtccactgtctcaatcacggagaccccttctttccggcggttcgtctggcgttggtgtacgcatgaacagcaccgtgccgttatgcgtttgttcgcattctatgccgatttcgctacgtgaacatttgctgaacatttcgcggattcgactagtacaaatccccatatcagcacaaaaacgtggtgccgcaacaccgaagtgttacagcaccacgctgaaatgttcatgtcgttacgctgccgtcgcgcacccacagcggaatcgataggaaacctcaccggagtaggtgaacacgggggcgaccagcatggacggaccgaacatatactgacggtccagcgtgcggcatgccgggtcatcggggaattccacgaacatggaacgcatgaccggagtaccgttcgcatgaggctgcaggccaagctggtagacatacggcatgagttcaagcttgagcttggtgaactcgcgcaccacatccacggcggtctggccgggcaccaatgcgacgccgttcttctcgtcttcctcgtcgaacagccacggcacacggtacacggtggaaccgtgcagtcgcgagtgggagccgagcatgccgaacgccacccaacgcttgtagacggccgggtccgggaacgcgccctcgaaaccgccgatgtcgtgactccagaagccgaagccggaggaggtcagcgacaggccggcacgcagggactgggccatgccattgaaggtggattcgcagtcaccgccccagtgcacgggctgctgctggccgccgaccgtcgcggagcgcgcatacaggcaggcgttgcccttgccgtaggtttcttcgatggcttcgaacacggcctggttgtacagctgggtgtaccagttgtgcatggagagcttcggagagccgtcataccagacgacgtcgcgcgggatgcgctcgccgaaatcggtcttgatggcgtccacgccctgattcagcagggccttgaccttgtccttgaaccattcacgggcggccgggttggtgaagtccaccaagcccatgccggcctgccagaagtcggtctgccagacttcgccattgggcttgcgcaccagatagcccttgtcttcgtgcaggcgcttcagcgtggattcgatgtcgccgaagaaacgcttgtcccactcgaaatcgcaccaatggaactcgcgcatccagtagcagtcgtagtggaaggcggccagcggaatatcacgctcggccataccgtcgatgaaggagttgatggtggcctcggtgttctcggaaccgatctcaaaggagacatggccgcggttgttgaccagtacgccatacccattggaggtcatgtagaacgggatgtccttgtagccctgctcggaagcagtgccgccatcctcattccagatgtcgacgctctgaccattcttcacgtaagcgccgaagcgttcgcccaagccgtatacgtcttcgccaaccgacagatgcagctggatggcaatgaacacgtcggattcatcacgggcggaaccgtccatggtcacaccgaattcgctgaccggctgggcggtgacgttcgattcggcaccgagcttgaatcggcccagcgacttgcctgcggactcagtgagcaccttgccgtcctcgccgatgaaggtcaggttccagggggcgcccttgacgaccttcacggtaagtccgccagtggtcagcgtgacatccgcgccattgacgccaacttcgccgtcgccattgccgttcgcctgaacggtcacgtaatcacggttgccgggttcgtcggcattgagcgggaatccggggtattcggtggcgccttgccagtgttcggcacacacacgaatcacgccttccgcaggtgtggtgatgtccacattgaatgtgggcaggttcagggtatcgtatcggccgcgcaccacggaggtcggggcgaggacgttgaggctttcggtggtggcatccgccgccagttcgtaggcttcacgagcgtagagggcgtcgacgccgtcacgaatcatccagtagccgttggtgaacttcattgttgctgctccttggtggagaggtggtttcgaccgccagggaacaaggcagccgaaaccaaaatcaatatgtgctgcttgttgattgaattgcctgttgtgcgaatgaccttacttcaccgcgccggtggtgatgccgtaccagtcgccggagcccatcatgccttgctcatcgtacttgccggtgtcggccaaggaaccggtgataatcttgtcccagccatattcggacacgtaatcgttgaggttggtgagcaggccttggctggcgagcaggccggacgtggcgttgcccttgttgtattccgtaacgtccggagcgtcgtcggagttgaggacctgggaggcgttctggcgaatctgttcgaaggccttcttctcgaattcgaccttgacgccggtctcacacattttcatgctttatgcaaaaaatgtgaggcatacgcacatttcccatcaaacgcacaggtgcaagaatggcagcaattcgccatttttgaaatcaccatgtgcgtttgacggcgcgtaagcctcacattgttctcagcaggaccgaatttctgcgagcccccctatagcgctcccctacgcaatatgtccgcaaacgaccacaccacatgggcgatacgcgccaattcggcgtaacggccgatggacagccactgcacacggtaccgttcgaaccacaactccaaatcggcggcaagacgggcgcggcgcgaggcatccagcgcacggccggtcacatccttggtgtcacaggcgtcctcgccgccagccaataccagcagttcctcacccagtctattgaacaaccgctgcccatccagcatcacccacagcagctccgggttcaatcctcctcgtgccgagccatcgagcaccgcgacaaccgcactgccgcaatcaatcaacgcccggtcgcaatcccggcgtcgttcgagacgggcatggttccgcaggagcaatcggcggcgcgcgtcggcgcatcccagcgcacggtcaaacatgagctctcccccgcacgaccgttccacatacgatgccacatccgtattcagcatgccggtgccggaaccgtattccagttccagcacttgcacggcgaggtcccaggggaacgacactccatcggagtcgatgcgagcgagtgaatccataagccaaccggattcgtcgccatacgccagattagaaatccgatggttcatttcgcatgcgtcaattgcaaccgggttccacgcgttttgcgcaccgtagcacagtcccggcacgctcaaccgcggatcattgacatgcccatagtcaccccaatcggtgaccaccatgccttccgcaccatatttgagcccagccaccgccatgcggtacgtgttcagccaggcaccgtcatagtcggggaagaaccggctccacgcacgcacggcagggcacacgaattggcggcggccttgtgatgcgatggtctggatcttgctttcgtcgatatccggctcatacatccagttgagcatcgtgatgtcgccgggcagcaagtccatggtgtgcggattctcgagcgcgatatccgcccacagcatcggttgtagaccacgatgggcaagcgtgctgcataggtctttgacgaaatcggcatacagctcatcgcgactggcgcccggcgagtcctgtacggaccggccacggcccaagtcgaaagtctcatcgccaccaatattgaaggaccgcgagcggaacagcggcgcgtattcctcgattaggcgcgaggcgaaatcgtgcgacttggggttggctgcgttcagtgtgtggtgttccattcgttcgatgaaactgaacggacggtcggcgtcttcggggaactctcccagtccacgatgttcacgggtgcgcaggttcatatacatgtgcccgaaagtggccaaggacggcaccagttcgatgccgtggtgtgcgcagtattcgtccaggaacatgatgtcgtcggccgtgagcgggtcagtgccgcgccacgcttcgctgagctcgccgaaagcgaaggcatgttccacgtacagctggaattggttgtacttatacaacgccagctggtcgatgaaccaggtgaggaacgccatcgtcggcacacgcccgcgcgtcacgtcaagactgtaggcgcgcaccgcgaacgcaggcttgtcttggatatgcaggcagggcaaggtccgcgaggtttgcctgatcatctgccgcagtgtctgcatgccgtaccgcaatccgctttcgctgccaccacgcacggcgatggtatctgaggcgaacacatccagcgtgtattcgtcatgcgccaatcgcgcatccacacacagcaatatgacggtgccgttcatcgctgccggcgcacccgcgcccgcacccgcacccacgcccgcatctcgcgctttttcggcggcattggcaccggcgtcggcttcatctgtggctgtgagtactcggcgcgtacggacggcgacgccgcagtaacgctcgagttcgctggacagctgctcgattggcagcgtttcccaggtctcatcggcatcttcggtgacggcatattcgggaattcgtttctcgatcgtcaccaaggacccgatcatagccgtgccatgcgtgtattccaatgtcaccggagcgggaatcagggtgagacacggcgttgcggcatcagccttatattcgaatgtgggcacagctgttcctttcatactgtttttattatcgttcatccgctgacggcaggcgacacgcggtcacgccgccatcagcggacgaatcgtttggtgaggtacggcggcatacgctatttcacggcaccggtcgtcacacccttcatgatgttgcgctggatgagcatgaagaacaccaccaccggcaacgagaaggtcaccgaagcggccatctgcccgccgaaatcggtgcccatggtgggtgccgagaaggacgacagccataccggcagcgtgtacttcgactggtccttcatgaacgtataggcgatcatgtagtcgttccaggcgttgatgaacgcgaacaccgaggtcgagacgatgccgggcgcggccagcgggaaggtgatcttccacaggatctgccagtcgttcgcgccttccacggccgcggattcgaagatgtccttcgggatgttcaggaagaacccgcgcatgttccagatcgcgaacggcagcaccatggcgatgtacgccaggatcaggccgctgtatttgttgagcaggccgagctggttgtagatgatgatctgcgggatgatgccgccagaggtcatctggatggccagcacgaacaccatgatcggcttgcgcccgcggaagcggtacagggtcagggccgtgcacgcgaagaacgcgacaataatcgacaggacgatcgagaggtgcatgggccagaacacgggggtcgtggtcatgatctcatcgcgcggctttacggcggtgataatcatccagtagaccgggaagaaccatacgacgcagaacagcagggcgaggatagtggtgccggcgcggcgcgcgatcttgccggggttggttcggcggcggggcggtgcagactgcgctgcgccatgcgatacggcccgtggattctcaacacatttcataaggacgaccctctatttcagggattcgccaatatcagcgtgccagtcgccatttccggcgtcggctatggcagcgccaccccttccccaccgtcgacatcgacaaccgactcgcttcacgcaagctcaccgagcatatgttggggcgcgggtatcgacgaatcgcctatatcatcggaccgtcgtacttgccgacgttgacgccgacgccagcgtgcccgcagctgaccaccgtgcgccagccaatggacgcattcggcgtcagcttggctaccctagtgcttgaccagatcgaggaccggccgttccagcgcacggggctcctgcccaccgaggtcgtagccagataggcgcgcagagaacggttctcaataatgtctgtgcacacttctctacgcccgaagcacacatggaatatgccctaatcactgccatgtcgccatttgcgatgatgtgagattgttatgttcttgttcatttgagcgcacagatactactgagaaccgttctctgcgcaaatagacaatgtggataactccataagctggaaccacattgccctgcctggcttgcattcaagtccaaatcagctttacggtcgcaccatgagctcttttatgcatgaggatattgtcggccgacgccgagcagaacgtgaacgctgcaatgatgctgcgcgccgttcgaaaggtccattgctggtgggatacatcaatgcggccaactactacggcgcgcccatcccccgacattgcacgctatctgttgatgccgtgcacgcctgtgtttccagtgccaacaaacgcagacgaatcaaaggcgtggtcttccatgtgtttaagggaaaactggatatccgcaaaaaggattatgaacagttctggattgcctcgccggtcatgatgtgggctcagatggcccaatactctacattggaggaacttgcggccattggagcctctttgatgagccgcgataaacggcgcagaatggccactcgcaaggatttcgatacttacttggaaatcagtccgcggttcataggtcgtaacaaatgccacgaggcactgccctacatgacagagaacacggattctccgccggaaaacacgctgtttgggatgctgaaggattcaggcttgggatgccccaccgccaactatcgcgtgaatatcggcaactcatacgtcatattggatatggcatatccggactgccgcgtcgcgttcgaatatcagggagcctatcacgccgatccggcacaaatgcgaatcgacgcggcaaagcgaaacgcattgcaactgctcggctggatcgtcattctcgtcactgcggatgacctgagaacagccgacacgcggcatcgttttatcgagatggcccatgtcgtggtgtcccggcaacgcaatctcgccgattggaaccgctcatgggccattacctcttagcatcgcaccgacaatgcgctatgccgttatttactgcgaggcacccgccagatatcgggctcaacgtagatctcccattcataccaaggcagcgcggcacggcgtcctcgtccatgtgaatggcctgcaggttaatgagcctatccacgccggcagtgcgctccattgcctcgaccaccaggtcgcaggtgctgtggtcaagcgattcgcccaccagcagcgaaccggacttaaacgccagcgccgcctacaaaagtgtgaggctgcgcaggctcacactgccaacagccgttcagccaaccctcggaaggtctggccaatgccatccgtacgcaaagcgccgtcggcgtccagcaccgccggccggccggcctcgccggtctcgcgcacttcgggttccagcggcagctgggccatcagcggcacgtcatagcccagcgcctgagtgagctgttcagacacgcgctgaccgccgccggcaccgaaaatctccagcttctcgcccttgtgctcgtagtagctcatgttctccaccacgccacgcaccttcatcggcacctgcagggccacgagtccggagcgcacggcgatgtcagaagcggagggctgcggggtggtgaccaccacgagttcggcgttgggcagcgcctgggccacggaaatcgccatgtcgccggtgccgggagccaagtcgagcaagaggacgtccggctcgccccaccatacgtcagacaggaactgttccaaggagcgctgcagtcgcggcccacgccacagaatcgcccggtcagcaccggcgaacatgccgatggagatcagtttcacgccccacgcggtgaccggcatgagcatgccattcagattggtgggctgtgtatgcacgccgaacaggcgcggcagtgagaagccataaatgtccgcgtcgatggcggccgtgtcgaagccgagggccgcaaacgtggcggccaggttcgcggtaaccgaggacttgccgacgccgcccttaccggaggcgatggcgaagatgcgggtcttgacacccggtttgctgaaggggttctgcttgcgttcggccttgaggtcggcgaccagatcggccagcttgtcacggctcatcgaaccgacttcgatatgaggcagcagctgtgcgcccggataggagctgaccgcgccattgatctggctggtgatggtctcgctcagtgggcatccgggaaccgtcagctcaacgtgcacggtgacgtcgtaagtgccggcgtccgacgatgcgggcgcggcttcgatggcggcaatcatgccgaggtcggtgaccgaacgaccgagctcggggtcgatgaccttgctcaggcgttcgtagatgtcggcttcgatctgacgtgcgtcgctcataaatccgtatcctcctttagggcctgttctaccctagcgtgtgatgcggcggcatgccagagggagtggagtaagtcacactggggcgggattcgctttttctctcccccagtcagcctaaaggctgacagccccctcatcagagggggttaatgaagcgtctgagggggctattttagatggtgccggtggctaggagctgggcgaattgggtttcgctcagcatggggatgccgagttcctcggccttggcggccttggagccggcgtttgcgccaatcaccacgtaatcggtcttcttgctcaccgaaccggccgccttgccgccgcgctcgataatcgcctctttggcggaatcacgcgaatagccctccaatgaaccggtgaccaccacggttttgccggccagcgtctgcggcaacgaactggtctcggcctcgtcgacgcccacgccggcggcctgccaagcacgcaaagtcgcgccgcgccagtcgccgggttcgcgggtggcggcgaaccagttcaccaccgattcggcgatttccgggcccaccccgtcgatggccgtcagatcttcaatcgtggcgttttcgatggctgccagcgagcccatcgccgaggcaatcaggcgtgcggtaggcggaccgagccggcgaatcgacaacgcgaccagcacacgccacaggtcggcgtgacgggccttgtccatttcgtcgaacatcttgcgcgtgttttcgccgggccgaatgatcaccggtacatccgtgacgccagtgcgcgtggtcttgtgatccacgcgcacgataaccgcgtcggccggcacgtcatactcaggataggaggctgcggcaaagcccggcatagtaccaagtggcgcctcagccccggtaggtgcgccggtcgtctcgctggcggtacctccctgtgtttcggcagattcgattgcggcctccccttgcgcgcgttcggccagctgcttggccgtgagctttttggccggcgtgggcgcggtccagaaagcaggcacctgatgccacaggccagagccgccgacacgcttacgcacctttttcttcttaccgttcgcaccgaccgtctcatgcacctcgacgattgcggcctcacgccacacgcgcacgtcgcgcagatcggcggcggtcaggttgaacaacccggattcgttggacaacaccggcttctgcgcggccggcaattccagcccttccaccggctcgtacgggtcaggctcttcgccgggggcgaccagaacctcggtgatgttcggcgcgtaggtcgccaccgaatcaggccggttctcctccgggttggtcagagcgatggccgattgttcgcccaagtgctcgatgtcgaacgccttgcgtgaggccagcgaaatcacgcgctcggtcaactgggccgggcagctctccacattcgggcagcgaatgtccttgtccccctccttggcgggtgacagtttcgcgccgcatgaagggcagaactcgggcatgacgaattcgcgcagctggtcctcacgccctttgcgccgttcaagcaccgggccgaccagttcgggaatcacatcgccggccttgcgcaccaccacggtgtcgccgatcagaatgcccttgcgtttgacttcaaatccattgtgcagcgtggtacgagccacggtggagccggccacgtagacaggtttgagcacggcgaccggcgtcacgcggccagtacgccccacctgcacggtgatgttgagcagttcggtgttgacctcttcgggcgggtatttgtaggcgatggcccagcgcggcgcgcgcgaagtggcgccgagggtacgctgcaggcccaggtcatcgaccttgacgacgatgccgtcaagtgcatgctcgatgtcgccacgatgctcgccgtagtactcgatcatgtccaggatctcctggaatgaggtcaccgcacgattgtgcggggagaccggcacgccccacttggtgtatagatcgtaggcctgcgactggtcggcgaccacatcatgggtgccgcgcggatggtccggcccccaagtgagctgccccagaccatgcgcatagaagctcaggcgacgggtggcggtgatgcgagggtctttttgacgcagcgagccggcggcggcgttgcgtgggttggcgaagggcgctcgtccggcgtcctcctgctcgttgttcagggtgtggaaatcatcccaacgcatgaacacttcgcctcggatttccacgaagtccggaacgtcttccttggggccgccgaggtttgcgggaatggagccgatggttcgcacattcagggtgatgtcttcgcctgtaacgccgtcgccgcgcgtcagtccctgttcaagcacgccgttgcgatagatgaggttcagggcgaggccgtcgattttgacctcgcaactcatgggcaggggcttggattcaggccaatcgaggtcgcgaatcaccgagtcgtaccaatccttgagttcttcgatggagaagacgtcgtcaaggctcatcatgcggctggggtggcgcacggaggcgaagtcgttggagaaggaaccgccgacgcgatgggtgggcgactgcggattgtccagtgaggggaacgccgcttcgagtcgttcgaggcaacgcatgcgcgcatcgtaagcggcgtcggagctgacgggtgagtcgtcgatgtagtaggcgatctgatcggattccacccatgcggccacgcgagcccacaggcgggcggcggcctcagcggtcatcgtgttcacgtcgaaacggtcgaggcgtatcgcgtcgtcgtcagtgggctgcagtgcggctatccattgttcggagccaggggcaaaacgtgcaataccggtatcaggccggacctcggccacatccccatcgtcgaaatcccatgccagttgttcgttcgtgctcatggttgtctatcctagcgggctcggctcccctcggccggctataccgtcaactcccctcaggcggctacgcggatagcgagcgcaggaactgggcttggatgatgtcgatgttatcgccttcgccgtcattcatgcgggccacagccaccgagagcgtgcgggccggcacgaacatgccctcatccacgcacacgcgagcggcgtcacgcacgatgtcagccacttcgatatgcggccagaccggcagatcatgcgtggcaagcacatgggcggcggcctccaccgattcaggcaccggtatgcactgcgagtccgcacgggaaaccagttcctgcagttcgctttccagcgaaccaatggccccgggagcgatgtgatcgctcataatgtaggctgcggcggctgtgtcgaaccggtcaagcatccattcggcgtacgcgaaccggtaataggcgaacgcggcatcgtcgcggtccaaggccacgcgcagagcattcaggcaggcggcgcgtgccgaatcccaatcctcattgcgggccagttgaatggcgagcttcagatgtgagagcgggtaggcgggcgcgtacgccaccatacggttgagatgcgggatggccgcctcggcacccttgatctgactcaacacgtcagccagctccatgtgcgcgtagaacagattgtccgggataagcaccgtacgctcgtccaatgtggcgaacagccgattgtagaccacgcgctcggcataggagttgaagtatcgaggtacgccatggcctgccgcatacacctggtccaaatgggccacggccgcttcggccgcttcgatggcctgatcggcttggcccgagaacagcatatctcgggcgcgcagacgctccttgtcaagatcgtcggcaagcgtgaacgtgaagtccggcgtgtccttgccatcgatcaacgcactggtgacctgagaggccaaaccggtcagttcgggatcgcatatcgattcgatgacctgcatggctcgctgggccttttccacggagccgagcgacgtgttcctggcgatatcgtggaattcgttgacgccatgctgcagcaggtccactcgctggatagccagtccggcactattctgtgcgcccagcacgtgagcggtcgccggactgaattgacggtcggccagttcgggctcctcctgggatccggtgggagagaaccggctgtccgccaagtcgaagtcggcgctgatgggtttcagaccaccttcgccgtccacgtccatcacggcaccgaacatgcggtaggtttcctcgggattgtcaagcccagcggtgtccagtcgcttgaggaaggcatcacgggtgaaggtgacggtgaccatattgcgcacggtgggattgcggcgcagcacactcatcggatcatcgtccatgccggcggccccatcagcaccgtcagtgccgacgccctcgccgccgataccgcccaggtcgtcgcctgcgccggtatcgtccggcatgccgaacgccatttcgtcgatatcgatgcccttcatcaggtcttcgaactgcgaatcgatggacgcagcgccatcggcgtcagcagattcggccgcggcctgatccgtagcatccgcagacggtccggtaccgttgcctgctcccccggccgtgccgcgttcgtcaccggacgccgtctgcccgaacgtctcctcatgggtgatggggcgggtcgggtcgccatggaaatcaccatctttggggtcggctttggaacccacacgccccaaatcgccactgcgtagatgttcgaaggcgcttagggcctcgctcatcatcgcctcgatggcggaatcctgttcggcaatcgcctcttcaagaccaatggaatcgatgtgcaacgacacctggcgcacggattcgctggtgccgaaacttagcgcggccatcatcaggccgacacgcaggttgtaggcggcgctcatcgacgcgcgttcggcgctactcagcgcacgccacgtacgtcgagtggtgtcataccggctatcgggcatcatcgaggtgccggcggtggtgaagccaatggccacttcacccgaatccaagcgcgaccggaactccacgtcaaaccgatacggcaaccgtaaccggcgcaacagtgaagagagggtctgacgatacacccattcgtcgctcctcgccggcgaatacgaaggacgagcggcttgagtgttggtgtcgctcttatcggtccgttctacagcgccctcagcactctcagtactttcagcgcccgcagcattcgtcacacccgaatccggcacgttctgctgggtcagcacatctcgaggatcggggaattcactgcgaatctgtccagccgtgcgtgcggcgatatcgatcaggctcagcacggcccgacgctcctgctcgccatcatacgggtcaagcgccataatcgcagggttttcgatgagtttcatgtcgatttgcgcggcctcggcacgggtcaccgtatcttccgtagggttgcgtcccaaggaagcgttgcgctccaaccaagcgctcaccgcagcgaatcggttgaggttgccttcgatcttcaaggatttcagcgcctgcccgaatgccaaggacttatcccacgtaaagaaatagccgctcgaatacgtcgaggtgtacaggtgcaacggttcggcgccatgcaccgcttccagtcccggcgtggtgtcgagagcgccggcttcgcgcatcagatcggcgaaatgatcctccagaccggaggcccgcatgccgtgggcacgtgccgccaaagtgtcacgcaccgaacggcgaatcgcaccgattggcgcctcacggttgagacggcggaagatattgccggaaccgaatccgatgagcagaccattgatctgcggcaacatatacgtggcgaagaacgcgatggtaatggcatcgcggtattccaaatcatgacgcatcgcaggcggcagattggcacgcatctgctcaagcgtgtaccggttgccggccttgagccatgaggcgagccacgtcatgcgtccggtgtcgtcacgccccaccacgccaccggtaatggccttcacaccgtcagcaccatgaccaaggccacgtcccaaaccacgcccatgatgcagcgcacttcccaggccacggtctgtacgggagaaaccggaacgtgaacgaggctcgtcgctttcgcccagccgctcaccgtccggcaatgtcacttctttttccttgccgaacataaatcgcgcctgcatatcctgcacgtccatgttggggtcggtgcccacgaatacgcggccatgcgtatcggcgaacgccacctgcgcaaaatgatcgcggtcggggaaaatgccaagcgaaaagccacggcctctggtggagggcagctgcgcccatccaagcaccagcccttccggcacgttctccaattcggggaaggtgcgccgcttgattacaggactcagcgccactgcatggcgagtcagttcgtcgataatgccgcctttacgctcactggtctcccgcaaggcatcgccgaacggattcgtatcgtgcttcttcggcttggacagtcccagatcggccgcgagcgcgttcatcgaatccttcagcccgcccagcagtggcgtgcggttgtgcttcccatggtccgatgtacgttttggcatgattcacattgtctcttgtttgcccgacatcaagcccgaataaagcctatagaataaatgcgtgcattccatagaccacactcgcgcagaccgtccgatgccgtcgaatcatgaacggcacctgcccagccgcccggatacccggcaccggctgcgtttggtgcgcctgctgatcgccttgctggccgccgtcgccgccatcgccgccatggagtgcatcgtgttcaacctgccgttctggcgtacgctcggagcgagcacggatacgaacgccgtgcataacacgctgggttcgggtctcacgcgccggaatgatggcatgttgaccgtcaccgatccgaccaaggcctatcttgaactgaccgcggacggcacgtcggattacctacgcatcgataccgagagcagcaaggtcatcgataaggcccgcgagcaggccgaggccgaatccaaagcgaacgacgataaggaagtcttcaaaccgctggcgaccattcatgtgcgcgcggatgtcgatggcatcaccggcaaggcccagtcgatgaatcccgacgctattcgcagccattatgtcaaggcgccgggtgccggcatcgtgcgtatttggattcaggaagagcgcggcgcgatcgtaccggtcaccgacgcccgcgccaacgtgcgcgtaccgttcgtcatcaattggatgcgcgtgctcgccatggccttggtgttgctgatgattgccgtctggaggccgggatcgcgcctgtggcgtatcacgcttgacccgtccagcactcggcaacgacttgctttcgtggggcttctggcgattcctaccctgcttatcggcgtatccatcatccacgaactgtggtacacgtcttcgctcgtcttccacgtttccggcgattacacctatgatttcgaccagtatgggcatgtggccgatgcgctggtcgccggccggccctggctcgacttgccggttcccgaacagctggccgccaccgagcacccctatgacgtagccacacgtgcccagctactcgccaatggagccagtccgctctactgggattacgcgtattatgacggtcactggtattcctattttggcgtgttgcccgcagtgctgctgttcgtcccctatcgtctgctggccggtcataatctgccgacatccgccgccgagtatattctcgtgctgctgttcatcatcttcttctccttgctggtgctgcgcgtcatccatcgtgtgatgccgaagacttcggtggcggccgcgtcgttagtagtggtctcatcgttggtgagcgcgcaaatggggtatttgctgtatcgcacgaacttctatcagataccgttcgccgcatcgctgacgttgacgtcgctgggactatggctatggctcggcgcggacacgtcccgccgtccgctgagaccatcggaccgatggcaggcgggcgatgccaagcctctctccctgccacgactggccttgggcgccttgtgcattgcggcgaatttcggatgccgaccgacgttcaccttggccgcattgcttgcgttccccctgttctggccgcagattcgcgcgctgggcaccggtctgcgcacacgccgcatcaagccgttgcaggcgttgcgcgcgccgctggcggtaatcattcccgccattctcgtcgtgacgcctctgatggcgtggaacatggttcggttcgattccccgttcaatttcggcaatgcgtatcagttctccatatccgatatgacccggtataccaccccgtccgcggatatgcccgccaacatctggtattacctgttcctgccgctgcgcttcatggatcgtttcccgtggctggcgggctctcccgccccgatgccgcaatggggttattacgaggtgatggtcggcgcgattttcacggccacgccactgaccttgatggctttggcgctgcccctgctgcgcagattggaaacacacggcatgcggccatggctgatgtcttgcttggccgtggcggcggtgctggtcgtattcgacagccgcgtcggcggtttgggatggcggtattccgccgatttcggctggctgatctcgctggcgtccataccggggctactgtggctggtcaatgggcgcgaaccgagccgctcattggcgggggccaacgacgccgcttcaggcgatggcatcgcccgcgtcactccgtggcgttggctgatgcgctgggtcgtgatgctggccgtattgtgggcgctgggcatagccatactaagttgcttcgtgcagtcgcgcagcgattcgatgatcgccaacaatccgacgctctggcatcaggttcagtcttggttcaccctgctataggaccggaccgctcggcgacccgccaagcttcagtattctcccagcattccggccggtgttttccaagacctgcggcataatgtatgtgacgtaattcactaatcgtttacccatactgtcgtgagggtttccccgtgtccactgccgtccgtagtcgcgtcttccagctacaccgtttccgctgaggggtacccggattacacggccaacgccatcaccagcgatgaggcggccgccgcataccgtgaggccgccgccggcgacgccgacggttccggcaatgtcggcggtaccagcacggcgagtcagacgaccacggtatcgagcaatgacatcgcctccaccgagcacgagtttctggtgttgggactgatccccaaggtcaagaacaccattaccctgaccatcaccgacaccgacggcaacctcaaggcacagtacaagatggtgctcagttcgggatgcatctgccgcgtctaccagtacggcttccgcggcttctacttcgcgtgagcctcggcatcggactcacggccgatgccaatcctccaacggccgattcctatctgctaccgcttcgcagcctcatacttgcggcgaatcagatcctcataaaacgccacagcctcagccggcgctccgtcaaacgcgaccgcgtgctcgtccagcaccagtacgcggtcgatggcgtattcgggccggcggatcatatccgtgtcatgcgtggcgaaaatcacctgcttgttgtagctgaacaacgccttggccacatgcgcggcgccaatctcatccaatcccttgctcggctcatccgccacaatcgcactcggctcaaagctcagcgcggccgcaatagccagcaggtgccgtttctcggagtccagttcgctggccttggccttggagacctgcgccaaatcaaaatgcgcgaacagattgccgatgcgcgcatgacgttctgactcgggcaccttgtgctttttcagcgcttcggaaacagcctcggaaatattcgccgcttggtaaaagctgttcggaatctcctcgcggcgaacttcgccgaccagattatcgatgcgcttcgcgtccttcttcacagccgggtcaagacgttcctcaccgcccgcaatggtcaccgtgccggcgttggccttcaacgaaccgtccagcagacccagcaatgtggatttgcctgcgccgttcagtccgatcacagccacccgcagctcgctgatggtgatgtccgtgggagcaagtcccacgtgcccatcatcatacgtatgcccggcctgatccaaagtgaacgtcagcgacgccaggcgtggcagttctttcggtctaaacaagaatcccatgccgctattgtacgtggagtacaggcgtggtgccggcaaacaccggcctatcgcagcaaagcggcgacggtattgagcacggcgcggatgccacgctcgaattcgtccggttcgggtagcagggaaacggccaggtatccattggaagtcatgtcgaagaagtagccgggctgtccggtcagtttgtgctcgtcaatcaaccgcagcaccagctcgttctcatcgatgactgaaggcactcgtagcagcacgttccagccgccttcggcccgtagcacgctgaccagcccgttgggatcggcgtcaagcaactcgtgcaacttggccaggttattgcgcacgcgctcccccacccgtctggtctgtgcgggcgcggcgttcaataatgcgggaatccgttcggcgatgatgtcactcatcggcagataatcatcggcgatgacgtccagtcgacgctgtgcctcggcaacgtcctcggcaggtccggacacctgaatccacccgactttggcgtgcggcgcggccagcattttggagaatccgtctagggcgaaggtgagcacgccgcgctcccccgcgagccgtgcgttgccggggaaaggttcgagagagtaatcgaagaacacttcatcggcgataagggcgatgccatgctcacggcacaatgtcacgatacgtgcacgctcggttggttttacgtacgaaccggtcggattgttcgggttgatgagcaccaatgctctgatgcgttcgccaccgggctcgctgagcagccgctcgagttcggcgatgtcgatgaaccaggagccgtcgaattgcaactggtattcgaccgtgtcaacgcattcaagccgtgcaatcgactcaatcagcggatagccgggtttgggtgccagcaccgcgtcgccggcatcgcaaagtaacttaatcagccacgaatacgcctcggacgtggagctcagcaagtacagggcgtccgggtcaacgccctcgatggcggtattcgcattgttgaaagcggcatggcgctcgttcccgccctcgctggcggcgggcgaagtcgactgagggctgcttgcgtctaccgcctttgccgtattgaggaatgcggccaatgcttctcgcgccgcacgcggtccacgcgggtcggccgtatacacgctcggcaccaattcaggtgccagcccgtggcgggtcggattggaatcgttgagtttgctgagtgcgatgccgtttgccttggctgccgcctcggccgccgcaatgggattcggcgcagaaatatccacacgagaagagaaatgcacgctcataccctcccacgatagagcgtggtgccccctgccccgctctcaaacgcgcaacattcccggaaatgcgtcgctctggacccgaatcacaccctcaaacgcgacacattcccgggaacgcgtcgccacagacctccatacacacgcccactttgcgcaacattcccgggaacgcgtcgcatacctttcctatgcaatgcaaaaggccgcccgactagtcggacggcctgaagcatattcgcgggtcagcgctgcacacccacgctcactggctcactgctgcttggtgctggcatagtaggcggcaccgacgatgccggcctggttacgcagcttggcgggcacgatcggggtcttgatatccacgtacggcaggaacttttcgctctgacggctcacgccgccgccgacggtgaacaggtccgggttgaagtacttctccataaggccgtagtacttggtcagacgcttggcccacttcttgtagcccagttcctcattctcgcgaatcgcggaggaggcatacttctcggcgtccagatgcttggcgctcaggatgatgtgtccgagttcggtgttcgggatgagcacgccgttgtaaatcaaggcggtgccgatgccggtgcccagtgtggtggcgatgaccagaccatcctggcccttggcggcaccgaactggacttcggccaggccggcggcgtcggcgtcgtttaccacgacgaccgggcggccgcaggcttcggagaacacttcagtaacgtccacgccaatccaagactggtcaaggttggccatgaagtcgagcttctggccgggcttgatcggcgcggggaaagcgatgccaacgggtgcggattcaggcacttcgaagtggtcgagctgctgcttgacgattttggccacggcctgaggagtggagacctcgggagtgagaatcttcaatcgtggctcggcgaaatcgcccttggtcagatcgacaggtgcggccttgatgccggaaccgccaatgtcaacaccgaaagcctgtgcagtttcaatcatcgttgaccttcctttccatacgttttcatcagttcgtaaggttgcgcccagtttaacgcgaattacgctcaacacgaaaccattacacaccaattgtgcaaacgtgtgcatcgtcgccggtcactacgtaccctattcgtatcgtttttcaagcctgacaatgggcaatgcatgcgatttcgcatactaggaaaaatcggcgtctatggtggcctgactctgtgtcgcgcgcgataatgggaggtatggcagaacatacccaacttattgatgcaattaacatccgcaccgccgtacgcgcctacgatgatgagccgatcgacgacgatacggcccgccagctcgagatggcgcttcagccgatcaacttactcggcgatctcaacattcagctggtgcgcgaccagcccaaggtgttcgccgaagccaatgcttcaggtcatctgaccaatgcggcgaattatctggccatcgtcggccccgcgaacgatgaggaagccaaagagcgtgccggcttctatgccgaacgcatggtgctcacggccacgttgcgcggcctcggcaccttatgggtcgccggctcatgggacaaggcggaggcggccaagcattgccgcgtcacctctggccaggagctgtatctcggtgtggtgatcgggcatccgaagaatcatctggattatcaggcgaaatcctatgaggagctatgcgaagcgcaacgcacgcaccgcgccaccaagacctatgagcagttcaccgccacaatgagcgatgaggggcgcgaggccgctccggattggttcaagtccggcgtcgaggctgcgatgaaggcgccgagcgcgatgaaccgtcagccaatcaccttctcgtataatccggccgacgataccgccgccgcgcatatcgatcagagtgcggaagatgagcatcacgcgttcaatgacatgggcatcgccaagctgcacttccagatcggtgccggccaaggccagtgggcttggggcgacggtggcctgttcatccataagtaacctgtagtgaccccctcatagaggggagccactactacggctacttcagcgacggcatgagcttccaggtggggtcgtgcatcagcttgcgcgagtcccaccagcccttggcaatctgtaccaaaccggtcttgaggtgctcgcgatccaccatcaccaggcgaatgacttccttggccgcggtgagcacggtacccagtccaaacaccagcggacggaagtcaccataggtcatgaagtaccgggccatgtatccgcggttgcgcatgatgtgataccggttcatgtcggatgtggagttgagctggcgcacgccggcgatatcccaattgccgatttcgcgcgtacggcgcaggatcacgtcgggcaccacaatcgggttggtgaccttgctggcgcggtagccatacatcgtgtcatcccagtagatgaagaagcgcgggtccggcagaccgatttccgtaaccacacggcggttgaacaggccgccttcgaagcacagcgtgtccatcactcggtatccggccgggccgaatgcggcgggcgcaatcgggttcgggatgcccagcggcacaatgaagtcgtactgccagtagaacgggccgccatcgtagtcgaatcgggagccctgaatcacctcgtgcttgtcggtccacttggacagcttggcaatggcgtccggcagcacggccacatcgtcatccatcacccagaaccatgcggcacccagctcgtaggctttggccacgccggcggagaaaccgcccgcaccacccaggttctcggtctgcggcgcatagaccacacgttcttcgttaccggactggtcggccacggtggtgccccattggccggtcaccttgccggcaaacgcagcgaccatgtccgccgtctgatcggactgctcattgtccacgatgacaatgcgccacggtgcctgttcaagcgccagaatcgaatcgaacagtgtctcaagcaactgctgacgtttgtaggtggtgacgatcagggcaagcttgtcgatggtgttgttgggtttcttcacttcagccatggctcccattgttgcacttgaccggcacaagacgaatttctgcacagtgaaacgcgggttgcatacgtccggcgcatggcgtatgaataagcctgtcagtttcagggaaggtgcaattccttactggcggtaacctgcaccccgggtttcataacggggatggcaggaagcccgcgacccgcgcaagcggctgatccggtgagattccggagccaacggtatagtccggatggaagaaacgagggctcattatgagtgtatcttcgcgtattcgcatgcaagttgttcgttctgtggcacccgaggccgagggttcggccagcacgtccaccgccagcaccagcgccaaacttggctcacacaccactggtgtggccgattctggccgctggtccacgcgccgtatcgccatgtatgcactgttcgtggcgctggcgatggtcaccagcttcattgaattcccgattacgccggtcacttggctgaagtacgacccgtccggcatcgtctgcctgattgccggctttgcgtatggcccggccgccgccgcaatcgtgtctgtgctcggctttgtgccgcacatgttcgccaatccgtggggttcgctgatggctgtgctggtggcgctgttcctgtctgtgccggccgcgttcatctaccgtaagatccgtacgcgcaagggtgccgccatcggcattctggtgggtgcggtgctggccatcgtggtggcgctggtgagcaacctgattgtcacgccgatttacgcgcacatgacctaccaagctgtggccgcgatgattctgccgattctgctgccgttcaacgtggctaagatggcgattcacgccgtgatcaccttcctgatctacaagccgatctccaacctgctgtccaagcagcagtgactggcctgagacgggccgatgcccgccacgactaacgaccactcaaagaccactcaaagaaccagaacgcagaatcccggcacgggccgggattctgcgttttcgcctatcagttacggattgctgtttcatgaccgttgcaccccattccttcgacgccgacgagttccacgattctgccgaacctcacgcttccgccgagcctgcctcccccgccgccgtgctcaaggacattcgtttcagctatgaccgcggcacctcatgggctttggatggcgtttcactcacggtccatgccggcgagcgcctatgcttggtcggtccgaacgggtcgggcaaatccacgttagcccgtctgattgcgggattgaccgcgccggacggtggtgaagtgacgttactggggcaacgcgtgtacgcagccggcccgaatgccgatgcctatcgtgctgcccgccacggcatcggtatggtgttccagaatcccgaggatcagctggtcaccaccgtgttggaggatgacgtggcctttggcccggagaatctcgggctggagcgcgagctcatcggcgagcgtatcgttgattcattgcaggccgtggggttggcgaacttacgccagtccgacccgacccgtatgagcggcgggcagcagcaacgcgcctccatcgccggcatgctggccatgaacccggcaatgctggtattggatgagccgaccgccatgctggacgaatccgcacgcgccgaagttatgcgcattttggatgatttgcaggcgcgcggcaccactattgtgcatgtcacgcatcatccagatgaaaccgttcatgccgatcgcatcgtgcacatggaggccgggcgaatcattggtatcactgcagccgtcgataatcgatccccgctagcggaggctgtctcgcaaagcgagactgagggtagtatcggcacagaagccgcccccagtcgccctacgaacgacagcccccgccagcgggagcgcgaagacggctccgaactgccgctgctctccgatggcatcggtgatatgacgaaccccattattcgcgtctcgcatctgacctatcgctatccttcggccaaacgggcggttatcgatgacctgtcgttcaccatcgcgcgcggtgaaaccgtggcactgatgggcgtgaatggttcgggcaagtcgacgctggtgcgcatgttgtgcgcactgactgcgccgaccgccggcagcatcgaagtggccggtgttccggtggcctcgaccggcaagcgcggtcgcaacgtgcgcccgaagtcggcgaatcgcaagcaattagcgcaattgcgccggcatgtgggttacgtgatgcagcatccagagcatcagctgttcgctgacacggtagccgaggacgtggcgtacggcccacgcaaccaagggcttggcgagaccgaggtagccgaccgcgtgcgcgaatcactggaactgctgcatatcgggcatcttgccgaccgctcccccttcgacctgtccggcgggcaacaacgattggcagccattgccggcgtgctggcttgcaatcctgacgtgctcatcatggacgagccgaccgcgagtctggacgcccaagccaagaagcgtatccatgagctgttgcgcacgctcaaatcgcgtggcgtgaccgtgctcatcatcacccatgaccgggaggaggccgagcaaatcgccgaccgcgtggtccgtatgccgattgccgcccccgcatccggcggccccgtcacggccaccgtcaccgagccggccgtatcctccaacggccctgcgcactcagtgatacaccgacttgacccgcgcgtgaagatggtgggcttcctggccgccatgttcacgatgttcgcggtgaacacgccaacccagctcgcgctgggcatcgccatcactctggccgttatcgcggcggcacgcctgaacccgttacgggtgcttgaatccattcatccgattctgatcctgctggtgctgatgggcgtggtcaatctgtttgtggtacgcaccggcacgccggtggtggcgcttggcccgctaagcatcaccgatcagggcgtgaccatagccgtgctgtacgcctgccgtttcgcattggtaatcattctgggcgcggtgttcctcactaccaccacgcctaccgccatgaccgacgccttcgccaccttgatcagtccgctcaaccggctcggtatccatgcccaagaaatcgcgctggtcatgagtctggcattacgattcattccaacgctgaccgacgaaacccgcgccatcgtcgacgcccaatccgcgcgtggcggttccatcgaaaccggttcactggcccagcgcatcaaggcgatgagcgcgattatcgtgccgattttcgccggcacgttgcgtcacgcggacaacctgagcctcgcacttgacgcccgctgctacgaggagggcatccgccgcacccactggcgtgccctgaccatcgccgcgcgagatctcatattcgccgctgccgtcatcatctacatcgcggccatcatcgcgctgtagggcggcaaacagcgcagacagcaccggttgctatgctggtgtggttatacgaaagatgtaaggaaattcccatggcattgaccaagaagcaaatcaagcagctgcgcgcgatggcgaactcgctgaagcccctgttctatgtgggcaagaacgatttgaccgagtcggccgtcaatcaggccgatgagaccattgagaagcacgagctcatcaagtgcgccgtgcaggacggttctggcctgaccgccaaggaagccgccgccgagcttgccgagcagctgaacgccgaagtggtgcagtccatcggcaatcgtttcgtgctgttccgtcgctcccggcgcgacgatgtggagcatatccgcttggtgcgcgagtaatgttcgccccgctcgatcccgtagcttgatatgagtaatggcggttggaatcagtccgattccaaccgccattactcatattcgcccagcgagcaccgtcactgatccaagatggacccgacgattcccgcaacaatggtcaggaccaaggaccccagtaccgaccaccagaaaccgtgtacgaagacgcccacgccgaacagactgaccgccagccagctggcgagtcgcatgaacagccaattgataatcaaggtgaccagcccgagagacagaatcgcaaacggcagtgcgatcagatgcacaatcggcttgattgacgcattaatcagcgccatgaacaaagcgaacgcggcgatgccgagaatcggaggctcccccaccggggtcatgccgggagtcaccgcgaccatgacggcggcggcgatagtcataatcaaccagctggtcaggaaacttctcatggcccaatcgtagcgcggcaggttttactattgggcaaaacatgagatgatgttgtgcagaaacggtaagaaggtattgccgttcccgattgagaggggactgacccgcatgactgataatcaacaacaaccgtacggttcggacagtgttccgcagccggcacagcccgcacagccggcacaaccgtcttacggccaagatgccgcacagcagccgcagggctatggcgccccacagcccgccgcatacgctcaacccgccgccggaagctacggccagcagcaaccgcaatacggccagcccgccggcgcatacgctcagcctcagtacggccagccgcagtacggccagcccgcacagcccgcagcgggctacggccagcagcccggctatggacaggcttaccagcagccgaacgcctacgcgcagccgcaatacaccgccgctccgtatgccgccgccccggtggggcaatcgtccaagtccaagctggctgccggcctgttgggcatcttcctcggcggacttggtgtgcacaacttctatctcggcaacaccggcaaggccgtggcccagctgctgctgacgcttgtcggctggattctgctcggacttggcccaatcgcagccgccatctggggctttgttgaaggcatcatcattctgtgcagcaagcccggctcaccgtggcataaagacgccaacggctacgaactatcagactgaaactaacctcgggccacgttcattgggcccctgatcaaccacgcctctgcaggtatcatctcgatgccgcagtcgcagcgggatgcgacacgccggccgtgtacatgagttcatgtacacggccgttttctttgttgctttcaccctcaaaacaaacatttatcatgttcacttttgcaagatatgaacatcagacatcacagactaccataacttcccaattgcattaccaatagattaataaccggcaaaacggcttatatccgccatttttcatgctaggctttgaaaccagcacatcaacaaagtgcacaatccttttctacagagaaggtaacatgttgttcaattcatatgtgaatcgaacaatgccagtacttccctaggtgcttgcttggggaacgccatgctgaaaggaacacattatggcggagggaaaagtcatcatcgtcaacccggatatgttcggcaaggacccggattcgaaaacaaccaaggccaatgaagtggccaagagcttcggcctgagcgacgcggcgttggccgaggtcgaggacttcaaggcacaactcaccaaacacaacgcctgggatctgccgttcatgggatacgtcaacgaggatggctacggttacgcctacgtgcccggtgccgccgtggtgtacgacccgtactgggacgcccaccaagcattcctggcgctgcctaaggacgtgcagaccacattcgccattcgtatgctgttcacgcaccgtccggtcgaccgctatggcgccagcatgttcctgcattaccagcgtggcttcaacgtgaagttcgagggtatcggcgcgaaccagtactgattggtactgactatcaaccatctttttcggattgcccgataaggggcgtataacaacggtgttatacgccccttatctgtattcagtgtcaggcgatggccgcccgccgcccgacacaggcgaatcagtatcgcacgagattcaacagttcctgctgtttggcatagcgggaaacgttggtcagggcgatgcggatgatgtgttcggaagtcttttccaaatgattgccgccggccacatgcggggtgatcaggcaatgcggctcatcccacaacggactttccgccggcaacggctcaggctcggtgacgtccaatccggcaccgtggagccgtccattgtgcaaggcgtcagccaaggcctcgggatcgatggcgtcgccacgcccggcattaatcacgatggctgtggatttcagacgacccagacgatccgcattcagcagatgatgggtctgcggcgagcgcggcaccgccatcgccaccacgtctgccaatggcaacagcgtctccagccgctcgaagccatacatcttttcaatgcccttggccggcacgtccgcatgacggcgcacgccgaaagtacgcatacctacggattgggcaagctgagcgaaatgcgacccgatgtcaccgacgccgataatcagcgcgatgccaccttccgggctcaataccggtccttcatcctgccactgatgatcacgctgattggaggcataccggctgaggttcttcatcaatgcccacatggtggcgaacatgtgttccgacacgctttggccatacgcgccgctcgcattggtgaccatggtgccgcgaggcagcacacccgggcagatgtacgcatccacaccggcgctgaaggtctgcaaccattcaagacgggtgtattgggaagcctgcgagaccggaaagttgccgatgactgcggtagctcgggagcgaagctcctcgggaacagcggccgaccagaccatgtcgccgcggtgcgcttcgtcgcccacgaattcctgcggcacatcgcgagccgccttggcgaaagcccgccgttctccttcgttgagtggcaggcagttgacaatcagcttatgcgtgttctcaatacccatggttcaccaaactaggcggcagggcagatattatcgcggtttcctcatgctgaaccaatgccgaactgctaccggaccaatgccgaatccgccccatcaaaccccaccaaaccaagggacaacccattgcgcatcgaccgtagcgtccgccccgaaccgtacactcacaggtggttttgtgattccatagcgtgcagccaaggcagtacgattgccggtttatccgcacgcacaggtacctacgccggttggtaaaccttacattccataccttgcaaccgaacgtttaggagcatgtatgcctgagcagcatattgataacgagaagattcccacacgtcttatcggcgcgattgtggctgtcggctcacttgccttcattggcattctgaccgaaaccgtgatgaccgtgcttttccccgcactgatgcgcgaattccatgtcgacacggccactgtgcaatggattaccacgatttatctgttggcggtggccgctaccatgcccatcagctcgtttttgaagcgccgattcgcgctgaaaaccatttttcttgcggctgtgattctggccatcgttggctcgctgatcatgatcgtcgcccaagccttcccgctgctgattgtcgcccgcattattcagggcattggctcaggcgtggccacgccgttgatgatcaacatcatcctggagcagtctcctcgttcgaaaatcggccgattgatgggcgtaggatcgctggtcattaccgtggctccggccatcggcccgaccgtcggcggcgcggtgaccacagtgctgccgtggcgcgcgattttcgtcatcgccattccgctggtgctaatcgcagcatgcatcggcatgaagtgcattgagcagaagacaccgaccgaggctgcctatcttgacccgattcagcttgggtccattgttgtcgcgttggtcggtctggtgctggcgctcaaccaaggtggcgtggccatcagtgcggcggtgtccggcaagtcagccacacgctccggcattatcgccattgtcagtctgattgcgggcctcgccttgttgatcgtgttcgccatgagttccaagcgtgccttctccccgctgctgcgccttggcattctcaaggatcccgccgtactgttacacgcctgcgcatatctgctgctgccattggtcgccatcggctacggctatgtcatcaccaatgtggcacagctctcgctcggtaccacggcatttgtggccggctctctggtactgcccggagcactggtcggcgctgtctgtgccccgcttggcggctggttctacgataagttcggcgcggtcaagccgattctgattccgatcggcatcgctattttgggcccagtgcttatgctggtgttctcgatgcagcttacgcccttgctgctcgccggattctatttcattttcggtctgttctattccatcggcaatgcgaatgtgatgaccagtggcctgtcggaggtctctcccgagttcaagccggacggcaacgccattttcaacacgtgtcttcagtttggcggcgctgccggtaccgcactgttctccacgattctttccgtggctcaggccggcgcaggagaagaaggcaccgctgagtttgctcacgccactgccgtcggcggcacatggacgtttgccacgatgacggttatctgcctgattggctggtgctgtctggccaccgcgttccgcattcgcgcggcacgtaagcgtgcataaatccgatcatcaatagagtcccagctttccaaacacgtgtggggcgtgccccgggagaaccccggggcacgccccacacgctaatgaaaggaagaaaaggagaaagaaagctttggcgggcagtgccggctgctgtgaccttgccatcacagcagccgggctgatcccgcctattcagttatggtgtgtgtcgtattcggtgcggagaccgagcgggcaagcccgctattttttatctccgccgaccgccatcaccgcgcgctgaagcacaacgaagacgaggatcatgagaccgataacgatggtggtccattcggccggcacaccgaagtcagaggtgagcggatcgaggatggagcggaccagagagccgagcacggagccgagcacgtagccgaagccaccggtgatgatcgtaccgccgatgaccacggaggcaacggcgtcgagctcccagccaacacccacagtgttcttggcagagccgatgtttgcggtgtacacgatcgaggccagggcggcgagagtcgcagaggtcaagtagatgatgtactgcgtgcgcttgaccggcagacccatgagttccgcggaggaacgggagccgccgatggcgtagatggtgcgtccggtgcgggtatggtgcaggaagacgtagccgaagaccacaaccaccagtgcgatgatcacgccgacgttgaaggacagatcgttggagatcttcggattgtcgatgatcttgatcacgttggagatgaacgagaagtcattgccctgcgggaaggtcagcgagtcggtggagatgatggaggcaagaccacgggccaggaacatcgtcgacagggtcgcgatgaacggctgcatgttgaattcctcgatcaaggtgccggccagcaggccgaacacagcgccgatgagcagcatgatgatcatgaccaggaaggcgggcacgccggcgttcgccagcttcaggccgacgactgcggtgatggccacgatagcaccgacagacaaatcgataccaccggtcagaatcggcagggtcatggccacagccagaataatcaggtaggcgtggtcaatgaacagggaggagatgaagcccagtcgaatgtaggtgccgaacaacgcctgacccatgatgatcatcaggatgaagatcaccacggccgcgagggtcgggatcatctgacgatcgagcttgaagcccttcttgggagccttcactttgtttgccgtagctgttgtcatgctgccaccgccttagcttgagccttgagcgcgcgcttgcgtttcatattcgcgctcaggttgtgaatcttcggagcctgcatcacgcagatcacaatcacaacgacggcgaagaaggccggagttgcctcggcgttgacgcccagggtgatgatggtcttgcggatcatggcgataattacagcaccgacagcagagccggcgagggagaacttaccacccagcagtgaagtaccgccgatgacgactgccagaatggcgtacatttcgaggtcctgaccggtcttaaccacgtcgacacgcatcacggatgcggtggcgaacagaccagcgatggccgcgaggaagccggaaatcgcgtagacgaggaagaggatcttcttcggcttgataccggtcatacgggaggcttcctggttgatgcccacggcctcaatcatcatgcccatagcggtcttgcggcacagcaggccaacgagaatcacaatgataacggcgatgacgaagttggcgggaatgcccagaatgaagccgttggcgaaccacttcagcggttcgttgccagcaactgcggaggcgtcggtgttctcaccggaggtgatgaccttggccataccacggccggcgagcatcataatcagggtggtgatgaacggctgtaggcccaggaaggaaaccagagcgccgttgacgcagccaatggccagaccaacagccaaggcgatgaggatggagagccacacgttcatgccattggacagggtctgcatggcggcggcacctgccactgccataacggaaccgaccgaaaggtcgataccggcggtggagataaccaaggtcataccggttgcaatcatcaggtatcgggcagattcctggagcatggtgatcagcgggccggccagaccaccggtgttgctgttccagctcaaagccaggaagtcatgctggaagatggtgcagatgatgaccagaagaatgaatgcgacgatcgaccaggtcaggttgctgctcagcagcttcttgacaaagttgttgccctcggcttttgccttttcagccatctcatgcctcctttccggtgtttacgttggtgttagcgatggtttcgacgatggtcgcctgagagacggtgtcgtcgttttcgatttctgcgatcttgtggcggtccttgagaacctcgatgtcgtcggacagacgcacgacctcttcaagctcggaggagatgaagacaacgcccatgccctgagaagccaggtcaagcacgacctgctgaatttcagccttggcaccgatatcgataccacgggtcggctcgtccagaatcagcagctcggggtgcgtggccagccaacggccaatgagcaccttctgctggttgccgccggagagattcttgaccgggcgatccgggtcggcgggacgaacgttgagttccttcatgtacttgtcaacgatggcgtccgcttccttcttgggaatcggcttgaacataccgcgcgttgcctgcagggcgataaggatgttctggcggacggtcaggtcgccgatgatgccctcatcacgacggttttcggtggagtacgcgattttgttcttcaaagccgtgtacggatcggagatgttgaccttcttgccgttgagcgtgtaggtacccgaatccggcttgtcggcaccatacaggagtcgaccaagctcggtacgaccggagcccagcaggccagcgaagccaacgacctcacccttgtagatgtcaacatcaaccgggttgatggtgcccttcttgccgaggcccttgacatcgacgatcggcttctcgccaggggtgatttcacggcgagccttcttggcaccaatctgggacagctcggcggcggacttaccaatcatcatgccgatgagttcgtcgcgcggggtgtccttggtcatgacctccttgatgaactggccgttacgcagaatggtcagacgatcggtaatctcataaatctgatcgaggaagtgggagacgaagaggatggccacgcccgagtcacgcaccttgcgcatgatcgcgaacaggtccctgacctcgttggcatccagcgaagaggtcggctcatcgagaatcagcaccttggcgttgataaccatagcgcgggcgatggcgaccagctgctgcatagcgatggagatggagctcagcggagtgtgcgggtcaatggattcgaggcccatctgtgccaaatacttcttggcggcctcgtgggtcttcttccagtcgatgccgaaggggccgcgcttttcgtggcccagcatcacgttctcaccgacggaaaggttggtgcacaggttcacttcctgatacacggtggcgataccggcgttttgtgcgtcgagggtgccgttgaactgctgaggcttgccgtccaccataatggagccggcgttgatcttgtacacaccggtcagagccttaatcatggtggacttgcctgcaccgttctcacccatcagggcgtgaacttcacccgggtagagagtcaaatcaacaccatccaaggccttgacgcccgggaattcaatcgtaatgcctttcattacgacgatggggtttttatctgtcatgtctttgccttaaacgagaatgagatgttatcgttttgtgatatttgagccacacatgagtgatggcgtggaaggaacatccttctcacaccatcacatcaattatttggtccagttatcaatgagtcgcagcagacttatcagtaggcgcgggtgttgttgtccagggcttccttggcggaggcggcctcgaaggtcttggactcgatctcgatgtccttctcaacggtcttgccatccagatagtccttgacggcctgagcggtttccttaccgaagatcgggttgtactcgatcacgtaggagaggtcgccatcaacaagagcctgcagagcgttcttggtaccgtcgatggtgatgatcttgaccttgcccttgaggccggcggcgtcaacagcctgagcggcaccgaggcccatctcgtcgttctgagcgaagatgaactgcgggttgtcggacttgtacttgtcgagcagaccagcggtcacggtcttggcctcatcagtggaccagttagcggactgggactcaagaaccttgacgttggaggcaaccttgttgtcccaaccagtgccacgatccttcaccacggacaggccggcagggccttcgaggatgaagccgttggcgccatccgggaagttcttgttcacgaactcggcagcctgctcgccgcaccagacgttggacggtccgatgtgagcaacgatggccttcttggcctcggcgtccttgacgtccacgttacggtcaacggtgaagaccggaatctcagcctcagcggccttcttcagggagtcatcccaaccggaatcctcggtggaggacaggatgatggcgtcgacttcgtcgttaacgaacttgttgaacgcctgaatctgcttctgctgatcgttgttctgggtcggagagtaggtcaggtcaaagccggcatcctcgaatgccttctgaatgtccttctcgttggcggtacggaagccgccctcaggaccgacagccacgaagccaaccgtcttcttgccggagtccgagctgccacctgcgttgctggaaccgcatgcggcaacgctgacaagcgcagcagcagaagcaacgagggcaatggccttcttccaattcttcataaatactcctcctcgagcagtgtttattttttggatgatctttcatcctgtttggtgactgttcgtcatcgacagcctctagtatgacgctcacaggccaaatgttcaatcgcatgcgataacagtttgataacaggtttataacaaattaataacagtggttcaaaaatggcgtcgcaacactgttttgccttgataacagaccaataatagtgattggttgcgcagcggcaatgccgctcgccagccgagcgacaaagccgttgcctcatacaacaagaaaggttattatgaacaccgtttttcttataccatctactgcgcaccgagggcagtgacctggctatcggcgatggtccaggaaccgtcgagtgagccagaaacggagcgaacaatacccaaatcgtccacaatggccaggcgacgggacaggctaatctgccccgatgccatcgacgttatggttccattaggcagacgctgcgcattggccgggcctggtgccatttgacgccatgcctcttgttgttcgctgtttccctcaggaggtgtggtggcgtacaccagattcagatcgttgtagaacgtgagcatggtgacgtgtctgagcacactcacttgggtggccgctttgctcagaccgctcagtgttttatcaccgttgcgcgccacaccggtcatcatcacgccgttcgtgtcctcgccctcgactgccaacgccaatcggcacccttccggagaaaccgccaatgccacaatgctgtcggcagcgccaagccaatcaagcttcagatcggtttccttacccccatctgacacatgcaattcgcgcccgttctcggatacagcccatacttcgccatccagaccttcggtaatcgatcgcatcgactcgccggagaacatcaccccacaggacgcaccatcagatttcaggcattcgacgacaccgtccgcacgcaacaccgcaccgccggatgaggaaaaaacgaagccccgagcatcgtcatatccgggggcctcccctacacgcaacggactggagctggccagggaaacgatatgcccaccggtcaacgtgtatacgcccgctgtcggctgctcggtagtaagtttcacatttgcgtcggcatcagaatagtccactccgtcgccggtaatcttcagcgcgtattcggcattgccgtcgcccatagtcagacggatgcgatgtaccagcaggcctcgttcttcctcattcaacgcattgataccgctgttaaggtgtatctccaccacattgttcttcaccggcacgctgtcgaccgcgagtttgatggtaggcaagccggtgcctcgcagcactccttccaaccaggagggtgcatccgagagtacttcaccgactgcctgggtgcgccagttgcgccagctcagccatcgaacatccggtatgagctgtttgccggatgtgctcacctgatacacggatacttggcggaagacttgttcaaaatcggcggtggatatcaccacgccgttctccaacgaggagatgcgccactggccgcttcttttaatcaagatataaggaactttgctgatcgtgctgctatctgtcggcgtatacacgccatgcgagtccagagagccgaccacttggagctgtacttctacaatcagcgagctctccgccccttgcggggtactcatcgtattggcacggcggcggaaatccggcgtaccgctgtagaccagtgccgaggaatcgccattccatccggccgacgccgaaccggtcagaaactcacgggccacacggtagccatcggactgtacgccggcaggcatggcatcatagaaccctttgacgatggtttccggctgcgcatcgtccgcaggtccctgaggattggtgtaaacacgctgagtctgctgttccaccggtgccagagtctgcaccgagccgctaatcggcaaaccgaacggacttgagcatgccgtcatcgtgacgcaacagactatggccgcgcctgcggcggcaatcgttctggtcactcgtctcatagcggcctccccatcatcgtgtcgcggcgaacctcatgataatcatgtgtgacttggctggtggccacaccaaacccaccggtaatacgcaggtcatcgggcgtttcagaagcaaaattcaccggcagttcagcgtccgccacctcaccttggtcggggtcacgcggcagcaataccaagaaccaggtgccctcccccactgccgaacgtacacggatagtaccgtggtgcagcaaggcatcagtcatggcgatggccaagcccaatccggtgccgccggtaacgcgcgaacgtgaagggtcgcttctccagaatcgatcgaatacatgagcgactttgtcttcgtcgataccaacgccatagtcgcgaacgctgatggccacggctttgcggttggccgcgacacgcacttcgatcggccggtcctcagcgaaatcgacggcattggccaacagatttctgacgatgcgaatcactcgacgcgaatcgatacgagtcaaaacctgcacattgggcagatacgtgtgaatcggcacccgtttggcttgggcgatgccggcaacttggtccactgccgtttcaattggttcgcataaatcggtttccacaaggtcaagtgccgcataaccggcatcgtagcgggagatttccaacagatcggcgagcatgtcttggaatcgactgatctggccggccaacagttcgaccgtacgcttggtggaggggtcgaagccgtcttttttcatttcgagcaggtcggaagccatacgcatggtggtcaccggggtgcgcaattcatgactgacgtcggacacaaatcgtttctggaaaacgcttgcttcctccagctcatcaatcttctggttgagcgcatcagccatcgtattgaaggattgctgcagcacaccaagctcatccttacgattcacggtaacgcgcatatcgagattgccggaggccagtgtttccgaggccgctgccactcgttcaatcgggcgcacgatgccacgaatcaccagccagattactacgcccaccacgatggacagcaacgcacagatgaccaccagactgagctgaatctgcgtcaaggactgctgctggaacgtgtacgaataaatggcgaagaattcgaggttgccggccacgccaaagtccaatacggtgccgagcaccgctgcgggcgtcccgctgcccgacatgccggaatcaccgggaatttcgaccggctgatagaacacgctgtcatccaagtcggaggccacggacgaacggatgtcatcagaaatcagactttgatagctgggttcggtggatacggggatgatggcacgcgagttggtatcacgactccacaaatacacacctatcaggttggagggcccctcggattgcaacgaggacgccaagtcattgaccagctgctggatctgcactgtggcggagacatcggccgcgtccagactggtttgggcctgctgcaccatgtttgaatagtcggcacgcgactgcgaagtgatttgggtaagcagcgaggcgcgcactgataccatcgatacgccagagaagacgatggccacggccagtgtaagaatcacggtgagggccacggtgcgggcctgcagcgagcgacgaacttcagcgcgtccgtggcgcagcaagcgtttgaggctgaatcgagggcgcaggttcattgttcaggagtgacgaacttgtagccgatgccacgtacggtctgcacgatttgcgggttctcggggtcgtcctccactttggccctaaggcgttgaacatgcacattgaccaggcgcgtatcgccggaattctcgtatccccagacattcttgagcaggctggaacgactgatggcctcgccggcggcggccgcaagcatgaacagcagctcgaattccatcggagtaagattcaggtccttgccatccttggtggcggtgtgttccaaacggtcgatgacgatggatccgcgttccagatggttgacgtttgcattgccaccgcttgcgccaccggtggcaccgtcttcggcggccggcttggcgatgcggaagcgtgcatggatacgcgccagcaattcggccactttgaagggcttgggcacgtagtcgtcggccccggcttccaagccggccacgacgtcaagtgtgtctgatttggcggtgagcatgataatcggcacattagaggtagctctgatgcggcgggccacccccgtgccgtccagcccggggagcataacgtcaagcagaatcaaatcgggcttgacgatggggaacatttccacagccctcagcccgtccaggcaggtcacggtctggaatccctcgttttccaaaacaagactaagcatttcgccgatggcctgatcgtcgtccacgatgaagatggtcgccatggtgtttgtcttccctttcccactgttattgttgcgttacactttactcccctatgttcatttctgttcgggttccccgccatgcaacatcgggcgaatcttggcaagacgctggctgacttcgtgttcgtagccgcgatcgttgggatggtagtactcggtgccacgcagctcttcgggcatatattcctgtggcgccacggcaccgggccaatcgtgcgcatacttgtagccctcgtggttgccccactctttcataagcttggtgggggcgttcctcaaatacagcggaacagcgccgatcttgccggcatccacgtccgcgagcgcctggttaatggcgttatagctggcgtttgatttgggcgcggtggccacggcaatcgtggcctcggccaaaataatacgtgcctcgggcatgccgaccagcgccacggcctgcgccgcggccacggtgacctgcaaaatctgcggggcggccatgccgacttcctcgctggcggcgatcatgatgcgacgggcgatgaagcgcggatcttcacccgctttcagcatgcgtgccagataatggatggcggcatccggatcggagccccgcatggatttgatgaatgcggaaatcacgtcgtaatggtcatcgccgtctttgtcgtagcgcacggtggcggtgtccattaccgtagccacgatttcgggggtgatgatgggtcggcgtgcgccctttttgcgggcttcgtcgccagtgaccgcgccagccgcggcctccagaatcgtgagactcttgcgtgcgtcaccaccggccatgcgcacgatgtcggcgatggcttcgtccgtggctttgacctcgcccctgagaccgcggtcatcagtcagcgcgcgctgcaccagttcgatgagctgatcaggctccaatgactcaagcttgacgaccaccgaacgggagagcaacggtttgatgatggaaaagctcgggttctcggtggtggcgccgataaaggtcacgtcgcggttttcgacggcgggaagcagcgcatcctgctgggatttggagaagcgatgtacctcgtcgatgaacagtacggtttcctggccgcgtgacacgagccgttcgtgagcgcgggtgagtacgtcgcgcacgtctttgacgccggatgtcacggcggagagttcctcaaacacgcggccggattggccggccacgatggtggcgagcgtggttttgccgacgcctggagggccgaacaggattacggagctcggcgcggtgagactgcctttgctggccggattggcgaggcggcgcagcggcgagccctggcccaacacctgcgtttggccaatcacctcgtccaaagtgcgtggacgcatgcgcaccgccaacggccgcgtcatcgactccggcgcatcagccgccccaaacaaatcgttctcactcataacgtcctatagtaccccagtgttcgaacagacgttcgagctgcaccctggcttccctcagagaggggagccaagaaaggaatcagttactcaccttgtagtcgcggaagactacttcgccggtgtcttgggtggcgtcgaggtccacgatgccttcgatggcccaatcgtgatcgccatcggaatcatcgataatctgacgcaccttccacgtatgctcgtcgttctcgtgcttgtcatccaacatgaacagttcgggcgagcgtgcttcggcgccgatgcccacgtactcgtgctcgtcgtagtagtcgtcgagcacatcttcccattcgtgcacgccgtagccccagtccttgtcgagcgcgccgagcttgtccggctggtcaaggtccataagccgcacacggcggaacaaggcattgcgcaccagcacggtaagaccacgacggtcctcgaccaccgcgctttttgcgccgggcgcggccagggatgccgcagcctcggattggtcagccgagtcaccggcgttctcccattcgtccaccagcgaggagtcgatggagcgcacgagcacgcgcagccacgagatgatgtcttcgagttgctcgtcacgcttttcgggcggcacggtgcgcgccagcgtgcggtaggcgtccgagaggtagcgcaacagggtgccttcggagcgggcgatgttgtatcgggtgatgtatccggtgaagtcggaggcggtttccaccatgtcgcgcaccacggatttcggcgacagccagtagtcgttggcccacggcacatcgtggcggtactgatcgaacgcggcttcgagcatgtcttccagtggcttcggatacgtaatctcctgcagcttatccatacgctcgtcatagtcgagtccgtcggccttcatatcggccatcgccttgtctcgggcctgacgctcctgggcacgcagcacctgcttggggtcttcgagcgtggcctcggccatggagatcacgtccagcgcataggtgtcggactcggggtcgagcagttcgagcgcggccagcaggaacggggagagcggctggtcgagggcgaagtcgtccggcatatcaagggtcatgtagtagtccttgccgccgtccttgcggtcctcggtttcgatgacttcggtatcgaacagggtttggaagatctcgtcggcccgctggtgcagatgctccttctggtcgggggtctgcgcggaatcgtcgatgagatcgtcgatacgggcacgggcgtcaccgccctgcgccacttcattgagcaccatcgaatgcgtgattttcaggtgcgggaccagggtttccggttcggcgtcgatgagcttatcaaacgtgctctggttccaggtcacaaaaccttccggcgccttcttgcgcttgaccttcttgagtttcttcggatctcccccggccttggcgatggctttctggttttcgatttcatattcgggagcctcggcgatcaccagtccctcggtatcgaatcccatacggccagctcgtccggcaatctggtggaattcgcgggcgcgcaggcggcgcatcttggtgccgtcgaacttggtcagggccgtgagcaccacggagtgaatcggcacattgatgccgacgcccaatgtatcggtgccgcaaatcaccggcagcagaccctgctgggcgagctgttcgaccaggcggcggtagcgaggcagcatgccggcatgatggatgccgacaccggtgcgcagcagtcgctgcagaatcttgccgaaggctgtggtgaacttgacgcctttgatggcttctgcgatggcttggcgctgttccttgctggatacaccggtggaggcgagcgcttgcgcggtctccaatgcggcgtcctgcgaaaagtggaccacgtaaatcggggtttcgccgttgcggaaggcgagttccacggttttttccatcgggtcgagcgtgtattcgtagctcaacggcaccggtcgcggcgcgtcggcgattacatccacgtccggggtgtcgttcagatcggagagcttgtcggcgatggcgtccacattgccgagtgtggcgctcatcagcaggaactgggtctgcggcagcgtgagcagtggcacctgccacgcccagccgcgctccggatcaccgtaataatggaattcgtccatcgccacgaggcccacatcggcatgggtgccttcgcgcaaagcctgattggcgaggatttcggcggtgcagcagatgatcggcgcgtccgcgttgatgtggctgtcgccggtgatcatgccgacgttgtcgcggccgaacacttcgaccaagtcgaagaatttctccgacaccagcgccttgatcggagcggtgtaataggagcggcggccagtgcacagggcggcgaagtgcatgccaagcgccaccagcgatttgcccgaaccggtcggggtattcaaaatcacatggtcgccggccaagaggtccataatggcctcttcctgatgcggccatggttcgatgcctttgatgtcttccacccagccgaagaatcgttcgtagatgtcatcggccgtaagattccgttcacgctcgtcaccgtcccattcgggggccagccgccccagggatccgtattccttctcgtcagtcataatgctcagtctacctagtggcctattccgacggcacgagccgccctccgtcgctatgcgacgcctcccgccagcgggcggagccatgcgaagagctgtgccatgcgcttggctccgccaatgggaggatcgctcacgccaaccggcggcgcacctcgtcggggtccacctcgggttcgaggggaggccaggtcatgttcatgttcttcaaggtggtgcgcagcagttcggagaccacggctcgcgaataccagcggttatcggccggaacgaggtaccacggtgcggcggccgtgctggttttctcgaacacttcctgccaagcgaacatgtactcatcccatcggtcgcgggcctcgaggtcggagatatcgaatttccagaacttggtgggatcatccagcctcccaagaaagtgttttttctgttcttcctggcttaccacgaggaagatcttgaggatggcgcatccgctggcggccagttcacgttcgaaatcgttgatctggtcgtagcgggcacgccatacgtcttcgggataggtgccatagacgtgcggcatgaccacatcttcataatgggagcggtcgaatacggcaatccaccccggcttgggcaattcacgcttcacacgccagaggaagtcgtggtcgagatcctcggccgtaggcttgccgaagccatggtaatggatgcccatcgggtcgccttggctgaacacgtgacgcacaatgccgcccttgccggaggcatccatgccttgcagcacgatgagcagccgccgtgtcgagcctttgacgccattcgcgtacatgagccgctggtatcgggcgatttcggaggagctgatcgaaatgaacttctcggcgtcctctttattgccgtcgaatccgggagtggaatcgccttcgacatcagtgacctgcatgccgtggtggaacataagacgttgagcgggcggcaacgaccatacggcgctgagcagttcactggatttcgccgcacgcgccagtcgttcaggcacgctggcactggagtcgatggtgtctatgcgatccaccgcgagctgtaataccttgtcgatccgtcgatcggttttggattcctttcccttgccgttcttgttgttctttcctgaggattttccggccgtaccccacttgccggcctcttcaggctcgttggttctgtcgtcgtccttggccatgctcccgattgtacgtcttgtaactcaggagacctagcaacgtagcgacattcacatttcgcctgttactgcaaatctataggcatgcagtcgttcggaccgtaattgttggctttgcaccaattccaagcctcatctgtcgagtcgaagccctcaccggcaagaatcacatagtatttgtcggaattgctgctgtaggcgggccagtcacccgaccagataagcagtacgtttgaattcttgttgtgcatcgtgatgaattgcgcaagaatatcgcggtagttccaggtcttgccttcagcctccatacccttacgcttgctggacagctgtgcggtatacgtggaatagacccgaaaaatcgaacacggcatcggccacgacattatcgtcgctgtcctgcaacgtgagtcgggtggccgaatcattgaatttcgtggatgcgttcttatcatcacaattcgaagtggccagaatcgtgactatcagattatcgctctcgctcttgatcgaggagactgtcatatcgggagcggcatcgcaggttttggcaggcttggccttgtctttcgacttcgatgcgctgccttggttaccggattgtttggttgcggtgccggaacttgtggtgttgggagacgatgcgccgccatcaaaccaatgcacggtaccggttgccaccaaagcaacaagcacacccactaccacaaccagtgcgatgacgacccccagcaatatcttctttccggcagacccaccggaacgcggctgcgcagcgccaccgttgcctggcgccgtcgacaatgtcgaagtaggtgcattcgccgtgttgaaacttgggggcaacggcatcgaacccgctggcacctgctggggagcagccggtaccagcgtcgggccatccatcgactgaggacttgggcttggcgcagactgtgccatcggcgcaccgcattccgtgcagaatcggcttccctccggcatctccgttccgcaaacctggcacttcatactctctccgttctctctcgtccctatcggccaatcccccgcccgttttgcagtacataaagaagcggcaaacggcccgaaacatacctgagccatcaggaagacggcacgatctactacgagaaagatatcatcaccgaccagcaaatcgtcggcatcatgctgaagcatccgaccagcgcacgcggcttcaagcgctacttgcgcgccgcatcatgacgcttgaccacgatggtgacgccacccgcagcgaacagcgtcgccagaaccacaaccaacgcaaccgaggcaccggtattggccgtatgttcggtctgctgtggcttggtgctgccattggcattgacgctaccgctatggttgccgttatccttgtcgtccgtcccggtggacactccggtaacggcaacgggcagagcgaccgtggtcttattggtcgcaccggttacggtcaggctgatatcaccggtcttggttccggcgggaatcgtgaccttgagctcggcggtatcgccattcgcaacctgcgcttcgccgaccacctgctcgccgatggtggcggtcagcttcgtctcgtcaggcacgcccagcgaggtgagcgtgagcttcgagaagtgcagggtgaacgagccaccggccttgaccgcaccggtcgggataccggtgacggccactgcacggcggtcgtagcgcggggcaaccggattgttgtccttgagatagtcgatccaggcgtcgcggtccaccagaccggtgtccttggtgttcgtgccttgggcgaaggcgcggaagttatcgccgccctccaacaggaagctgaacgaaccgatacggtagttgcgtttcaggtccagaggctcaccgttgacggtcaccgaggtgatgtgatggccttgcgcggcatccggatcatacgtgtagctcacgttgtgggacagtccgagttgcagatacgcgcgcgatggcgtgctgccgtccgcgttcgtctgccactgctgttccagcgcttccttgaactgcgcgccggtaagcgtggtggtccacaggttgttcaggaacggcagtacagcgttggcctgggcgtaggtgatattgccgtcggcatcgagcgtgcaggcgtcattggtgccggacttgcagaattcggcacgcagaccgccggggttgaccacaccgatttcggccgcgccgcggtcctcgcctttgagcgaatcgagcagcgcatcggccaccagattgcccatggtcgattcggaggcgcggtcgtcacgcttgccatccttgaatgcggtggtgctatccgcagacaccttgccgaccttctcgccgcccttttcatcggccatcttaagagcctggtacacgatgtccctcaccttggcgacagtcggattcgcggcggcgagcaggccatcgttgtattcggcgtaatcgttgtagtgcggatcatttttgtcggcgggctgcgaagccacctgcacggccgtgttaccggacttgtcgtaagacaccgcaccggtggccgtgttgtaggtgagcaccacttggccgatgttggcggcatagctaccggtctggatgatcggccggttgttgtgcgcgggatcggtgtacgagtacttcatgtgggtgtgtgcagtgaagatcacgttcactgccgcatcggtatcgtccacgatcttcttgaacacggggctggcggccttctgctcgtcaagtgtgggcttggcggtggcgtcatcttcattggaggctgcaccctcatggtattcggccacaatcacgtcagcctcgccattggattcgtcgccgtcggtgagctgcttggccacacggttcacggcctccaccggatcgccgaattcgatgtccttgacaccaccgggagccaccaatgtgccggttttctgagtgaccgcaccgatgatgccgaccttcacgccgttcacttcctgaatgctgtactcgggcagagccggggttgtggtgcccttcttgtacacgttggcaccgaggtaatcccattgggcgttgcgcgcgccctccttgccaatcacacgatcggtaaggtcggcatagccttgatcgaactcgtggttgcccaccgccgaagccttgacgcccaaagcgttaagcacatcgatggtcggctggtcctgctgtaccgaagagttgaacagcgaagcaccgatattgtcgccggcggacagcagcagtgatgagtcagggtattcgcccttgagctgctcgatggtggcggcgaacggcacggtgaggttcttgtcgatacggccgtggaagtcgttgaagttcagcagattgatggtggtgctggcgggaaccggctgattggttgccatatagcccatacgcaatgaatggccattggtcacgccgtcgtctgcccagcacaccggcttgtacaccttgccatccaccaccttggtggcttcggcatcgggggtgatggcaaagccttcggtgttctgcgtacggatttcatccggagtgtcggtcagcttggtcagctgcagcacgccgttcttgaactcgtaggtaccgattttggcaccggtgttcgcatcattgtcgctttgggcgagcagctggttgtgctcggcgtcccaagtcagatcgcgcggaccatcatagccggcgttcactgcggactgcggcaggtcgatgtcggccaccggatgcaccaggtcctcatcattcacggtttgcagtgcgaaggcgtagatatggccggttttctccagtgcggcgaagaacagaccgccgaaatcattgccgaaaccgtccgggtcgtaggtcattacgttcttcgggtcaaggttggactggaatccgttggcggtcaggaccgagtcgggaataaaggctatgccttccaccccaagattggcgtccgctccgtggcccagcgtcacgccgaactgcgtgagtgctgcgatgagattccactcgtgcgtagcgttcagatcgtgcgctccgtcgccgttggcgtcggtggttttctcggtcacgtcatactgcaggatggaaggccgcggcacattcttgttttcgttgtcgcgctcggcgccgatgaatatgcccttggatgaatctccgttgatcagcgtgatgccttcggagtccacaccgcccttgccgtccttgaagtgcagctgcttgccgcccttggtctgaccgttgttggtgaaggtccagccatcagtgggatcctgctgccatgtgccgttctggtagacgaacttgttgatggagccagggcccttatcagcggtgttgccgagcgtggggttcagatcgttgtcggccgcccacagcacgccttgcttgccgtctttaccggcttcatacaccagaccagacagattgccgtcagtgtggtcgccgccttgtcctttggcgccaaattcgccttcggcatccactgtggtcacatcggccaatcccgaccatgcgtccacggtcatggtctcgccggcgggcggagtcggagtcgggtcatcgaacacgttctgtgcaccgggcgtgggcgtatcggaaagcgcgaaagtgccatcgtccttacgggaccacgactgactgtcgctcatcttcttcacgccggttgtatcggtattccatgacgtggaatccaccacatcgctatcggtaaagtcgccgctggtagtggtcagataggcttcgtcggcatcggaacccaggccgggctcggccttgtcggggtcgatgtatgccaccagatatccgccggctttgatgacggtgtccgtattcgttacttcgctggtgccgatggtgtagtgcttcttggctttcttgccgctgtcgtagatgccccagcccttcacgtcaacgtctgtggagccggtgttcttgagctcgacccaatcgcaacgcttgctatccgggtctccggcagctttcgtattgccggcatagacctcgttgatgattacggatggtttggcagccgtgttctgttcggcagtggcctgctgctcgtccgcagccgcagcgggcacgccgatcagggcgatgctgctcagtgtcaccgcagcggtgagcagcgcgatggcgcgccgcgacatcgcggtgaaattgttggtgtggaacattactcccgttccttcctcgggttgtgccgccgcagcatgatgctcttcggcggatgacaccccgagggtatgagagagaaatgaagccgacaccgtatgaaggcaaactcggcagatctccaaactgaactttggctgaattactgctgaagctagttcttggatttgcgtcgaaccgtccgtattccgccgacaatcgcgattacagcggtaccgatagctacgctgatcaacgccggtcgttgcgcggcatggagggtggcgagatccggtccggccgcaatggcactgttttcacccgccgagctatccgacgccgggtgattgcccgcgtcggtgtactgggcattgaccacactcgggccggtaagcgccacttggtcggcggtctcgaccttggccacatcgccgtgcttatccaaggtgacgcgggcgcacagggctttggcccagttgatacgctgccagccgtcgctcgattgccatagggggtatccggaatccaaggcagtggctttcaaaatcgcgttgcgctgatcggcgtgcagttcgggataggccagtcgcagcacgtccgccgccccgcgcggtgccacgaaatcagcgccggactgggcggtgtcttgcgggaaggtgtaggtcaggcgtgcggtgtagacgcgcacggccgaggcctggtccgcgaccggctcggtggccaccgggtccagaaaatcgttggtgtagccgcccgaaccggaggccttggtgttggcgatgcaggcggcgagggtagtgccgtggccgtccgcggcgcagcgggacaccagatagtcccgcagctgccgggacgcgggcacgatggacgaagcgaattcgttatgccagtactgcccgttctgggcggatgcgccaatgcgcccgcccatgatgtcaagcggataatgcacgccgagcacgatgcggttgttgccggcctccgaagtgcgggccatgatttgcggcgcgagttcgggaatcatgccggccagcgcgataccccacgaataggcgccggtagtgtggccggaggggtaggaactgtttttctgcaagttcgagtagccgggcacgtgttcgagccatgagggtgattgcttgatgtcaagcgtggcgggcagtccggcgagatcgttagtgccgccgtagctgctttccgcacggttcagataggggcgcggatgcatggccgcacgttttgaggcgtaggtggaggccacgttaaaggagaagatatcggcgacggcgttgagtttcccggatttgagcccttcgctcatatatttgccaagcaccggaccgagcgcgtccggcatggcttcctcggcttgcagatcggagtcgacgagcgcacgcttgcgttgggcgttcaggccatccttatcgagattttcggcggctttgtggttaattgccacggccaaatcttcgtcgagtttcattgtatcggcgtcgagcaccttgccaccgtgttcggcatcggtgggggcctgccaatagttcttttcgtagtcggagagcaatgccacccaatccgggttgggcagctggtcggcctgtgcgattgcaggcgtcacggctagcgtggccgccaacgccagcggcgcaatggtcgcaatagcaaaaacggaggataggtgccggaacatcttcatatgttccaacctatcctccgtgaaggctacgtagccggagcccagtcaaacactcagtaaattcttcgtgccggcttagcggcgattgagctgactgtcaggcctctggcttgtcctcaggcttttgagactcctggaattcgccggtttccgggtcaacctgtgactcgggctgggtggcgtcatatccctgttcgtagcgggtgcgccgccagttgcgaatcgaggcgttggtgccacggtgatgcacatggtatttgcgcggcgtaccgcccagcggcagctcttcgacctccttggccacagcgatctggttgacattggacgggtcgccggcggcgatcggcgccagcggctcgggttcggcgggtgcggccgtacgctgctgcatgcgcgagggcagccattcggcgagcctcgacaacagccagcaggcgatgaagtaaatcaccgcggccatgaccagcgtctgcaggatgttgaagtacatcgagccgagtcggcgcgattcctgcagcaggtcggtatacatgatgatcgagcctagggcggtgtccttcaacaccacgaccagctgggtgacggcggccggcagcatggcgtagacggcctgcggcacctcgatctccatcagcgactgcgtttcggtcaggcccaaagcgagcgaggcctcacgctggccgcccggcagattgccgacgccggagcgcaccagttcggcgaccaccgaaccgttgtacagcaccaaggccagcaccacggcccaataggacgggctgggcaggcccgcgaacgcgaaccatcgccagaagaaaatcatgagcagcagcacgggaaccgcacggcagaactcgacgatcacggcggagacgccacgtaccaacgggttcggcagcagtcggcccacgccgaacaccaagccgaacaccacggcacccaccacggccacgatggtggccttgatggtcatccacagtccgggcaggtagaagtcggtccacgcctctcgttcgacggcgggcttccacagctcccagctgagctggttctcgccgtccggcgggttgtgcaggcgcatgaggataagcacgagcaccaccgcgaacagaatgcccgcgatccagttgacgatgcgaatggtgcgccggcccttgggaccgggcgcgtcgaacagcacggaattcgaagtatcggccatatccgtcacctccttacggcgagtttgttggacaggtacgtggtgagcatgccgatggggatgatcaggatcacgtagccgagcgcgaagatcaggaagatttggatgatcacgtcgggacggaattcgatcatctcgctcatcagcgaggatgtttcggtggccacggatgcggcggcggccacggtggagttcttgagcagggcgatcagcgtgttgccgagcggtgccacggagcctcggaaggcctgcggcagaatgatctcggtggcggactgcatgaagcccaagcccagcgctcgtgcggcctcggcctggccaatcggcacggtgttgatgcccgaacgcagagattcgcacacgaacgccgccgtgtacaggctcaggccggtgaccgcgagccagaagaagttcgtggtgaaggtgtcggagaagctgagcttcagctgcgcgtaggcacccagcaccatgaacaccatgatgatggtcagcggcaggttcttgaacagttccacatacgcaccggccacggccctgagcgaggaaatcggcgagatgcgcatcaccacaaggatcacgccgaggatcagggagaacagggcggaccatagggtcagttcgatattgaccagaaacgcgccgagcacgtcatactggctgaagagttccaggaatccgctcatcaggcctcctctccttcgtccggggtgggcgggttgtagcgtacgtcgggcgtgtagttggtgcccttggtgttatcgctgatggcgttctcccacgagccgtcctgaatcatgtccacgatggcgttgttgattttggtggccagctgcgtatcgcccttcttgatgcccacgccgtagtattcctgcgtgaacggtttgccgaccaccttgagcttgccgcgcgaggcggaggccaggccggccaggatgatgtcgtcggtggttaccgcgtccacgatgccggagaacagggcggtggcgcattcggcgtaaccgggctgttccatgagctggacttcggaggcgaacttctccttgacggtggcggccgaggtcgaaccggtgacggagcataggcgcttgccgttcaggtcttcggggccgttgatggagttgtcgtccttgcgcacgagcagatcctgtccggccacgaagtacgggccagcgaaggagacggccttcttgcgctcgtcggtgatggagtaggtggcgaggatcatgtccacgtcgccgttctgaatcatggcctcacgctgcttggagggggcttccttccatatgatctggtcttcggaatagccgagtttcttggcgacgtatttggccacgtccacgtcgaagcccacgtaggtgccggacttcttgaagcccaggccgggctggtcgaatttgatgccgatgcggatcttgccggtttcgtccgcgccgcaggcggccagcgacattgtgcaggccacggcggcgagcgcggcgatcacgcggcaagccttccgtttgaacgtattggtgaatgtcattggattacgtacccgtctttcagtgggttcgtcagtgggtgaggatcttcgagaggaagtccttggcacggtcggtctgcggatgctcgaagaactcgtcgggcgtgttctcttcgagaatctggccgtccgccatgaagacgatgcggtcggcggccttgcgcgcgaagcccatctcgtgggtcacgcagatcatcgtcatgccttcatgcgcgagttcgaccatcacgtcgagcacttcgttgaccatttccgggtcgagtgcggaggtgggctcgtcgaacagcatgaccttggggcgcatggcgagcgcgcgggcgatggccacacgctgctgctggccgccggagagctgggagggcatcttgctggcctgggagtcgacgcccacgcgggcgagcaggtccatggccagttgctcggcttccttcttgtccatgtgacgcaccttgatgagggccagcgtcacgttttcaagaatggttttgttggcgaacaggttgaacgactggaataccatgccaacttcggccctgaggttcgcgagctccttgccttcctgtggcaggggcttgccgtcgatgcggatgtcgccggaatcgatggtctcgaggcgattgatggtgcggcacatcgtggacttgcctgagccggacgggcccacgaccaccagcacctcacccttggcgacggtcaggttgatgtccttgaggacgtgcaaagcaccgaagtgcttttcgacgtgggtcagttcgactagcggacggttcgggtcctctttgccgggaaccagcggggtcaatttggccttgcttggtgatgttgtgcttgtcgtgcgcgaacgcactgctgtttcattgttcgtttcagacatgagtgggaggataacacaccgacgtttccaacgtgttcacagtatgtccacacagttgctcagtcgatgtctcatttccgcatcagacatcgtgaaggcggcattgggcatcggcatacattctcgctgagtcgcgcatcgctcggcgtctgctgtgcgctgattgcctgctgcgtggtggccgagacgttgctgcgacggcaaagcgggcacgtgttgtcctatctgctgattccatgtttggccttggtgtcgttggcgttgctgccgtgtatgccgcagtcgggcgcatggctggcggtcactttgtattgtgtggggctggtctcgccgtttcccatgtcgtattcgtataaatgcgctaggcattttgagcgtggctagctgttcgcacacgatgagtgctgttatacggtggacgacactcccgaagcgcggtggataaccgggcgcggcacacgatatgccggtggataaccggttcgcgccgcttaagttattcccatttttcggttttgcccctgtgccaccgtggaatgcgctacgctcggcgcatgaacggatacagcgaagtgccgcacaatggcgaaatcaacaactatctgcgcaaagatcttgacgccaaagccacggccaagaacacggcctgttggaatctgctgggcaaagtgcgcacgaaacgcacgttgtgtttctcgctgtataccgcattggaattatgcggcgtggagttgccgaggcacagcacgttgccgcagaaggatttttatgtgacggtgaggagcaaggggacccgctcttcattggacaatgtcgactatcgcatatggaatgcaaagttcaacagtatcgttttctcaaacggcgtaacctgcatgcatcccatggatgcatggatacagtttgcccaatatctcaacctcactgaattagtggtgctggctgaagcgctcatcagacgttatggatatgccattgaacaattcactcaacgactaacggcctttcaccgcgttattggccgtgcgcgttgtgaggcggcgctgaagctcgtaaaaccatcggattccgttcaggaaactcgtacacgcttggcgcttatgcttttcggcctgcccataccgcaaacacaatatggcattaccgattcagagaacggatacacctacaccgttgacatggcttatccacaatacaaagtcgctattgaatatgatggcgatcatcaccgtcgcttccgcaaacaatatgtgcgggaccagcaaaaacgtcgacgtctgcggcaattgggctggaccgtcatcgaggtgttcgccgatgacctgtggaacaccgccaaacaacgtgccttcgcacaagaggttgccaccgcgatgcaaataccgcttcctggccgtcctcaaccttcatgccgggtattaatagacggcagcctaccatcaatgcgcgcaaaggggaatacaggaggcggaaacaagcaaaacacaacaaagcatcacaacattgatcaaatacggagttgcgatcgctcctcatggggcggtaatttgcccatggggcggtttgaagaaattgtgaaaccgcggaattaagccattttgacctaccgccccatggggttttcaccgccccatgggttgtttaccgccccatgaggaagttaccgccccatggaaggataatcggcaaacgccaagggggacaccgcatggtgcgaggtttgccgcatggcggaggtgccatcgggcggagtatttggcaccccttggcaggtatttggcacattgggccccacccgcaaaaagcaaatggcccttggaattattccaagggccatttgcggctaatagcaccggagcattactcctcgaaaattaatctacgcgtgcggagaccgccgtccgaagccgaaggcgcactgaagtacgtcgagtgctgaggaaaagcggtatacgctccgtagattagttttcgtcggcgtccgggtcgtagtcgacgccagtctcggcgcgctgctcgtcggaaatcggggccggagcaccggtcagcgggtcgcggccgccgccggccttcgggaaggcgatgacgtcgcggatggagtctgcaccggccaggatggacacggtgcggtcccaaccgagggccagacccgcgtgaggcggagcgccgtacttgaatgcctcaagcaggaagccgaacttctcgtcggcctcttccttggtgatgcccagcacatcgagcacacgggcttggatgtcgtcgcggtggatacgtacggaaccgccgcccatctcctcaccgttgcagacgatgtcgtaggagtcggacatggcgtgctcgggatccttgtcgaacttgtcgatccaatccttggaaggcatggtgaacgggtggtgcatggaggtccacttggagtggccgacagccacatcgtcatcatccggatcgtcggtgggcttgaacagcgggaagtccacaacccaagtgaaagcgaacttcttcggatccagcaggccttcgcgggaggcgagctccacacgcacggcacccagcagcagctgggctgactcgcgggaaccggcggcgaagaacacggcgtcgccttcctcggcaccgacggcctcgcgtaggccgttgcgctcctcatcggataggttcttggcgacggggcccttgagctcgccgttttcgccgaagaccacgtaagcaaggcccttggctccacgctgacgagcccaatcctgccaagcgtcgaactgacgacgcggcgtggcggcaccgcccttgaagaccacggcacccacgtacggggcctggaacacgcggaacggcgtgttcttgaagtactcggtcagctccaccagcgggttgccgaagcgcaggtccggcttgtcggagccgtacttgtccatcgcatccttccaggtgatgcgcggcagcggcagctggacctcatagccggcggacttccagatggcggcgatgaccttctcagtcatggccatcacatcttcctggtccacgtaggccatctccatatcgagctgagtgaactcgggctgacggtcggcgcggaagtcctcatcacggtagcagcgggcgagctggtagtaacgctcgacaccggagaccatgagcagctgcttgaggagctgcggggactgcggcagggcgtaccaggaaccaggcaccagacgggccggcaccacgaagtcgcgggcgccttccggggtggacttaatgaaggtcggggtctcgacctcggtgaagtccatgtcttccagcgcgtggcgggcggccttagccatgtcggaacgcagcttcagattgtgctgcatggacgggcggcgcaggtcaaggtaacggtacttcagacgcacgtcctcgccaggcagcttgttctcggactcattctcaagagcggtggaaacctggaacggcagggcgtcggacttggcgaggatctcgatggtctcggccacaacctcgatcttgccggttgccagatgggtgttctcgttgccatccgggcgcaggcgcacttcgccggtaatctgaatcacgaattcgctgcgcagcgggcgggccatatcctcgtcgtaaatgacgacctgcacgaggccggtcgaatcacgaaggtcgatgaaggccacgccaccgtgatcacggcgtcggtcaacccaaccggcgagggtgaccttctggccgaccagggcctcggtcacttcagtggcatgatgtgttctgtaagccgtctggctcattgtcttgtttctcctcgatttttcgcgcgaatacgtcagatttcgacggtttgctgggcaaccacagtatccggctcccacgacgtgcaatcggcggcaacctgctcgcccgtgacgatgttcttgacctcgtcgccagcgggctctgcgccttccgcaccttcggcagcggtggccgggaaccacacgtacggaatgccgagtttgtccgcgtacttgatctgcttgccgagcttggccgcggtgggtgccacgtcagtagcgatgccgcgcgcacgcagttggttcgcaatacgattggcggccgggcggtcctcttcattccacacagcgaccagcacggcggccgggctgacacggctggcgtgagcgccggcggtgtgcagcatgtagctgaccagtcggctcaggccgatggacaggcccacgcccgggtacttgcggttgccctgggaagcgagattgtcgtaacgaccaccggagcagatggagccgagtgatgcggcaccgtcgaggaaggtctcgtagacggaaccggtgtagtagtcgagaccgcgggcgatcttcaggtcggcgatgacggaaccggggcggatggcggcggcttcgtcgacgatcatggccagggtatcgagtccctgacgagccagcgtgtaggactcggaatccttggcgatgccgtgagcctcgcacagcgcatcgaacttggcggcaagctcggcaccatcggaggcggtgagctcggccaattcgaggcaggcgcgcgcctgtgcttcggtggcgccgcaggtctcggtgagcagtcgggccacctcatcggcaccgattttgtcgagcttgtcgatctcgcgcagcacgccttcgacgtccgtcagaccaaggccgcggtagaagccttcagacaacttgcggttattggcgtgcacggtggccttggggaggccatacgcgcgcagctcttccagtgcggagaccatgaccagcggcagttccacttcatagtggtcgggcaggtcgccggcgccgatcacgtcgatgtcggcctgtacgaactcgcggaagcggccttcctgcggacgctcgccacgccacaccttctgaatctgccagcgcttgaacgggaacgccaacgcacccgagtgctcgaccacataccggctcagcggcacggtcagatcgaaatgcaggcccaaacgctcttcaatcggagtgtcggattcatgaccgacctcctgcaaacggctcagcaggtaaatctccttgctggtctcgccttttttcagcaaagaagcgccggtttccaccgctcgcgtctcaatgccgatgaagccgttgagctcaaaaaccttacgaagcgtatcgataacacgctgctccacaacacgttcggaggggagccactccgggaatcctgatattgatgcacctttagccacgaaatcaatataataggtgagggttgcgtcaaaacttcctggttcgcccgggatgggagacgctcccgcttatgcattctacgctttaaggagctggccatggccgacgaaactgtcaccgaacccgtaaacaccgctgcgcccgaagagcaggcaacgacacccgcacccgaggccagcgcggccacgccggcgccgactccgtcccccgcttccatgccgaaaccgcacgcgccctcccccgccgccttcgccaagaagactccggcgaccaagccgcgcgctgccgccccggccgccgccaccgccgcctattccgaggctgatgtcaaggccgccgaggccttcggccgcgtggatgacaacggcaccgtcttcgtcaaggatggcgacgccgagcgcgaggtgggccagttcccggatgtctccaaggaagaggcgttggcactgtacgcccgtcgtttcctggatctcaaggccaagctcgatctgttggccacccgtctggcttccccgaacatcaaggcccgtgaaatcgacgaatccgtgaagctcttgggtgaagaaacctccgagccggccgtcgtgggcgatcttgccgcactcaaggcccagtacgaggagctgaaggctgccggcgaggccaagaagaccgaaatcgccgaggcacgcaaggccgctcaggccaaggccgttgccgagcgcaccgccattgtcgagaaggctgaagcactggccgcttctctgggcgacaacaccaactggcgctccaccgccgacaagttccgtaacctgttcgacgagtggcagaaccaccagcgcaccaccgtgcgcatcgacaagccggaggccgaggcgctgtggaagcgcttctccgccgcccgtaccaccttcaaccaggctcgccgcaagtgggctcaggctcgcgacaacgagcgcacggccgccaaggaagccaaggaagcgattatcgccgaggccaatgagctcaaggattccaccgcttggggtgagacttcccgcaagttcaacgatctgatggaccgttggaagaaggccggccgcgctggccgtaacgaggacgacgagctgtgggccaagttccgcgaagccgccgacaccttcttcaacgctcgtcaggccgatcgcgatcagatcaactcctccgagaaggagaatctggctgccaaggaggctctgctggtcaaggccgaggctctggtgccggtgaagaccgacgccgaggccaagaaggcccgccaggagctggccaagattcaggaagagtgggatcagatcggttacgtgccgcgtgacgatatgcgccgcatcgagaaccgtctcgacgccgttgacaagcagatcaaggccatcgaggatgccgcttggaagcagaccgatccggaggccgacgcccgcaagtccagcttcgaggagcagctcaacgcccagctcgccgagctcgacgccgagatcgcggccgaatccgacccgaagaagaaggccaagctcgaagccgagaaggccaccaaggagcagtggctgaacgccatcaagtaagggtctcgccagctcccctctcagacagagaggggagctggcagtaaggctgactgaggggagtttacggttataccgcaagctcccctcagtcgcctacggcgacagctcccctcagcgaggggagcgtcgtcatatttatgccgttttctcctgccctatactcataacttcaccccatagttcctcagtcacccagcaattggtgtcttacgcctgagtccctaccggtactgcaacaactgccgtgagcccttgatgtgcggccagatattcatgcaacggctggctgtatggcatatccagctcgccgtaattggttccggcacggaaggcggggtaactgtcgccgccctgaagcagatatgaattggacgcgataatcaccaggtcatcgtccgcaatcggtcggccgtcaacggcgaggttcgcgatacgaaccgccgcatgttcgtcggcagcacactcgtcagcgtcagcgttggtatcagcgccggaatcagtatcaacgccggcatcggcattgccgctctcaccagccgtaccgcattcggcataccgatacgtcacgttcgaggagatgccgagccagcgccgctccagtcgcccatcgtcacggcgaaattgctcggcgagcactctcttcacatcgcgcccggtgagcgtctcatgcgcggccttgaactgcaaggccatgagactatccacctcgcgcacggtgactttgccatcgccattcatatcaagccgtggagtccgcagactgccattattcgaaaatccgattaccggcaagcgattcccggcatacacatgcttcatgattgactctcggttcgcgtccgccaccagcacaccgaccgtattcccgtgcttgtccgaaccttgtttgtcgaaattcacgccggaggccaaggtgccaatcaccgcgctgccggtatggttcgcatatgttgccgacgcctggtaaatatgctgcgcgcgcgatacctcatcgttctcctcagcaccggcagacatccaagcggcttgcgccggatgcgcattaagcccatccacgcccagcacgccgtcaaccgccgtatggctggtgccattgccgaggtcaacgtcggccactcgcaccgtggcgcgacgcccggcaccggtgatgatcaaatcctgcacggccatgttccgcccgaagctgcccgcctcgtaaataggcgcgccacccgcggttgtaccgtgcttgatcgcgtgactgtgaccggtgtataccacatcaacatctcgcccaatatcggcggcggctgaagcatcggcatgcagcaaggccaccaccgcatccacctttccggagcgcttgagttcacgggccacacgattgatcgcgtccaccgcccgttcgtcaagatcggcatcacgagtgatctgcggagtggccaccgagccgagcgcatcagtaagggcgcccacgaaaccgatccgcttgccgttcaccgttcgaatcgtagagtcacgtacgtggctcagcagtccgtcagacgacttattggcggcagacgtgttggcgcacagccagtcgatgccgttgctgggatcagcgatgcgattgttgaaatcggcgacaccgcggtcgaactcatggttgcctaccgccgaaatcgtcaatccccacgctttggccatatccagcgtgggttggtccttctccaccgccgactcatacggggagcctcccaccaaatcgccggtcgataccggaatcatattgccgggattatggctgtcggccacggtgaaggcggtggcgttgtccgcaccacgttcgatatgcccgtgaaaatcagtgatgtcggcaatggtcaccgtacgagtgccggaagatggattatcaccggaaaaaggaacggctcccgtggttccagcacaagcataaggaaccaccagagccgtaaggataagcgctactgcaccaaaaacgatccccgatcgcttgccggcccaccgccggttcttcatattcctgctcacaccagtcacgctagaatcgtcgattgaatggccatgcctaggaaggcgactctcaggtgaattcttagcggcgtcttgggatgggaaaggcctgaccccatactatcagggtcaggcctttgcaacccgagtcactacgaatgcgtcagcaagaggagattactcgccaaattcctcggcgcagatctcagctaccgcatccacgcacgcctcggcaatcagacggccgcgttcggcgctcgagccggccggattggcgagtccgccgtgagcgggaacgtcaccttggcgcacagggtagcggacataggatttcgccgtggcaccggcttcctcgaccatacggtccatgtgcaccagttccggcgcatagtggagcatcaacgaagtttcggtgacggccgcatgctccaatgcccagccggggaacaccaatccatcgaacaccttgtcgataaccgactgcggaactggatcccaccaattggtttccacgatggtggctactccccggtttcgcggatgaccagatcgatggcctcgacgatgaacgcctcgttttcaaaatgcgcgttcatgacgacgatcttggtgaagccatcggcgatgagttcgctcagcacgtcgtgcatttggttgatcactgtcacgccgttcatgtcgatagtgcccgggaacagcggcccgccaccggagagcggcttggacttgtatccgtagctcagggtgggcagcacggtgccgtcgatgcgttccgccagatcttcggcgacccgcgtggcgagtaccgcgtcggtgccgatgggcagatgctggccgtgctgttcggtcgaaccgatcggcacgatgacgggacgagtcttcgcctccttgaattccggccaggtcatgtggtccatacggcggttgctacccattgcagtactcctttaggttggtggtggattggatggtcgatgaatacgcccggctccctcggggaaggagccggagctgaggagatcagatgtgattcagatccttgtcggtgttttcgtgggagaggatcatcgcgaccaaggcgatggccgcaacgcccaccatgtaccaggccggggcgatggacgaaccggtcagggcaatcaggccagtggcgatgaacgaggccgtaccaccgaagatggcgttggccagattgaagctgaacgcgaatccggtgaagcgcacggaggtggggaacgtctcggtcaggtagctggacagggtaccgtcgttggcggtcagggtggcgcacattgccagctcaaccagcagcacgggccagaactgggaggtgttgaggatgaggaaggcaggaacggtgaggacgatgaacgccacgcaagcgccgatgagcaccttcttgcggccgaatttgtcggagatgtggcccatgccgaacaccatgaacacgtaggcgaccaggcagatggtggtgatggtgccggactggggggcgtccatgccgacggtgtcagacagataggtcggcaggtaggtgagcacggtgtagaagccgaccgcgttcagcacgcaggctccgaagctgatgatcagagccttgagatggttgtggaacaactcggcgagcggggcgaacatgccgctcttggcagcgatttgaccgtcggcggaggcggcgcccttggactcaagcgcatcgttcatcgactggtagacgggggaatcagcgagcttggcgcggatgtacagcacaatcagaccgagcgggccggccagcaggaacggcacacgccatccccaaccgaccatcgcgctagagttcatgttggcggtcatcagcgtggccagagtagaaccggcgagcagaccgatagcggtggaagccggaatcagcgagcagtagatgccgcgctttgaagtgggcgcatattcgccgaggaacgtggccgcaccggcatattcaccggaggcggagaagccctgcaccatgcgcagcagtagaagcagaatcggcgcgccaacgccaatcaccgagtaagacggcaggcagccgatcaggaagctcgcaccggacatgaacataatcgagtgggccagtgcggctttacggcctttcttatctccatagctaccccagaacagtgcgccgattggacgcaggatgaaggatagcgcgaacacgccgaaggtctgcagcatggcgacggtgtgattgtcggttgggaagaacaccagggcgatagtggtggcgaagtacgaataggaggcgtagtcgaaccactcgatgaagttgccgaggaaggaagataccgcgacttttctgaccatggcctgttcttcagtttgcggggtggaattcatcagtcgtgcagatgtagtaatcgttgcggaactcatgatgtcaccgtcctttcaaggatgtgctgttcgtgtgactgaatgagattcaagtgggaatccgtttcgcagcaggtcgaccagcgccgcgatagcctcgactatgcccttgagtatttgctgaaacgtgaatcgtcgattaaccagttcggcgtagaagtggacaggttgcccagtggcactgccgtattattcaccatgctgttcttgccatgatttcgtgagtttggcggcgaatagcagcatcacccagttcggtttgtcgttatagtcgacgccgaccatttgtgtcactttgtccagtcggttgtacagggtttgccgtctgatacccaattgctcgcacgcgccggttttgctgtcgaggttgtcgaagcaggcgcacagtgtgtccagcaacagcggggaggcggcgacctcgaatccgatggtctgcaccacgagcatgcgcatcgccttgtccatatcagaggatgcgacgaaacggtcgacgagtgcggacatggtacttacgactcgcccgtatgccggttcatgattggcgatgtcacgcaataccgcgaacccgtcgaccagcgtcaccgtgtccaatgccactcggccatgcaccacgtatataccgtcgccttccagtacggcaagcgcatccatgcaatggcgtccgaatgcggccgcaccgtctgaggaatcggtggtggagcaccatccgaccatcaagtcaccttccagcatgcaggagacggcgcatcccgacagttcttcgaaccgttcgaccatcgtcgatacatggttgatgccttccaccaccgatctgaaccgaaaagcgaatggcatatagatgcatgatccggcaaaacccagcgcttcgagcatcgcatgcgcttcctgcgcctcaaatgtattgacgtgcacgccgtcggccggacccatactcagatgatgcatcatgcccatgcgcgcaccgccgtcaatataaagggcggccaccggagacacgatggtggcgatggcccgacgcatcgtggcgtcggaagtcatggtgcgttgcgtgatctccaatgctcccaccggccgggagcgactttcaagggcgatgacggcgctcgattcgttgccggcatcgaacgcacgacccgctcgagcggccaacagaccgtcaccatcgaaaatggcgacgctttcgccgaacagcgacgcaatggtttcggccacagcctcgatattgccggtacgggacaatccctcacgtaatgaagtggacattgtgtccacctccaattgcaagtgcatctgttcgtgcacgatagcggtattgacgctctgacagatgtcgacaaaaggtacgcgagatttcaaaccaatcaacgtcaacccatgcagcctggccgcagacaccagttcgtccggcatccgcaccacaccctccaccagttcgaccaccagagcggcgacaccagcctgtgccaggcttgctacatattgtcctagcgtgccgtgccaatcggcggcgagcagagcgttgccctcgataatcagcatctcaccgcccgaaaggaagctggagacatcctctcgctcgttggtgaacacccatcgcactggcgtatcgaggtctttgccttcgacctccaccacaggatcggctcgtttgaactgcgtgttatgaagcacactgcgaatcgatacagtcatacaatctgtccattcccccgcggaacaccggtcgttccggttaacctcaccgcaaagcgtgctgttgacaataacctcagttggttacgcgggcagtcggttcacgtaaccgttcggcaacacaccagttgaaggagcgacgatgactaccacactgttcaccaacgcacatatcgccaccggagaacccggaagcacggctgcaagcaccctgccattgcaggacattctcgtcacggatggcgtgttcaccgcattcggccccggactcgcgcaacaatatgaggctcagggtggtgatctggcggccattgaggtggtcgatctgggcggcaaacttgtctgcccaccgttctgcgatacgcatctgcaccttgattacgtattcacggcccgcaagcccggtgcggtgaatgaaagcggaaccttgtttgagggcatccagcgatggagtgagaccaagtccgacttgacggtcgacgagatcaagcagcgcgcgaaaatcggcattaagaaagaaatgctgcatggcgtgcagctcattcgatcccatgccgatgtgaccgacccgaacctgacctcgttaaaggcgctgctggagcttaaggaggaattgaaggatacggtcactctccagatcgtcagcttcccgcaggagggcatgtactcctacgagggcccgcatggcgaatcgggtgccgagctggtggaggaaggactcaagatgggtgccgactgcgtgggcggcatcccccatttcgaacagtgccgtgagtttggcgagcattccatgcacacggtagttgagttggcttcgaaatacgacaagctcatcgacgtgcattgcgatgagacggatgatccgaattcccgttacgtggagctgctttcggcgctggcatataaggctggcattggcccgaaggtcaccgccagccacacctgttcgctgggatcggcggacaacgcctacttcttccacctgaccaagctgcttaaggcggcgcatatcaacttcgcctgcgcccccaccgagaacctgtatttgcagggccgtcaggataccttccccaagcgccgtggcatcacgcgagtcaaggagctcactgaggcgggtgtcaatgtgtcattgggccaggattcaatgcaggacccgtggtacccgttgggcaatggcaatatgatgctcattcttgattatgtgctgcatttggcacagatgatgagctttgaagaaatcgacgatgcgttgaagttcctgaccgtcaacggtgccactacgttgggcctgcgcgatatgtacggcttggaaacgggcaagccagcaaacttcattgtgctggacgccgatagcgtgttcaacgccgtgtatgagcgctgctcggtattgcgttcggtgcgcgccggccgcacgctgtttacccgcgaggagaccatcgacaccggactcgccctgctgtaataatccgacacaaacagtagctccccttgacaggggagctgtcgccagaggcaactgaggggtagaccacaaacgtgcacatcatgtgtgcgcaggtctacccctcagtcagcttcgctgacagctcccctgtcaaggggagctttgctggtatgcgctagctacgctatcgaaacggactactcctgcggagcgtcaccggaatcggcgggagcggattcggccggctcagtggccggagtggcgtcggctggagtctcgccatcagtggcggcaccgtcttcggcgggcttatcggcggcggccggctcctcgaactcctcacccttgaaggtgaattcgccgaggataccctcgccttccgcatccacaatcacgcgctgaccgtcttcgagatcgcccatcaggatcttctcggagatggcgtcctcgatgtcgcgctgaatcacgcggcgcagcggacgggcaccgagcagcgggtcgaagcccttctgcgcgagcaggtccttggcggcgtcggtgagttcgagcgacatatgacggtcgaacaggcggtcgttgagctgcttgacgtccagatccacgatctggcgcacctgcggctcggtgagctgcttgaagacgatgatgtcgtccagacggttcaggaactccgggcggaactgctgcttcaattcggagctgacctggtccttcatgcgctggtagctggactcgttgttggcacctaggttgaagcccgtgttggcggccttggcgatgtctcgcgtaccgaggttggtggtcaggatgatgatggtgttcttaaagtccaccttgcggccctgaccgtcggtcaggtggccgtcatcgagcacctgcagcaacgtgttgaagatgtccggatgagccttttcgatctcgtcgaacagcaccacggagaacggcttgcggcgcaccttttcggtgagctcgccgccttcctcgtagccgacgtatcccggaggcgcaccgaagagtcgcgaagccgcgtacttctcggagaactcggacatatccacgcgaatcagcgcgtcctcatcgtcgaacaggaattcggcgagcgtcttggccagctcggtcttgccgacgccggtggggccggcgaagatgaacgagccggacgggcgcttcgggtccttcagacccacgcgagtacggcggatagagcgggacagggcggaaaccgcctcgtcctggccgatgatgcgcttgtgcagttcggcttccatgttgagcagtttcttggactcggcctgagtcagcttgaacaccgggataccggtggtggagctgatgacctcggcgatcacgtcctcgtccacgaccatcttgacgtcggactcgccttcgcgccaggagtcttccttctgcttgcgatcggcttccagcttctcctgcttgtcgcgcagttcggcggccttctcgaagtcctggcccttgatggcctcgtccttgtcggcggcgatcttggcgatcttctcgtcgagttccttgagctcaggcggggcggtcaggcgcttgatgcgcaggcgtgcaccggcctcatcgatcaggtcgatggccttgtcaggcagattacggtcctggatgtaccggctggacagctctgcggcggactgcagcgcgccatcggtgatggtcacgtggtggtggttctcgtaacgggaacgcaggcccttcaggatctcgatggtctcggcgatggtcggctcgtgcacctgaatcggctggaaacggcgttccagagccgcgtccttctcgatgtacttgcggtactcgtcggtggtggtggcaccaatggtctggagctcgccacgggccagcatcggcttcaacatgtcggaggcacccagcgcgccgtcagccgagccggcgcccacgatggtgtggatctcgtcgatgaacagcacgatatcaccacgggtcttgatttccttcagcaccttcttcaggcgctcctcgaaatcaccacggtagcgggagccggccaccatggaaccgaggtccagcgagtagacctgcttgcccttcagggtttccggcacgtcgccggcttggatcttctgggccaagccttcgaccacagcggtcttgcccacgccgggctcgccgatcagcaccgggttgttcttggtgcggcgggagagcacgaccataacacgctcaatctcgttggtacggccgatgaccgggtccagcttgccttcagcggcttcggcggtcaggttgcggccgaactgatcgaggatggcggaaccggacttgttctgcttgtccgtcacgccgccggcgttggccaagtcgcccttgccgtcaccggtgccggtgccggagttgccgcgaatcatatcgatggtcgcgctacgcaactcgcccagatcgacgtccatcttgatgagcacctgggtgcccacgccttcgccttcgcgaatcaggccgagcaggatgtgctcggtgccgatgtagctgtggcccagctgcagggcttcacgcagcgaaaactccaacacctgcttggcgtgcggagtaaaggggatgtgcccgttcggagccgcgttgcccttgccgatcatttcttcaacctgcttgcgggtggcatccagctccacgcccttcgaggcgagtgccttggcggctacaccctcaccttcgcggatcaggccgagcagcaggtgttcggtgccgatgtagttgtgctgaagggccctcgcctcttcctgcgccaacacgatcacgcgccgtgcacggtcggtaaaccgttcgaacatgcttgtccttcctcaattgacattccgtcttactctaccgattcacgatgacgtttattcatcggattccacgaattgcgccgtgagaggagaagaaaacgatatgctggttctagattcacccgtagtcgattacaaggaggctcgaaatgagtgaagctgcaaccaagcccgacatcgttgtcggtgtggatggttccgatgaatcctttgccgcgctgaagtgggcgcttgaggaggcctcgttaaccggtcagagcgtcaacgccgtgtttggctggacgcattcctgggatatggggtccgaaccggacagcgacgaggcctgggccaaggtccgccacgatattgccaacgagctgcgtgtgtgggtcgacaaggccgctgcaggcatcgacttcgatccggcgaatctgaagctcacctcggtgaaggcctccggtacttcggccctgctgcagatcggccatgattcgcagcagatcgtggtcggccgccgctcgctgagccgtatggcccgctggttcatggggtccctgtccgcttcgctggccgaggccgccgaagtgccggtgaccgtggtgcgcatcgccggcagcgaggatgagaccgtgaccgaggccattgccaacgccctgactccgggagacaagcccgttcactacacgcagcctcagccggtggttgaggaggctcgccgcccggtggtggttggtgtggatggttccgagacttcccgccgtgcgttcgatttcgcactggaagaagcacgactgcacgacgcgccgctgcatgtgatgttctgctggcagctcaaggatttgggcgttattccgggctatgagaacgccgtggcaccggtgaaggtcggtcagcgccgcgccgaggagattctctctgagctgatggccaaggcccggattcccgatggcgtcaaggtcagcacaaacgccttccatattcccgcatccaaaggtctgatcgcggcctcgcggtacgccagccatctggtggtcggctcgcgtggcctgtccgggctggacgcgcacttcctgggatcggtgtcccgccagatcgtgaacttcgccgaatgcacggtgaccgtggtgcactgattcaccaaaatcggcatggagtgctaacgcacgcctcggtgatgggcttgcagggaggaattctttattcctgcaaccccatcaccatctacttttcgcggaattcggagtttattcctcgtccgccctgttctggcgcagctgctcaatgagatcgatgacggtttcgagttcaggagtcacatcgtctgaaggacgaacgttatcctcttcgtcgtccatctcatcatcctcatcatcatcggcaacggtgttgttgaggatatcctcttcggtggcctcgtcgtcagcatcagacttggactcgtcgctggaatcagctgcatcaacatccacaacggaatcggatgcgttctgtgcaacggactcatcaccggcagactgggattgcgaggtcccgtcgcctgccgcctcctcagcgggctcagtatcgacggcgttcccgtcaacagtcttctgtgcttcgatatcatcaccggcaggctcgcctgtcttgtcggtttcgccttcggcctcgtcctgggcagccggttcctgcttgcgcggacggttggccaccacgtcgatatgcagatcgtcgaaagcaggcttggactgcacccacagctggcttggctcgggaggttcgatttcggaatgctcaccgcagccgtggtccaaggaaaccacgcggccgtcatccggactccacttgttggcgcacacgccgaacatacggtcgagttcgcccgcgagcggcacgaagaaaccacaggtggagcacaggttgccttcggcggttttggtgctcaacgctttggggcctcgcggaccttcataccagcgcttggcagcctgcgcgcggcccagcgaggtcagcacgtgacggcgggtcagtcggaaggtctcgacggcgtcgttgacatcctgcagcgaggattcctcgacttcgccttcctcgatgcgctcgtcatccggatcggtaccgatcgaatcggtgggagccagatccgtgggctcaaggcgatccctccaaggaatccacttgggcggcatcaacgcgccctcagtagggatcaaggaggattcgttgacggtccaggagtcgatctcctcgtcgtgatacagcgtcaccgaccattgccatccttcgtagccacggatattcgcggcgaagcggaagtcagtgacgtgatcctcaagatcatatgaggtaacgaaatcccccacctgatcgctctcgtcggccacttcgagcagcacggcgcgcgcgatggcgtgagggtccggtgtcacgatggtttcggtggtatcagtcatagatcagatcagtcctgtacatcgaattgatccgccaccgcacgcagcaacgtggccagctttttgctgtcggcagcagatgggtaacggtgacggcgcaacgtattgccggccgcatcaagcatcttgatgaggtcctcgcagatggcggccatgtcatccgccttcgggcgggtggccttgaccaagctgggagcggaggcgatcaggcgaacatccatggcctgcggcccacgacggccgtccaccacggaatactccaccttggcccccttgcgcaacgtggtgacgccagtgggtagggcctgagccggcaggaacacgtccttgccttcctcactggtgatgaagccataacccttggctgcgtcaaaccaacgaactcgaccggtgggcattgcgaaccttccttaatcctcaatggaaatagtaaaccgaaggtacagtttacctcacagggcttgacctcacgctttgggctgagtcgcctgagtcttacgctcagagctgaaccaagaagtcttctgtttggcgtccttggttttgccggtggactgcttgggctcaggagcggcgatctgctcaatcggcagcaccacggtgaaggtcaggcctcccccatcggtgccggtggcgcagataaagccgtgatgtgctttgaccacggattgcgcgatggccatgcccaaaccagtaccgcccttttcgcgggcacgggatgggtccgcggtgtagaagcgttcgaaaatcttcgagcgcgattcaggcggcacgccggggccatggtccacgaaacgcaatacggcatatcgatagccggtctgcatcgaggcacctacttcggcagcgtcgatgaaccgccgcattgacgcgtcgctggcgggcatgcgggcgagctgtcttggatcgatggcggccggcatcacaccgagcgcggcttcagcgggcgaatcggcaggcgtgtagcggtggatgttgcccacgatgttggtcaccacctggcgcagtcgagaggcatcaccgggcagtacgacctcaggccaatcgccttcggcaaggctgaattcggcgggatggttcaaatcgcgcgccggttcgagggaaatctgcatgcggcgaacggcacggtccgggtcgagcgcatgcaaatcgtcgacggcgtcggtgaccagcgacgagagtttcaccgtgccggtcatatcgatgccgcgcccctcatcgagacgggccaaagacagcagatcctcaacaagaacagtcatgcgctggctggaccgttcgatatgttcgatggactcgtccgcacgctccaaggcaccaggcatatcgcgctgcatcttatacagctccgcatagccatggatggcggccaacggggtgcgcagctcatggctggcgtcggagacgaaccgtttcatcttgtcggtggtctcctcctgctcatggaaactggattctattcgggtgagcatggaattcagcgaggcggccagagagccgacctcggtgttttccggcgcggaaggaatacgttggctcaggtcgccggctgcaattttcgcggcggtcttctcgatgcgcttcagcggcgtcatcgtgtgctggatgatcagcgtggacagggagccgccgagcagcaccacggcgatgccgaccacaatgcagtatcgggtgagtgtgttgacggtgtcgatttggtcggccagcgacaagccgatgtacaccacggcacggtccttgccgttttgctggaaggtcaccggcagaatacgccatggtgccctcgccgtgacgatggcggcatggttggcattggcagtggggttggccagtaccttggtgatggtgtcagaggaattggagtttccgttggccggatcgttctggctgtccgcactgtcggactgcaccgtgatgatctgcttggccaccgcctgcgtagtgaatgcctgaccgagcgtgatgccattggtatcgccataggtaggcagaatcggcaccgatacgataccgtcctgcatctgcggcatcagcggggtcacgaccagaggattgccttctttgtctttggttccgtcggtgtattgaatctgcagaaagtacgagttcggccccgatgagtcattttttgacagcagatcgatattgttgaccaccagttggctttgcgagcttaactgggtgtcggttttctgcagcatgtagttgttcaccaacgcgcggatggagaaggaaatcaccgacacgccgatgagcagcacggcgatggtgcaggccaccagcttgctgctcaacgagatacggtcgatatgccgcatcagcatgtttttcttacgctcgcgctgctcttggaaatgggcggcgaacggcgacattgcaggcatgggattcgtgttcggggcggcgttcggcgtgctgctcggcggtacgccgcctgactgcttatcggggatactcatgagattgcgatacgttatggatggaggcgattagttcttcggttcgcgaatcatgtatccgatgccgcgcttggtttcgatcagcggagtcaccttgcgcttgccgccttcgccgtcgtcgacctcgatgccgtcgactttcttgcgcaggtaggagatgtacgattcgacgatggctgcgtcgccgccccagtcgtattgccagacatggtcgagaatctgtgccttggacagtactcggccctcgttgtccatcaggtagcgcagcagcttgtattcggtagggctcaggtcaaccggctgccctgcacgggtcacgtcgtgggagtcctcgttgatttccaagtcggcgacgcgaataatcggatcgtcttccacctgttcgcgggtacggcgcagaatggcgcggatgcgagccacgacttcctcgaggctgaacggcttggtgacgtaatcgtcaccgccgacggtcaggcccatgatcttgtcttgggtgtcgtcacgagcggtgagaaacagcacaggggcgttaatgccttcctggcggatgcgacgggtgacggtgaatccatcgatgtcaggcagcatgacgtccaacacgatgaggtcaggctgcactttttcgataacctcaatggcttcggaaccggaagcggcggtgtttacctcgaatccggcgaagtgcagggaagcgaccagcagttctcggatggacggctcgtcgtcgacaacaacaatcgatgcttcaataggcttactcatgcttcctagagtgtcgcgctcttctgggcgtttcctgaatgtcatcttggagttcggccttggaatccttcttgatctccttgcgccgatgaatcaccaccatgaccacgatgatgatgaccagcgccaccaataccacacccatgatgattatgcctacgatcaccgtggacgatgaggtggaggcttttttggatttcacgatttgatccatcattgccgttgccgcgccagaccagctcggcgggttttccagtaacggctgctgtgcggcttcggatagcttatcgacggttttgttatcgagaagccacttatcggagttcttggacacgacgaccaccaggttgccgtcattcgaggccacggcaagcatcactgtgttcggcttgggattcatggactccatcacggttgccgcccagtctcccggtttctgttgactattgaaactggaaagatacagcagatgcacgtgtacaccggtttccttctcggttttggcgatggcatccgtgacttcggccgcatgggagcccaggagattttccgtatccgtgatgttctcggtgatggtcacgccgctgtcggtgctgctgctggagctgtcagagctgtcgctcgagttatccccataggcatttgcggttatccacattgcgttcatcgctactgcagcaagggcgcaaatggcgcaaacaagccattttcggaccatattcccgaaggccgaataggacggctccgaagctaggaccacaatagttgtttttccgtcttcccgattcgttgttgacatatcctccaccttaacggccggtattggcaatcggccgccatacataccattaaccctctagaaaaggagcaacgatgccccaatatcaggtagattccgagcgaatccaatcatcctcggccgcagtggccacttcgatctcgcaaatcaggcaggccgtgggcggcatgtacaccaatctcaatgccttgcaggacgcatggcgaggttcggcggccacccagttcaccgcggtagccgaacagtggcgtgcggcccaacagcagatggaggcctcactcgagtccatccaacgctcgctgacgcaagcctccaccgtgtacgctgacgccgaaatccaagcttcgcgcctgtttgccagctagtttcttggctcccctcaaagaggggagccagaatacaaaaaagggactcccgaaggagtcccctttcagctcaatcagctagcgatcgtttgcggatcagtagcccatgtcggcaccggcggccggggcagcagacttcggctccggcttgttggcaacgacggcctcggtggtcaggaacagaccagcgatggaggcggcgttctgcagagcggagcgggtcaccttgaccgggtcggtcacaccggcggccagcaggtcttcgtaggtgtcggtggcggcgttgaagccttcgccatcaggcagggagcggacggtgttgatgaccacgtcaccggacacgccggcgttctcggcgatctgcttgatcggggcctcgatggcgcggaacacgatggcggcaccggtagcctcttcgccggtcagggaggtgacggcctcggtcttctcggccttggcagcagcctgaacgagggccacgccaccgccaggcagcaggccttcctcgatggcggccttggcgttacgcacggcatcttcgatgcggtgcttgcgctccttggcctcgacctcggtggcagcgccgaccttgatgacagccacgccgccagccagcttggccagacgctcctgcagcttctcacggtcgtaatcggagtcggtgttctcgatctcagcgcggatctgggccacgcgagcgtcgatgtcttccttggagccagcgccctgaacgatggtggtctcgtccttggagacgatgaccttcttggcgtggccgagcacggaggtgtcgacggactcgagcttcaggcccagttcgtcggagacaacctgagcaccggtcaggatggccatatcctgcagcatggccttgcgacggtcgccaaagcccggggccttgacggcgcaggacttgaaggtgccacggatgttgttcaggatcaaggtcggcagtgcttcgccgtcgacgtcctcagcgatgatcagcagcggcttgccggtcttcatgaccagctcggccacgtgcacgatgtcctgctgggatgagaccttgccggaggtcagcagaatgtacggatcttcgagcactgcggtctggtcgtcagcgttggtgacgaagtacggggcgatgtagcccttgtcaaaacgcatgccctcggtgaagtcgaggtccaggccgaagcggttgttgtcttcaacggtcacaacgccgtcctggccgaccttgtccagagcctcagcgatcttctcgccgacctcagggtcagcggcggagatggtggcggtagcagcgatctggtccttggtctcgacgtccttggcggcagcgacgagttccttgacgatgacctcggtggccttctcgatgccgcgacgcagggcgatcgggttggagccggcgaccacgttcttcagaccctcgtgaaccagggactgagcaagcacggttgcagtggtggtgccgtcaccggcgacgtcgtcggtcttcttggcgacttccttgaccagctcggcgccgatgcgctcgtacgggtcttcaaggtcgatttccttggcgatggacacgccatcgttggtgatggtcggagcgccgtaggtcttgtcgagcacgacgttgcggcccttcgggcccagagtgaccttgacggtgttggcgagcttgtcaaggccctccagcatgccctgacgggcttcctcatcataagagatgatctttgccatggttgcgtattcctccaaatggctaggtataccggttatcactcgcaagcgtcgagtcgtgacgaccagccgtcagctgccgattatcactctcgacctccgagtgctaacccagacattagcactcgcgcccgccgagtgccaacaccatcggcggcgattgcgctttgggcatgaaaaagccccaaccgtcgaaacggtcagggccttcaatgcacatccttgcgtgcgtgttactcactcggagcgggcttcacccgaagacagcttgacaacatcctttgcctgcgtgcctttgccggacgaagcgggcgtatactccacgcgatcgccctcgtacagcattttgaacttattggtgctgccgtcgtccttgatttccgcgtagtgcacgaaaacgtcctcgccgccgtcgtccggctggataaacccgaaccccttcttggcaaggaagaacttcacggtaccttgtgccatatctggtctttcctttgttcccttgggcgtcgcgacacaaaacctatagggaacgtagaaagaaccgcatcgcgctccccctacctcgcgactagatgacgattgtacagtgacgagggaacaatctcaaccgcagtggcacattttcggtacgaattattccataggcgtgagaacgctcacagttttcgatgtatttctcgccgatatcaggggcgcatcaacaacgctagttgagcaacaccaccgtaatgggaacggcgagtccttgcacctgctccacagccgaaatgccaagcgtggtcgccacatcctcagcggtggccttatcggtctcattctgataccacaccacggaagaagccggcaatgtgccgctcggattggtcgcctcgacactggtgtaaccggcggtctgcagcacatcggcctgctgacccgcatatccttggattcctgtggcgttgaccacacgcacctgcgtggccttattcacagtcgcgatggcttcggactgctgagactgctgatcggagttttgattctcattcgaggatgtcgtgtcactgtcggtatcggactttgccgaatccgaagtcgagtccttggacgaatcggtcgaagtggacgaggaatcatccttggtgctgttcttggtctcagccttgctggacgaatcggacttggacgtggtcgccgtctgggacgatcctcccactacattcttgtattctccggaaatccatgcccaggccccgacaccgcacagcgcggccaccagaataacgacgatgaacgggcagaggcgggccattaccgaacgagcgccacggtgaactcccaccggtcccttcggaggattgtcgaaggaatccggttcataggattcgtaggtcatcgtgtcgcgtgccataatcgccctttcttcctatcaaaactacccatgagtgtaatcggcaaacaactcatcagtccaccacaccacgccccatgcaccggatatgcacgtttgactacagtggtgagtcatgatcaaaccattgagcgaactggtagagccagggtgggcccatgccttggccgacgtggagcccaccatccaccatatgggcgattttcttcgtgcggaaaacgccgccgggcgcccgtggctgccggcaagccacaatattctgcgcgcgttcaccatcccgttcgattccatcaaggtgctgattgtcggccaggacccctacccgaccccgggtcacccggtgggtttgagcttctgcgtggcgccaaatgttcacccgctgccgaaaagcctgatcaatatttataaggaattggttgacgaccttggggtgcccatgcccaccaacggcgatctgacaccgtggacggaacgtggggtgatgttgctcaacagatgtctgactgtcggcgtcgggcggccaaattcgcatcagggcaaaggctgggaggaagtcaccgaggccgcgattcgtgcgttgaacgcgcgcacggacgccgacggcaagccccagccgctggtggcgattctctgggggcgtaatgcgcaaagcctcgagccattgctgaccaatgccttcattatcaaatcgcctcatccgagtccgctgtccgcttcccgcggattcttcggctccaaaccattctccagagccaatcaagccctagtcaccatgggtgccgacccggtggattggactctttaggcaggccaacagtcattgtgagtagttacagtggggggcatgactttgttccccacgcaaccgaacataccttcgccgaccaccgccgcacgaccggtcgccgttcccgcgcccggcgtgtcggctccgctgggtgccgatgacgccaaacgcgcacgtatcctggccgacgccattcgggcgaggttcgcccagacactggtgggtcaggataatctacgcgaatcgcttatcgtgaccttggtggccggcgggcatattcttatcgaatccgtgccgggcttggccaagaccacggccgcccagacgctcgccacctgcgtatccggctcgttcaagcgcgtgcagtgcactcctgatctcatgccatctgatctggtgggcacgcaggtcttcgattttgcgtcgcagaagttcaccacgcagatcggtccgattcacgccaatttcgtactgctggacgagatcaaccgttcgaatgccaaaacccagtccgccatgcttgaggccatggccgagggtgccacgaccatcggcgggcagcgtatcgccttgcccaagccgttcatggtgatcgccaccgagaatccgatcgaggaggagggcacgttcaacctgcccgaagcccagatggatcgtttcatgatgaaggccgtcatgacctatccttcgcccgacgaagaggctcggatgctggccatgctcacccgccgcggctccgatatgatcggtcccgacaccatcaccggcgaacgcatttccgtgtccgacgttgattttttgcgcaaggcggcacgccgcgtgcatgtttccgacgcgatcatgcgttatgcggtcgatatcaccgccacgtcacgaggtgccggctcccgccccatcaagggactgtcgtccttggtgcgtttgggcgcctcgccgcgcgccaccatcgccttgacccgtatcggccaggcgaaggcgttgctgtccgggcgcgactatgtggtacccgaggacctcaaggcgttcgctcatgaggtgctgcgccaccgtattatgctgacgttcgaggcactggccgatggcgtggtcagcgatcagatcgtcgacaagatcgtcgaaacggttcctgttccgtgagttccgattccgttcgcaagaagatcgaggcccttggcactcagctgagcctgcctaccgtaaggaaggctttgggcgcgctggagggcgaacacgcatccgggcgtcgcggcggcagcggcgatgcgatggatgtgcatgcctatgagccaggcgacgaatcccgtcttatcgattggaagaccagcgcccgccaaggccgccccatggtggtcgagcgcgagcgcctgtcgacgtcacgggtctggttgctgatggacgtgggcctggagatgactggcgtatgcccttccggagaacgcgcatggcaggttgccgccaatgcgctgcgtatgttcgccgcactgtcgttgcgccggtcggacgatatttcgctggtgttcggcgatgagtccagtatcacccgcgtgccgttcaacggtgggttcgcgcagttcgaacgcacgctggacaaggcgcttgaccgtgattgggatcatcaccgtaatatcgacgcgctgctggaatatgcgcgccgtatcaaggatcgcgaggcattgatcgtattggccaccgatgagcatgcgatggaggagcggcatatcaccacgatccgtcgtattacccgcacccatccgatggtgctgatcgatgtggcgacgatgaatccgttcaaggccgtctcatcccgccacgctcccaccgacggcttgagtgcacggcgtgtgccggcattcctgcgcaacgccaaggcagcggccgaggtcgatactcatcgcgcgtatatggccgcggctttggaacaggagctcacccgtgccggttcccatatcattcgatccgcatccagcgaatccatgttcgatcgtttcgtcgccctggtgtcccgggcattggcccgcaccacacgcaatagactgggtactgcacccgaactggtcggactgactttggctggtgatctatgatgcacagcatgttccccatcatcccgctcgccactgatcccggcgatctcaggcccgtggagtcgttggccttgaccactcccctggtggtggccatcatcgcatgcctgttgctggcggtaggtctgatcgcgttgatcatcatgctgtctcgccccgcacgcaaacctcggaacagcgaccgcgcgcgtggcgctcatagcaatgccagctccaaggccgagtggcgtgcccgcatcgacgatgtggtggcccgtcatgaatccggagcactgccccggcatgaggctttcgtcgaattgtccgtcatcgcccgtgatttcgccggtgccgcatcaggcaaggagcttagttccagtacgctgaccgatttggcgtacctgaatcgcacgcccgcgaatcgccaaggattggacgcattgaagcagaccattggcgcgttgtatccaccggaatttgccgatgatgcccgcaaccgaatcgcccagacgaccagcgtgcagcaggccgccgagtgggtggcgaatctggtggaaaggtggcgttcatgatgctggcatggcattggccttgggccgctctggccggcgtcttggcgacgctggcgattatcgtgctgattgtcgtgttcgcccgccgtaacgccgccgacgacacccctgtattctcgatggacgacgatctcaataccgagcacgcttcccgcctgttccgtcaatggcgcgctttgggccgtctcgccatcagcgtgctggtgcttgcgctggcgctggccattgtgctggtggctcgccccagccaagtggatgccggtgacgaacgcgcttccagccgagatatcgtcctgtgtctggatgtgtcggggtccacgctcccctatgatcgcgaggtcatcgacacctatttggaactggtcaagcatttcgagggggaacgtatcggtttgagtatcttcaactcgacctcacgcacggtgttcccgctgaccgacgactacgaactggtcaccaaacagttgacctccgccagcaaggcgctgaaaggcgtcgagtcgcaggatgacatcgataagatgtccgatgccgaatatcaggacatcgccaattggctcgaaggcacgcagaaccgcaaggacgccacctccttgattggcgacggcgtggtgtcttgcgcggcgatgctccccggtttcgcttatggcgaagccaatcatgcgaatgccgaccgtcagcgtgcggcatccatcgtgctggccaccgacaacgtcgtgtcgggcaagcccacctattcgctgaccgaagcgttggatttgacccagcagaccaaaatcaccgtggacggcctgtattccgggccgaaagccagtgaatcggaccaaaccacaacggatatgaagtccgcgatcgagtcgcatggaggcatcttcctcacccaatcgaatggcgcgtcgatagatgagctggtacgggatattcagtcgcgtagagatacggatgtggagaacaaggcgaaatcctcgatggtggacgctcccggtctgtggacgcttgctctggccgtgatactcattatctggatcgtatgtgcatggaggttgaggcgatgaacggattcaccttctcccccgccttgggctgggtcgccggcggactgctggcggccgggctcgccgtactggccattctcgaaatcgcattatttgttcgtcgccgtgcttccagtgacgagaccgtgtgggcttgcatacgacgtacgcttatgctgctcatcgtcgcggtgatggtactgactcccagcgtggtatcgtctaccacctcacaggccatcaatgccaccgacgtcatcgtggcggtggataccaccgggtcgatggcggtggccgatgccacatacgggtccgagaagaccattacccgcatcgatgccgcacgtcaggccgtgcatgatgtgaccgccgcttatccggacgccagtttcgcggcgttacggttcggtgcttcgggaacgcttgatgtgccgctgaccccggatgcgccggccatcgataattgggccaacacgttggcggtggaagccacatccgtgtcagcgggctccagtctggatgctccgatcgatcaattgctgctgaccgcgaagtcgattcgtgaagcgcacccggatgatgcgattgtgctgtacctcatcactgacggcgaacagacctcgaatgtgacgcgtcgtacgttctcgtcactgcgccagtatctcaatgatgggtttaccgtgggcgtcggctcgaccgagggcggcaagattcccgtcatcgccgatggcgtcagtgccggcgattccaacaccacggaccactgggtggtcgacccggataccggcgaacccggcatctccaagatggatgagaagaaccttaaagacattgccgacgagatcagtggcacgtatgtggccgtgaacgcttcacagactttggcggattcggtttcggccaagtcatcgaagcagtggcgcatgaccaccacggtcaaggagcgcacacgcaccacgccggtggtatggccgctggccattgcgttggcgatattgcttgccatggaagtcggtgcatggatcgcaacctcaaggagactgctgtgagaaacagtaacgaaatccacgagaacgatggctcggcgaatactcggatgcgggcgaagtgcccgctttggacacgtatcgtcctggcttgtggcgccgtattgctgttgctggttgccggcgtggcggcagtaaacctgtccgcttcgattacgttcaatcaggccaccgcatcattgaacgccaatatcaaagcggctcaggacgagtccacggatatcaccacgctcaaggcgcaacagcagcagaccgatgcgcaattcgccgaggccgggcgaatgcgcacgcttctgttgccgcaagtcaaggacgccatcgacgccaatgcttcgatttcttccgagctgacaaagatcaccctgaaacaggccgaggcgcagaacagcggttccgattccgggcaagcccagtcggcacagcaatccgagagttcctcatccaatgccaaaaagggcggcgcgttgaccgacgaacagaagaagcaggtcgaggagctgatgaaggccaatcagcaatccaccgatacccagtcgaacaccacccaatccgagcagaaagcgacgcagaacaagggtaccggggccaccaagccgtggtaagcagtcgttcacagttgttctttttctcacaccctcatgggtcatggccttatcgcggctgtttcccggtttcggctgtcggctttgacgtttgtccaatttttcgataggccatggctgatccaaggtatgtccaaacaggctatttgtggataatcgttacgactatgcacaacacttggggataacttcgcccaaaatcggcaagctagaaccacattggtcgttccggctggacaagcatgagtcctgtccttttagctggatatatgaatacctacaccagcaacccagcacccatcgatcccaccggcggctttgccgacaatacggtgacgccgttcgattacggcacttgcccttgccatgcggcggtacagcgtagtcgcgacctcgtgtccgtccagcgtgcggccacactggcgcaatcggaccagacggcggtggccgtgaaccgctccagcaacatcgtgtggaccggtaaagccgccgatctattccgatcgcggctcagtcgcaccgcacagtattcggccagtctcgcgcaagacatggagaccacccaccgattggcttgggggtcatcatgagcgagcacgattactggcaagtggaatcgtccgtttacggcggagtgggatatgcgccagccactcttgaagaatatgtcgtcatagccaaggctctcgatgacgaggcggcaggatttgcggccatagccacggcttgggaatcggccgcattacagttgcagtcacatcggcatagtgcgccgatgtgcgtcaccttgcagtcgggcgatccgagcgccgttgttcccggccatgtcactgcaccatatgccgcgctgggcaatcggtgttatgaccatgcaacggcatgtcagcggttgagcgatgatctgcgtggcgcggccgatctgctgattcgcgcacactctctgtattctcaggcggagatgacggctcggcgcatgtttaccgaattattgcaggccggcacacaggccaaaccgggatatgccgcggtgggtgttgccgctgtggcggcgggcggctttctggccggctggactattgacggcaaaccgaattcggcatggatgtccacgttcacctatccgttccaggaaggagtgcttagcggcgcgggcggaatcattggcggcgtacctatcggcaagagcattgcgcacaccgatgaggtcaacaaggctgcggggaaaatcgccaatttctccggcccggcgaaagacgtcgtccaaggcaatcatctggacgtgcgcgaggtgcaggcgaatgccgacgtcgtccgcgcaagcggatcggtggccgagtcaatggagaatctgcgcaggctcgccgaagagcggctcggcaaaatcgagctgaacagcggactcgaatatgggaccatcgccattcaacgctatgaacgatctgatggaaccaactcctggctggtcaccatcccgggtaccgatggacagcctgactcaccatttggctgggcgcagaacgtggaactgatgagcgccgatcaggagcgccgcaggaaagcggacagcgctcgcatggttgccgaggcgatgcgtcaggcaggcatcggcaaggatgagcccgtggcgctgatcggccattcccagggtggtatcgttgccgccacgcttgcctcggattgggcggaggaatataccatcgagcatgtggtgacagccggatcgccggtggccaatcatccgattccgcaacgcacgtgggtcaccagcgtggaaatcgatgatgaactggtcgccgcactggatggtgccgccaacccggtcaccgataactggctcaccgtacaagggcatgtatcgcccgcgcccgcggcaacaccatccacagtgcattcggacggctcatgcactcccggcgcaacgcccatcaccggcctgaccccatatgacgccgcacccgtggctggttcgaccaacggcagggagttgtcgcactggatcaaataccatcaggccgcctatcagaacgccaccgacctcggctcccccgccgtgcaacgccacgaagcccatttccaggaagttatcaacggagagctcaaggaaacccgctactaccaaggccgcatgacccagtccgcgaccattgcccctagcgagcgaaccaccgagttcagcacgttcggcggttaaaagtaaataccacacttgacagagttgtcaagaaaggagttaacaatataatgacgagtaggagatggctcatcaaactgatgaagcaagcggcagaacgcaagaatgtcacgtttgaaagtatcaggcaaggagggagtcatgagatattccaactcgacggacttatgattccccatcccacgacataacgaaatcgacaacaacctcgcggacattatttgcaaagaagcagaagccaaactcgggaaaggctggtatcagcagtgaaaacatatcaggtcatcgttcgccctggcgaaaaatactggattcttgagattcccggtatcggtttcacgcaggcaagaacaacagcagagattgaaagtatggcacgcgaccttatcaccgtcatgacacaagatgctgatttcgcactcaccgtagagacaaagctgccgcaatccgtgcaggagcatcttgatgaagctcggcgactgcgcaaggaagaagcggaatgcagatcgaacgcagcgcgggaaactcgcgccgcggcacaagaactacatggcatgggtctcgccctacagcaaataggcgatatactcggggtctcacggcaacgggcacatcaacttgtcaatgcttagcatcaatcggctaccccacaatgcaatcaccgcagagacgcggctagcgccactttcccgggattgttgcgccagcatgcccgaaccccccctctatcagcgcaacattcccgggagagtggcgcgcaaagagtgtcaggcgcgtcgctcgatgagtgcgcggccggatgcgaggcggtcgagcacaccggttttggcgatggccagcatcagataccaggccatcacgccgctgataagcacgccgccggtgacctcggaaatcatgtgcacaatgccacgcgggctgacgaatgacacacccacgtagcgaaacagcatcagatatgtgccgtattccaaggcgaccaacgcaccggatgcaatggaaatcggcagattgaacatgcggtaacgggtcaaggcgaacggaatctcagcgaaaacaccttgcaacagcgccgagataatcacgaagcccaaatcgaactggctaccaatcaccgtttcgaccagcgtgccgataaggttcacgtacagcgccgctccgggtttgcgcagaatcagcaccgccagcgtaccggagaagtaccagacggcgtgcacgatgctggcgaaaccgggcagaatcgcgccgaataccgaagagatcggcatgtacgcgaagttgaatccccagaagatcacgccgcaggccgcacccagcgtggcaccgaccgcgatatccaacggctgccatttcagtgacgatacggcaatcggacgtttcggaagagtatgaatggtggttgcaggcatggtgatctcctagccttaaaggccgcacacagtaatcgaaccacgggcgttccttgacctgtgcggctcgggcgggaacgccgcaccacagtatagccgctcggttcacggctggaagtacccttggaggttatgaagcttaccgatatttcccccgcaatcgcattgaccccactcgacggccgttatcacaaggccaccgccccgctcgtcgaatacatgagcgaacctgccctgaaccgcgaacgcatgcgtgtcgaagtcgaatggatgattcttctggccaacggctttgagggcaacggcaaccagccgatcgttgacggcgtcaagccgttcactgccgaagagcaggccttcctgcgcgccattcccgaggacttcggcgccgaaggcatcaagcagcacgccgctcatgaggccatcacccaccacgatgtgaaggccgtggagtactacatcgatgatcagatcgacaaggctccggccgagctgaccaacatcaacgacgagctgaagaccctcgtgcacttcgcctgcacgtccgaagacatcaacaacctctccatcgcccgttgcgtcaagaacgcgatggaaaacgtgtggaccccggagttcaagcgcatcatcgaccacctcgccggcaaggccgaggaattcaaggatatgccgctgctctctctcacccacggccagccggccacgccgaccacactcggcaaggagctcgccgtctacgtctaccgtctgaaccgtcagctcaagcacatcgaaaaccaggagtacttgggcaagatcaacggcgcgaccggcacgttcggcgcccacctggccgcatgcccggatgtcgactgggtcgccgtctcccgcgaattcgtcaccaaccgcatgggcctgacctggaacccgctgaccacgcagatcgaaagccacgactggcaggccgagctgtactccaccgtctcccacgccaaccgcatcatgcacaacctgtgtgtggacgtgtggatgtacatctcccgtggagtgttcgcccaggtgccggtcaagggtgccactggttcctccaccatgccgcacaaggtcaacccgattcgtttcgagaacgccgaagccaacttcgaaatcagctgctcgctgctcgacaccctctccgccacgctggtggaatcccgttggcagcgcgatctgaccgattcgaccacccagcgcaacatcggttccgcgctcggctactccttgctcgccctgaccaacctcatgggcggccttgagtccatccacccgaacacccacgtcatcgagcgtgagcttgatgagaactgggaggtgcttggcgagccgatccaaaccgccatgcgcgcctgcgagctcaagggcctgccgggcatggacaagccgtacgagaaggtcaaggagcttatgcgcggccacaccatcaacaaggaacaggtcgagcagttcatcgaccagcagtccttcgacccggaaaccgccgctcgcttgaaggctctgacccccgccacctacaccggtgtggccagccagctcgtcgctttcgaccgctgaaataggtgcgatgcgagtccctcgagcccctcgaatccctcgcatccaccacactactgcgctgagtcacaaaccgaaccgcaaactgaaccgaacaaggacaggcgtcaggtaaccatttcatgactactgaacaggatcagtccactacggaagatcgcccgaacaaggcgacctcctccactaccgaccggccgatcgcctctggtgacggccggtcggccagttttgctgtcagcggaccggacagcccggcaaccgacgacagcaacgattccggaccgtacatcgacgacatcgctccgcgccgcacgcgcgacttcggcgatctgacccgggccggtctgtcgctgttgatggccgccgtggtcatggtgttcgccgtgtatctgggcggcatgacgcgcggcgtcgaatccgacgcacacaccgcagcccaggtcatcaactggttggctgacttcccctccaccgtgctgacgcagctggccaccacggtcatcgtagttatcgtgctcgctcagttgctcttggcccgcgaatggctgcaagctgcggtgtccgcgctggccatgtttgccggatacggcatggtgtgggtcatatcgacggcaatcagcagtctgaacgatttcaccctgccaatggcactggtctcagccgccacctcatacggctccgggctgttgcccgacatctacgccggcatggcgtccttcctgaccgccgccgggccacgccgtacccgctccacggtcaaatggagttggaatatcctgtatgccatcgccgcggtgatggtggtgctttcgtggcattcggttaccggcatgctggtttcgatggccgccggtcgcacggtgggcatgcttatccgattcgtggtcggcacgcagaataaaggcgtgtggggcaaagatctcgtcgcagtgctctcaagcatcggattagagaccacctcactcatccggcatcaggagcccggaatcagccatggctcattgtctgccacgttggatgacgatttgacggaaggctcgcgcatctacgatgtggagaccgcgaataaccgtcgttttatcgtttccgtcatcgacgcgcaaacccataccgtcggctatctgaagcaactctgggattgggtgcgttttaccagcgtgtccattcgacgcgatcgttccgtgcgcgacgccgttcagcatcactttgccatgctgctcggcctgcacaatatcaaactgcccgcgccctccccatacggcatcgccgatacggacgagtccgcgattctggtgctggatgcgcacaccatcgagttgcccgccaacctgaacacgcttaccaaggcggatgccgtagcgtatatgcgatatctgtccgtggcaaatcgccgtggatatacgcaccgacgcatcacgcctgatacgctcgcccggctcgaagatggcactgcggttatcgccggctggctgaatggcgacagcgcttccggcccggccaataccgcacttgacaaggttcagctactcgcgttgttcgccgcactgatcggcgtgaaaccggcagtcgcggccgcccgcgaagcttggggagacacgacgttgaccacgttggccccgttcattcagaaagtcgcggtcccctcccccacacgcgcattgggcacgtgggacaagcagctgctcaaggaactgcgagaccacatcaacaccataatcgatgaggagaccgccgaatccgccgagccggtgacgctggcccgcttctcttggcgttcgatgatcaccatgctgctggtcatcgtggccgtggtcgtggtcttcacccaactgaagcccgaggagatcatcaccgcgctgaccaacgccaacccgttgatggcggtggtgacgctcgcgttcggtgtctgcggctggatcggctcgtcgatttcgctcggttccctgatggcgcggcacaagcgtgacaatatgggcgtcttcatgagccaggtggcaggcggcttcgccaccgtatccatgccagccggcgtgggcccctcgttcgtcaacctgcagttcctgcgcaaatccggctatcgcaacacccaggcgaccgcaattatgagcgccgcgctcgtggtgtattacgccgtgtacttctccatgctggtcatcatcggcctgttcaccggccgcaacatgttctccggcgcaatcccgacaaacacgttggttatcgtgctgggcgttgtggtcgtggtgctgtccattgcgatgatgattccgccgttgcgccactgggtgacccgtcgtcttatgccgctggccaagacgtatatcaaccagctgctggacgtgctttcccagccccgacagctcacagtcagctgcctaggcgcgctgttccagaacgcgaccactgggctcgctttctgggcggccctgcaagcgttcggctattcatcgaatccgattgaaacgacgttcgtcttcctgctggcctatgcattgggttccgcagtgcccactccaggcggtctgggcggtgtggaagcggcgctgacattcgcgttcgtggcggtcggagtgccgcagggcgtggcgctttccgccactttgctgcaccgcgtggtgttctactggctgcgcattccgctgggcgcggcggccatgaagtggcttgacaagcataatcttgtctgattcgtctattttcatacccccttcggggaaatagatgtgaaaacccttataaaacgcgggttttcgcagaaacatgcgctagtatcattgatgacaacatggactaagcaaaagtgcttgtcccctgacccaagaaggatgctttatggcatacaacaagtctgacctcgtttcgaagatcgcccagaagtccaacctgaccaaggctcaggccgaggctgctgttaacgccttccaggatgtgttcgtcgaggctatgaagtccggcgaaggcctgaagctcaccggcctgttctccgctgagcgcgtcaagcgcgccgctcgcaccggccgcaacccgcgcactggcgagcagattgacattccggcttcctacggcgttcgtatctccgctggctccctgctgaagaaggccgtcaccgagtgaccttctgctcgtagcgattacttcgagcattactgacgacaaagaccccgaccgagatggtcggggtctttttgttgtggtgctgtgacgtgttgtccaaccgtattattccggactagttcagcgcttccataagctgctcgaatcccagggtgggctcggcctcgaagggatcgaggagtatggcttcccggcgttcgggggcggtcagggtcaggtgggtccagtcggcggagaactgggctccgacgttcagggccgcgtccacgaaccggccacgcagggcggcacgggtgtcggtcggcggattgtgcacggcgtattccacgttgtctcctgtcagcagctcacgcatctggttgcgggctacgagcgaaccgtacaggcgaccgttggcgatgtcgtggtagtcgagctcaagctgttccatctgagcgaaggtgacgtccgggcgacggcgtttgagcgcgtcgaacagacgcttcttggcggcccagtccacgcggtcggcgagcgcatcgtatgcaccacgctccagcgcgtccagaacgcggctccactcccccataatcgtgtcgatcgtggtggccggcagcgaacttgccagcgcatcgccatgggtttcgatgaaggccttgaccgccgcataataccggcgctgcagacccagtgcggacacggattcgcctgattcgagcgtcagttcggcgcgcggattgtcaaggaatcgactgaccgtgcgattggcggcagccggatcagcaaaggcatactgctcgaatccggacggaacgccatggcggaaggcgtcttcgatcgcgcacagcacaaggtgcgtgacggcaagcttcatccatgtggaccattgcgaacggttcgagtcgccgatgatcacatgcagccggcggaaggagtcggggtcggcgtgcggttcgtcgcgcgtgttgaccatcgggcgggagcgggtggtggccgaggagacggcctcgtccaggaagtccgcgcgctgggtgatctggaagccgtccggggtcatgcggccggcaccggtgtacagctggcgggtgatgaggaacggcagcagctggtgttcgatggtctccaacggcacgaagcggcggaccaggtagttttcgtggcagccgaaggcgtggccggcggagtcgacgttgtttttgaacacatggatcgtggcgtgtgcgccgtaggattcgcgcagcttgcgctgggccttcagggctaggttgcgcatcacgtgttcgccggcgaggtcctgggccagggcctcgcgcggatcgcgcgcttcggcggtggcgtattcggggtgggatccgacgtccagatacagacgtgagccattggccagatacgtgttggtggagcgggaacgggagacgatgggctggaacatggtcatcgccacctggccggcgtccacggggcgttcggcaccggtgaccgccacgccgtattcggtttcgacgccgaaaatacggcagaacccgtccatctcggcggatggtacgggttccgtggcgtgcagggagcgggtgccgctgtcacgcagttggggcatcactcgccgcctttttgcacgaagctgttgacgtattcctcggcgttggtttccaaggcggattcgatgtcgtcgaggatgtcgtccaacacgtcggcttggtcggtggactcggtttgggcggcggcctgcgtagtggcgagggcgtcgtcttcctgggtcgcggcctgctgtgcttgaggttgttcgaattgttgtggcatgttgtcttcttcttgggctgtcaaactcccctcagtcagccttcggccgacggctcccctcacccgaggggagccggaggagacaggaattatcgaattatcgctggttgatggagtcgggccacggatactggtgcaggtaatgctgtagttcgcggatgatgagtccgttggaggccactacatcgttatcgtgacgccagtggatgcgttcgccgtcccaacggctcagcgtgccctgcgcctcccagaccaccacggtgccggcggcgatggcggggatatcccacacgtgcagcatcggctcgaagtaggcgtcgtaggtgccgtcggccactttgcacaggtcgagcgaggcagggcccacacgcttgatgtcggccgggcgtccggcgagcgaggatgccacgtcgagcgcacgctgcgattcgccgggcaagaaggacatgccgtagcccagcacggaaccatccagtgaggaggtcatcgacggcacgactttgtcgcgcttttcgccgaccgtggttttgtggatgcgcacggcgcccgctcccctggcggccaggtaggtcaggccgagggccggggcgtgcacgatgccgatgatcggcttgggctcattgtccgggccgaattcgaacagggcggcggtcactgtccattcgctcatatggcgtacgtagttgattacaccgtcgattttgccgatgtaccagtaacgctggccggggcggctttcggcgggtcgggtggtccagaagccgtcgaagtgggcgatgtcggcgattctggagctcataaagcgcaaaatcttgctgtcgacttcgagcttatagcggggaccacgatccgcgttctcggcgctcggctgggcgaggttacgcggattgagctggtcgtggagggcatgctgaccggcttcttcgagaaggccggcgactttgagcgcaaggttgcgcaggtcctgtggggtctcttcgcgtgtttcttccatagctaccaagtctatcgttcggcgttgatggccagcgacttcagcagatcgatggcgtgttcggccgaattgagttcggtttcgcagcgcgccttggtgaaggcgagcggatcggagatgtcgagggagaacaggtgatggtcggtagcggccatatggccggcattgccgtagaattcgacagcctcgccctcgtctgcggcgcgcgggtcgcgaacagtgagtcgggaccagctggcggcggccacctcatcgccgaattgcgccacgagttttgccctgagccaggcgcgggtgtcttccggcggttcggtagtggcgcgtgcgatgtcggcggcgctcaccacccgttcggtgcggggttcgagtttggtgaagatgctgtccgcggggtcgagcgccgcccatttcaggtcgatgaccttcagtcgcgggtcgttccagccattggccacgctgggcgcagctgccgcggtgattttgcggcgcagtttttcgagcagctgccatttgagcagccattcgatgcggctggcctcgccggtcatggccagacgttcgtcatcgccggcggtgtgacggatggaggcgcagtcgatgagcgcctgctgccacatcgccatgatggatgtggtggatttgtccggccaggcgggctcgccggcggtgtcggtgccttcgaccagtgcggcgacctggtagacggcttggcgcagtttgagctggataagccatgcgttggtttcgccgccgttggccagcggcaggcttgcgcccagcgtcaggtcgtgggagacggtgtgcatggcttcgactgggtcagacagttcgagttcgtcgaggaaggcgttcagatcgaatccggcttcgtccgcgtgttcgagcagccacagcagcatgctcgtggtgccgagtttcagggcctgcggtacctccatacggttggcgtcgccgacgatgacgtgcaggcggcggtattcgtcggtggagtgggattcgtcgcgcgtgttgataatcgggcgttcgaaggtggtttgcaggccgactttgacgtggatgtagtcggcgcgctggctgagctgatagccggggatttcgctgttctcgccgattcctacgcggccggagccggcgtagatctggcgggtgacgaagtggagggtcatcaggcgcgtgactaggtcaaatggcactgagcgggccatcatatagttctcgtgcgcgccccagcaggagcccttgccgtccacattgttgcgatgcagggcgatgggggcgccggtctgtgtgcgggcgcgttcggtggcggcctgcatgatgaggtctccggcacggtcatagcgggccgcttcgaacgggtcggtggtttccggtgccgagtattcgggatgggcgtggtccacgtagacgcggccaccgttgggggcgatcacgttggtgatgttgagttgtggggcgtcggtgagcatgtccggtcgggcggcggcacgttcgagtcgggtgccgcgcgcgtcgttgaccgggtcctcctgccggtagtcccagcggatggatttgctgtggctgtccgcggcgccgttcaccacgtcgaaggacagttgcaccgggttgtagcggtccggggtgttcagggataccgcgtattcggtttcggtgcccatcactcgtttgacggtcatgtagtgctccttgagcttgagctattcggcggtgcggatgcggcggatcgggtccatgccgttgatgcgcgaccattgttcggggtccacgtcggccatggaatcgcgggtctcgcggtattcgtcttccacggcggcggcgagcaacggcacggtgagtgccacgtccgagccggtttcgatggattccttgaccgctcgggtcttggcccggtccacgatgttcttgagcatcgcgccggagaccacatcggccaggaacaacgcatgccactggccgttctcctcctgcacgtcgcacagatggcggcgttcggaggctccgtaaatgtcatgcaccagcacggcggacaaggcgtgcgcgtcgacgccatcttccagaggcaggtcgtcggtcaagtaatggtccacgatggcgatggcctgattggctttgggccgaccaacgcgaatcttgacgtcgagacgccccggtcgtagcacggccggatcgatcatgtccacgcggttggatgcgccgatcaccatcacattgtcgagtgattccacgccgtcgagttcggagaggaactggggcacgatcgtggtctccacgtcggaggagacgccggagccgcgggtgcgcagcagcgaatccatttcgtcgatgaaaacgaccaccggattgccgtccgcggcgcgttcgcgggcgcgctggaagatcaggcgaatcagccgttcggattcgccgacgtatttgttgagcagttccgggcccttgacggacaggaacacgcctttaacgcgggtttcggccgggctgatcgagccgtcgccgttcgtatcgtcccccctcgcacagggcgttcgccacggccttggcaatcatcgtcttgccgttgccgggcgggccgtacagcagcacgcccttcggcggcttcaaatcgtaacgctcaaacagcgcacgatgctggaacggcagttggacggcgtccctgatacgaccaatctcactatccaagccgccgatgtcggcgaacgtgacatccggggtctcctccagcaccagatccttgtcgccctcggcgggcagcgcttcgatggcgaggcggacggacggatcgacgataatacggtcgccctgattgatgcccgcatacgcgagcgcgccggaacggcggatgagcacgggattgccggaggcgtcggtaacgatcagtcgaccgtcgtcaagtacctgcttgacactgcgaatctggcccacggtgtcagcatcgcgctgctcgaccagcacgagcttctcgttgagcatcacggtggccccggcggtcaggcgggcggcgttgacgttggaggccacaggcaccaccatgcggcgggtgccggaaatgacttcggccgacgcgtgctggatgccgtcttcatcggtgcgggtggaatcgaccttgaccatggtggcgaaggtgagcggcggctgagcgagctgggcgagctgtgacttcgccttggtcagttccttgccggcgcggctcagcgcttcggcgagcgcatggttcttggccatcaggcgatcgttcagcgcggcgagatcttcggtgtcgctcatgcgggttcttcgcttcccttctatccgggattttcggcaacttatggcagtcggcagaccctattcgttgccgtcggaggatttcctgttacgtattacagtacgcacttttcgcaccacgaaccatacgatgatcacaatcacggccgcgatgaccacgtcctcgaacacgccgagcgcgccttgaatcgagcaccactggtcgccgagcaggtaaccggcggaaacgaggatggtgttccacacggccgagccgagcagggtccagccggtgaagtgcaggaagttcatgcggttgaatccggcgggaatcgaaatcagcgagcgtaccacgggaatcacgcggccgatgagcaccgaccatgtgccgtatttggtgaaccagtcgttggctttgctcacgtctttgcggctgacgccggggattttgtctgccgcgagattgatgcgatgcaggcccacccagcgggagatgccgtacaaggtccaggcacccagtacggagccgatggtggcccagatgattgcgcccggcagactcagggtgccgcgtgcggcggtgaagccggagagcggaaggatgacttcggacgggatgggcgggaagatggattcgagggcgatggccaaggccacgccgataccgccgatggtttccatcagcatgatcagccagtcggtgatggtgccgatcaggccgggttcggtggtggtgcagatgggtgtggggtcggttgcaagaatagtggcggctgccatggaaaaactcatagagggcattgtcccaaggttttcccagaatcagaagcatgacgcaagaagatgtgcattttgttgacaagtccgccgagagcgaagttgggagcccggctgattctgcggtttctgtgccgacgctgagcaagcccggcctgctggttatggatgtggactccacgctcattgacgaagaggttatcgacgagttgggcgtggtggctggctgcggtgaggagattgccggagtgaccgcacgcgccatgcgcggcgaactggagttctgcgatgcgctgcgcgcacgagtggccctgttggagggcctgccgatctccgtgttcgacacggtgcatgacaagctgcatttcaccaagggtgcactggagcttatcgacacgctgcatgaacacggttggaagatcggcgtggtgtccggaggcttccatgaagtggttgacatgttggcggccgagggccatatcgactattggattgccaaccggcttgaggttgccgatgggtgcttgaccggcaaggtgctcggcgaaatcgtgagcaagactgtgaagttacacgccttgcagacatgggcggaccgtttgggtattccgatgagccagaccgtggctgtgggcgatggcgccaacgatattccgatgattcaggccgccggtttgggtctcgcgttctgtgccaagccaaagacccagctcgccgccgacaaagccatcaacgaccgcgacctaacccacgtactcgattacctgcgccggtaaaattttaccgacctcggctccggcacttatagttgagccatgactacttcaggcgcagaacagttgacgcttgcggggctggctccccgcaagcgtcgtaaacgtgcgcctgcggagcatacgccggccgagcagcatcccatagcgcaagtcgtgctggatgtgcaggcgctccacctcggtcagacattcgattacttcattgatgaaaaagacagcgaggccgcacaaccgggtgtgctggtgcgcgtgcggtttggcggtcagagggtcagcggtgtgatttgggcacgcaccgataccagtgatacgccgcgctcttcgattcgctatatcgagcgagtgctaagccccgatgtactggttcccgcttcgatgcgcgaggatatcggtctggttgccaaagcctatggcggcacacgggccaatattctgcgtttcgccgtgccaccgcgcgtggccaaggtggagaccgagcagcggttggccgcgtcgttccgtcggccggtcggcggctcattgccggataatacgcaaggcggttttgccgggcgtggcaccaatcccgatgggaccaaacttgctggctctacctttgccgttgctagcaccgtttcggagggagctgcgcaggggtatcgtcgtctgaccgccaattacgccgatgtcaatgtgcttcatgacgcgcttaccggtcaacgtttccaatcttttgtgtttgattcgttgcccggtgcacaggagtggcaacgaaacatggcatggatggtggccactgcgttgagtgccggtaaggctgccgtagttgaattgcccaccatgcgcgaggtcgaagacctgatgcatatgctacgcaattatggactcaaaccatttgcccctgctccggccggcggctgggtgggcgacgtcgccgtgcttaacgcggagaccatgcccgcggccgaccggtatcgcacctatctggctgtggcgttgggacaggtgaaggtggtgatcggcacccgtgcggtgatgtatgcgccggttgaaggcccggcgctgttcgccattctggaggatgccgcctatcagaacatggacggtatgatgccatatccacaggcccgtggcgtgatgcggctgcgcgccaagtcccatggcggcgtgttcgtggccatggccaatgcgcgcaccccgcaaagccagtgggaaaacaccggtccaggtacagtggagaccccagtgagcggctattccaccacaattcatccgctcgcctcgccgctgaaggacgccactccttgggtgcgttggctcaatcgcgatgaacttgcgcgtcttgccgacccgtccatcggggcgcgcgtgccgcatacggccgtccacgtgctatctaaggctttggagagcggccccgtgctgctgtccattccgcaagacagcgtcagtgagactctgagttgtgcgaaatgccatcgtcaggcgcgttgtgccaagtgttccggaccgttgcaactaccggccgaccgccgggattccacaccgcgatgccgctggtgtggggctgctgccatcaattggaagtgcccgggctgtgggcatgaacgtatgcgtgtggtgcgcgtgggtgctgcaggcactgcggctgaactggccgggttgttccgcggcgtgccagtagttttgtccagcaagacgcagggcctggtgcgcgatgtggcttgccagccgatgatcgtcatcgccactcccggtttcgaaccgcgcgtgcgtccggtcagtgccgagcagggatcggctggccatgagtatcgtgccgtggccgtgctcgacgcttggaccagcttgtatgcgttgggcgtggatgctcgcttggatacgttgaccgcgtggatgcgtgcggtgtcgttgtgcgcgccgcgttcccgtggcggccaggcgttgattctcggcgaaaccgacccggccctcgcccaatcgctgatgctctgggattcgaggattcttgcagccaaggatcttgaggagcgtgtggagaccggtatgccgccggccgtggccgccgcctgcgtatggggacgccgtgatgcggtgatgacgctgatgcagcgtatcggcgcgctgggcggcgattggacggcctgcggcgagctgcccggcatgttgggcccggtgccgatcgcgcaaccggacacggtcgacgcccgggagctcgaagccacggccgaccgggtgaaggcagtaatccgtgtgccgcagagtcggcgagccgagctggcggcccgactgcaccgggaaaccgctcgtcatgtggcgtcccgcgaacccggcgagcttcgcttccgagtagatcccaaggacctgatctaatcgtcttcaacacgtgaaacgataattacagaatgaacatcgctagaaggaggacaccatgaagggctggcctggagagccggatatggattacgacgtgctggtcgcggacggcgaggccgctgcgaacgccggcaagccgatcaccgacgtgatcttcgatttcggcaacgtgctgatttactgggatccggccgccgtactcatcccccgctacagccagaagaccatcgacgaattcctcgacaacgacatctccggcttctacgatgtcaacgacctgatggacggcggcaccagcaccgacgaggccatcgccatcatgcgccgtgacaagggcgataagtgggcggacatcctcgactactacatcaagaacttccgcgactccctgaccggcatcgtgccgggcgcgcgcgtgctggtcaatgacctgaaggctgccggcatcggcgtgtggggcctgagcaactgggaatccagtctgttccacgtggccgaggaacagtgcgatattttgcagcagcttgatggcaaactcgtctccggttttgtcaagctgcgcaagccacacaaggaaatctacgaggccgcgttgaaccagttcggcatcaaggccgatggcgcgttgttcatcgacgacaaggccatgaacatcgtcggctcgaatgcggccggcatccgtggcgtacgtttccaggatccggtcaagctgcgtgaactgctcatcgccaatggcgtgaacattccggccgtgcagtgagcatcgacgttttaaggaggaccatgctcaaactcgtgttcgccggcacccccgatgtagcggtgccctcgctcaaggcctttgccaccgatccacgttttgatgtggtcggcgtcattacccgccccgatgcgcctaccggtcgcggccgcaagctcacgcccagcccggtcaaggcgacggctctggagctcgggttgcccgtcatcgatctcaaaccccgctcccccgaattcatggaggcgttgaacgacctgcatgcggatatcgccgctgtcatcgcctatggcaatatcctgcccaagaacgtactcgacgcagtgcccctgggctggtacaacctgcatttctccaacctgccgaagtggcgtggcgccgctcccgcccagcgtgcgatttgggcgggcgacccgaccaccggcgccgacgtgttcaaggtgggcgagggtttggacgatggcccgatcgtcgcttccctgaccatcgagctgaccggccgtgagacctccggcgaactcctcgaccgtctggccgaggaaggcgcacccatgtatgtggatgccttggccgccgtgggtgaaggcactgccacattcaccgcgcaaccggccgaaggcctggaatacgcgcacaaaatcacggtggaagatgctcgtatcagctggacggacgaggccgaggccatcgaccgtcaggttcgcgcctgcacgccacatcctggggcatggaccgaactgtttgcggaggggccaatcgccgataatgacgagccggccgccaaacccctcaccctgcatattctcgccgcgcaaccggccgaccagtccaatcccaacactccggccgagcttcagcccggcgagctgaaggtgggcaagaagaacgtgtgggttggtaccggcagcacgccgctggaactcacccaagtcaaggcgcagggcaagaaggccatgcgcgccgccgactgggcccgaggcgcgcgcctctcccccgccgcctgcgtgcgataacaagcaatatcgctcccgcccggaagcacagcaaaaagcccggcatcttcgcgaggaagataccgggcttttcagctatgcaatcggcgatcagtcgagaccggagagcttgttgatcagctccgggtcacgcgtcgcacccttgtcggccgagcgggcgaaggcggcgtacgccttcagcgcctgggagacgtggcggttgcggtgagccacgtagccgtcgccagcctcaagctcgcgacgacgctcgtccagctgctcgtcagtcagttcgacgttcacggaacgggcttcgatatcgatatcgatgatgtcgccgttcttgataagcgccaccggtcccttattggcagcctcaggcgccatgtggccgatggccagaccggaggaaccgccggagtagcgaccgtcggtgagcatggcgacctgcttgccgatgcccttgcccttgacgaaggaggtcgggtacagcatttcctgcatgcccgggccacccttcgggccttcgtaacgaatcacaagcgccatgccgggcttcagggtgtcgttcagaatgacctcgatggcctgctcctgggagtcgaccaccagagccggtccacggaacttccagatctccggcggaacaccggcggtcttgaccacgcagccgtcgggggccaggttgccgcgcagcacggcgaggccgccttcgtgaatctccgggtggttgatgtcgtggatggcgccgttggcgcggtcacggtcgagcgaatcgaacagggtggtgtgggtccacggctccggggagatgatgtggccaggagcggccttgtacatctgctgggcttcctcggtgcaggtcgggcgcatgatgtcccaatcggccagcttggcttccagcgtcggatagtcgatggagtgcacgttggtgtgcagcttgccggcgcggtcgagctcgccgaggatgccggtgatgccgccggcgcggtgcacgtcggaaatctcccacttgccggacggcgaggccttgcagatgcacggcacggtgtgggaaatacgctcgatgtcgtccagggtgaagtccacgtcggcggactgggccatggcgaggatgtgcagcacggtgttggtggaaccgcccatggccacatccatggtcatggcgttctcgaaggcttccttggtggcgatggagcgcggcagcacggaatcgtcggaatcgtcgtagtactggtgggcgatcttgacgacctgcttggcggcacgctcgaacaggtccttgcggtaggagtgggaggcgaggatggtgccgttgccgggcagggccaggccgatggcctcggtcaggcagttcatcgagttggcggtgaacatgccggcgcaggagccgcaggtcgggcagacggtcttctcatagttgagcagttcctcatcggagacgctgtcgtcggcggtggcgtacatcacgtcgataaggtcggtgctcttgacggtgccgtcggcgagcaccgtggtgccggcctccatcgggccaccggagacgaacacggtcgggatgttgaggcgcagggcggccatcagcatgcccggcacgaccttgtcgcagttcgggatgcagatgagtgcgtcggcacagtgcgcgttgcactggtattcgacggtgtcggcgatgatgtcgcgggagggcagggagtagagcatgccggtgtgacccatggcgatgccgtcgtccacggccatcgtgttgaactcgcgcgggatgccgccagcttccttgatagcctcggaaacgatgcggccgaccttgttgaggtggacgtggccgggcaggaactcatcgaacgagttggcgatggcgatgatgggcttcttgcccatgtcgtctccgttgacgcccgcagcacggtagagggctcgggcgcctgcaaagacgcgccctgacataatttttgcagatcgcatttcagtcatggttctattcaagcccttgtgagggacacgccacttgtcaagagtcgaataatggaatttgcaaaagcgtaacgtttctcacacatatttttggaatacattcctccactggaagtctggcggaggtccggcagaagtcccccaaacggctacacttgcttcggttgagatagattttccaatgtctggagataagaacaatggcttttggtactgacccgacacccgacggtcttgcgaacccgccgatcgacgacctgatgaagcacgccgattccaagtacgcgctggccattttcgccgccaagcgcgcacgccagatcaactcctacttcacgcagctcaacgagggcctgctgcagaacatcggcccgctggtcgaataccagaacaatgagaagcccctgtccatcgccttccgcgaaatcgacgagggcctgcttgaggagaccttgggcgaggacgacgccaacgagggcaactgatcgattccgacaattcgtttggattgtttggacagttcgtcgccgaatgatggtgtgagagttctctcacaactgattttgagcgacacgcttgcctgagttatcgcaatcggctataactcaacatcgggagcgaataagacgcaaggctcgcgccaccgcgctggttggcacgagcctttatttatgcccgcttccacagtgacaagtaaaaattgacaccgtatcattgtgcctcgcatcccgcggggcgataagtcctgaagaaagggatgatatgacagaagaacatcggcttatttccgccgaatccgtgaccgaaggccaccctgacaaggtctgcgatcaaatctccgacgccattcttgatgatttgctggcccaggattcgtccagccatgtggccgtggagacctccgccgccactggcgtgttcctgatcttcggcgaagtcacgtccaaggggtactgcgacgtgcagtccaaggtccgcgaaaccctgcgcaacatcggctacacctcctccgaagtcggccttgacgccgattcctgcggcgtggtcgtggccatcaccgagcagagcgccgaaatcaaccagggcgttgcccgtctgactggcgatcaggagaccgccgccagccgcgaagagcgttacgaagcacagggtgccggcgatcagggcgtgatgtttggctacgccaccgacgagaccccgacgctgatgccgcttccgatctacttggcacatcgcctcgccttccgtctgaccgaggtccgcaagtccggtgaagtgccgcacctgcgcccggacggcaagacccaggtaaccattgagtatgacgataacgataagcccgttcgtctggacaccgtgctgatctccactcagcacgatcctgaggttacgcaggattggcttgctgttgagctgaagaagcacgtgattgacccggtgcttgatgaggtgctgggttccaaggtgccgcatgacaactaccgccagctggtcaacccgaccggttcgttcatcctgggcggcccggcggccgacgccggtctgaccggccgcaagatcatcgtcgacacctacggtggcgccgcccaccacggcggtggcgcgttctccggcaaggacccgtccaaggtcgaccgttctgccgcatacgcgactcgctgggttgccaagaacatcgtggccgccggtctggcccacaaggttgagatccagatcgcctacgctattggtgttgccgacccggtatccgtcaacgtggagaccttcggcaccgagcaaggcgtgacgcgcggccagatcgccgccgccgtacgcaaggtcttcgatctgcgccccgctgcgatcatcgacgagctggatctgaaacgtccgatttatctgaagaccgccgcgtatggtcacttcggccgcacggacgttgagttcccgtgggagaagaccgacaaggtcgaggagctcaaggccgcgattggcgcgcagtagacgttggcgcattcttgcgtcgcaccccgtgcggggtgcgacgcaagaatggactccatgtcccaaaatacgaatactccgcccgtcccacggcatcgattgcacggtacaatccatccgtatcttccccgatacgcaaccgctgaagcgacatgccagcagatcactcactcttgagttatcaaacaacaagaagaacacacaccgtccccaaaaaccataatctgcggcgcaaacgacccagtgcttcatgagagctcagagctcacaccgcacaagacaacttgacagaatacaacgagcatcgcgaacgactgtgccgtgaactgactcaccgccagccagctcaacagcggcgcgattccgccgagcgtcaaggcggtgcgacatggagaatgggacactttaggcacagattcgtaagcaggaatctggctttgctgactgtgcacagcgtgaatagctcttactctgatcacattgctccaatgcatccgtccggctaaatgattatttagccaacttgtgtgaaacgattgccagtagatactgtaatgacagaaattcacgtcttcgagatatctgctatcaggttgctgaccacgtcgattatgacaacgcgaatcaggagacttacgtttcgactgagtcactaatgcagaacaagggcggacggcaactggcgtcttcgctcccagcaacgggcaagattacacggtataaagccggcgacactctgatttctaatattcggccctattttaagaagatatggtacgccccgtttgaaggtacatgttcgggtgatgtcatcgtttttagagcgaatgatcccagcaacgcgccatatctgcatgcatgcctacggcaagactcattctttgactacgtcatgcaaggtgcgaagggaacaaagatgccccgtggggataaaaaacaaatgatggagttcaaggttgccagttcatgcagtacgaaagatttgatcctattagattccgcaataaagcaaagatctgataacgattcagagacagtaaagctccaagcactgcgcgatacgctccttcccaagctcatgtccggcgaaatcgacgtttcgaaggttgacctcacgcagctaacaaataatcatttgccagcgcgtgggcacaatgttcctaactgttattggaaggaacccctatggaaaccatcattaatagtgttctgtcgcagatgcagaacatgcttgatccgtcacagctcaaacatctggccgaagtactcagagtcacgctgctgccaactcaggaaacatcagcgccgcagaatctgctgacgctattcctcacggcaaaagaggtcgaaggctgctcgccgaaaaccatcgcttactatgagagcacactccagcacatgacccaggccctcgccaagccttgtacgcggataaacagcgatgacttgcgcgagtacctcaacagatacgagaacgaacgtcatgcgggcaaggtcaccatcgacaacattcggcgtatcatgtcaagcttcttcgcgtggcttgaggacgaggattatatcgtcaaaagccctgtaaggcgcatccaccgtgtgaagaccgctgtaatggctaaggaagtcctgagcgacgaaaatctggaaactctgcgggaccgatgcggcaccttgcgggatcttgccatcgtggacattctcgcatccacgggtatgcgagtgggtgaactggtcggcttgaacatagccgacgtgaatcttcaggagcgggaatgcttggtcacaggcaagggaaacaagcagcgtcccgtttatttcgacgccagaacgaagcttcatctcaccgcatacctgcaatcacgtaacgacagcaatccagcgctattcgttgctttgaatggcgatggtgaccgtatcagcatcggcggcatcgaaagccgcctcagacagctcggcaaagatgccggcattcatcgagttcatccgcataagttccgtcgtactctggccacgcacgccatcgacaaaggcatgccgatcgaacaggtgcaaaaactgctcgggcatgcgagaatagacacgaccatgcactacgtcatggtcaaccagaacaacgtgaaagcttcacacagaaggtatttggaatgagctggcgagagacgacccttggtgagattaccgacttaaaaagaggatttgatttgccgaaaagccagcgtttgcaaggggatgtgccggtttattcatcatcgggaattaccggatctaatagtactgcagcagtagaggggccctgtgtaatcacagggcgatacggcactatcggagaagttttcttttcgggtggtccatgttggcctctcaacacagctttgtattctaccgaattcaacggcaacaatcctcgatttatttattatcttttgcagacaattccttggcagggatacacaacagctagtgctgtgccaggcgtcaatcgaaatcacgtgaatctctgccctgtcaagatacctgacagggcaacgcaagatgcaatcgtagaagtgcttgattccattgtcgacaaaattgcccttaataatcggctaaatgattatttagagcagcttgtagacggtaagtttcaagagttgtttggtggtcttaatttcaacgctacgctctctgatgttgccgaaataacgatggggcaatcaccagcaggaagttcgtataacgaagaaggtgctggcataatcttctatcaaggaaggggtgaatttggatggcgtttcccaaagcgtcgtctctataccactgagccaaaacgtttagcctgcgagggtgacgtcctaatgagcgttcgtgcgcctgtcggggacctcaacgttgcctttgaaaattgctgtatcggacgtggtctggcagctatccatagcgaaaccccgtcatttgctctgtacttaatgcgattccttaagcctcaacttgaggcttacaacggagagggtactgtattcggctcaatcaacggtaaggctctcaaaagcttagaagttgcgcttccatctcataacgaagtgatgcaattcgagtcatttgcggcaccgatagatgcactaattaggagtaatgaaaacgaaacacggaaattaaataacctaaggaattatcttcttcccaaactcatgtccggcgaaatcgacgtttcgaaggttgacctcacgcagctaacaaataatcatttagctggttgttaagctcgattttcctatcaaacaaactaagaacatttgcaatagcattttgttccgccatcgaaggaagaggcaatttcatggcacaaagattactctggctcagctttggctgcgtagatcctgttacgtaggcagaaatatcagtcatattaagaagatgtctcagaaaaacgagattacacttttcggactcagcaataacatgcgcatgattattcactctgaattttccagaagccgcattcgcaataggattcttgcgactcctaagattttccccatcttcagcaaccagtaggtaatctccctcataggtgtaatcatctagataatcgacaataccttgagctccgtaataaggataggaaccttttctgtcctttctgtccctagaagatatcggctctctcttgacatcttcaagctcgataacatcacctagacgcgtcagctgctcacatgccatagccgatggcctccagattcttcttgatctgctcttgcagacggttggattcctcgaagcatttggcgatctcgccggtcagacgggtcatcttctcctcgaatggctcatcgtcttcttccacttcggcgacaccgacgtaacggcctggagtcaggatgtaatcctgcgccttgatatcttccgtcgtggcgatggcggagaagcccttctccgtttccagagtgccgtcacggaacgcgtcgaacgcagtcgataccttggcgatgtcctcatcggtaaactcgcggagcctgcgggacaccatggttcccatatcgcgcgcgtcgatgaacaacgtcttgccggactgcttcttgttcttggtgatgatccacaagctcacaggtataccggtgctgtagaaaagcttgtccggcattgcgatgatgccctcgaccagatcggcatccacgatcttggcgcggatctcgccctcgttgttcgtctggctggacaacgcgccgttcgccagaaccatgcccatgcggccggaacggttgagatggtggatcatgtgctggacccatgcgaagttggcgttgccctccggtggggtgccgtactgccagcgtacgtcgttctcgagtttctttcctccccagtccttcaggttgaagggcgggttagcgaggatgaaatcgaatttctcggtcttgtgcaggtcctcgaagaacgtgtcggcattatgatcgcccagatccgcgtcgatgccacggatcgcgaggttcatggtcgccattttccacgtggtcggattggactcctggccgtacacggagatgtcgttaatgttgccctgatggcgtttgacgaagtccgcggactgtacgaacatgccgccgctgccacagcacggatcgtacactcgcccgtggtagggttcgatgacttcgaccagcgtcttcacgacgcacgcgggtgtgtagaactcgccggcgttcttgccctccgcttcggcgaatttggccaggcaatattcgtaggtgcgtccgaggatgtcgcggctatcgcccttttcggccatcttcacgttggcgaacaggtccacgacttcgcccagacgtcgcttgtcgagctcctggcgtgcgaagttcttcggcaggatgcccttgagcttgttgttctcggcctcgatctggcgcatggcctcgtcgatggccttgccgatctcgggcgtgtgcgcggccgctgcgatggtcttccagcgggcgctctcgggaacgaagaagatgttctcactcgcgtattcgtcgcggtcctcctcgaagccctctccctcctcaacgagttcctggtatttctggtcgaacttgtcggagatgtacttcaggaagatgaggccgagcacgacgttcttgtattcggaagcgtcgatgttgccgcgcagcttgtcggcagcgctccagatctgttcctcgaagccgatctcggcggtattgtccttcttctttgccatgtcttgtattatcctcctgctcgtcctattcgctgatcttggtgtcggcccacagctcgcactgttccatgacggtcttcatggcgtcctcgacgccttcgggcggatacttgtatttgcgcagcaaacgtttgatggcacgccgcatgccggccctggcgctttccttcttctgccagtcgatcgtggcgttgctccgcatcgcatcggtcaactcgcgggctatcgagacgagctggtcgttgtcgtagaagtccttgaccgcctgcggctgggtgatcgcgtcgtagaacgccatctcctcgtcgctcaagccgagcttctgcgcgtcgtcgcggtccttcatgatctccttggccatgttgacgagctcttcgatgacctgcgcgttcgtgagcatgccgttgagatacgcgttcaacgtgttctggagcatctcgctgaacttctgggatttgaccacgctggtgcgcccgtacgcccgcactttctccttgatgaggcgtttcaggctctcgatcgcgatgttcttctccttcatgccggcgacctcctggaggaacgcctcatcgaacagggagatctccacgctgtccttctcgaacaggttgagcacgccgtccgcatgcacgctctgctggaggatctcgctcacctgcttgttgaactccgtgtacgtcatgccgctgcccccgccggagccacgtccggtcaggcgaaggacctgcacgcgcaatacggataggtaagccgcctcatgcgcgtcctcttcgcttaccatgcttttgcacaggctcagcgcctggttcatgagctggcattgcttgaggaacgattccgtgtcttcgtgccgttccagatcgagcagccagtcggttccctccgcgatggcgtcggcaagcgcctccctgctgttctggaagatgagtttgcggtagttgaagccgtacatgagatcacggcacacgtcgagcttttcgaggaatttcggataggcggtctcggcgatgttcatgtcgccgtaattgtgctggtcacggctggtatagtccttcatcgcccgcttgagcgcgcctgcgatgccgatgtaatccacgaccagaccgccctccttgcccttgcacacgcggttgacgcgggcgatggcctgcatgaggttatggcccttcatcggcttgaacacgtacatggtggacaggctgggcacgtcgaagccggtgagccacatgtccacgacgatggcgatcttgagggaatcggaatcgtccttgaacctgcgttccatctccttcttgtgcgtggtgccgccgcacacgtcgaaccattcctccggatcctggttcgacatggtcatcaccacgccgaccttgtctttccattcggggcgcagctccatgatcctgtagtagatcttcatcgcaatcggccggctgtacgccacgatcagggccttgccggccaggacgtcggcgcggttgttctcgtaatggtccacgatgtcgcggcacaatgcgtcgatggtttcaggagtgtcgaagatggcatcgaggccgccgaggtcatgcttggacttctccacgctcgcctcgtcggcctggtccgcgaactccttgtagaccgcgtcgatgcggcccagcgcgttctcgtcaagatggagcgagaccacacggctttcgtagtagaccggcttggtggactcgtcctcgacggactgggtcatgtcgtacacgtcaatgtagtcgccgaagatctcgcgggtgttgcggtcatccgtggagatcggcgttccggtgaaaccgatataggacgcgttcggcagtgccttgcgcacgacacgggccgcgccgaccgacacatgaccgtccgcgttgatccgttcggtcaggccgtactggccgcggtgagcctcgtccaccatcaccacaacgttgctccggtcgcacaacggctcgtcgccgtccgagaacttctgcatggtcgtgaagatgatgccgttcgcctcacgaccctcaagcagttcctgaagattcctgcggctctcggcctggaccgccttctggcgcaggaacctggcgcagcggctgaattgtccgaaaagctggtcgtcgagatcgttgcggtcggtgatgaccacgatggtcgggctttcaagataacgctgcagcagatgtgcgaagaacaccatcgaaagcgattttccgcttccctgggtgtgccagaacacgccgatcctgccatccccattgacggcctcttccgctctgacgatggctttccgcaccgcgaaatactggtggtatgcggcgatgatcttcacgaccttctcggaggaatcgttgaagcatacgaagttttggatgatgtcgagcagccgttccttcgggagcatgccgtcaatcatggtgctccatgccgcggctttcgttccggaatagtcgccgtccgccgacttccaagccacgtaacggtcctcgtcggatgtgatcgtgccgaccctggtctgggtcatatcgctcatcacgcagaacacgttgggcacgaacatgctcggtatctgcttcatgtactggcgcaattgcaggtacgcgtgtgaagcgtccgtctcctctctcgacggggacttcagctcgaacaacaccaacggcatgccgttcacgaaaatgatgacatcgggacgtttctcggaatactccacgaacgtccactggttcacgacatggaaatcgttgttctcgggatcgtcgaaatcaagcagccggacgatgtcatcacgctcttccttgccgtcaaagaagtgcacttcgactcctgattgcaggtagtcattgaatatctcgttgcgctgctccaagctgccgatctcgacattctgaatcttccggatggcctcctcgacggctgcttccggcagatttctgttgattcgtcgcaacgcatccgggagaatatcaggaaggaatacgtcgcgatacgagtcgtcggtgcggcgaacatcgggcccgtacaggtgctcatatccgagtttctccgttagatgttcgacgatcagattttcgtaccattcctcgttcagtggatccatggacgtgatgttgttcagagaacactccgagaccgtacgagattcgactttggaaacagccattgcttaccccacaaacatatggattctcaagcaaaccacttttcggttagtctatcaaccagcctatcgttcgggtgtaatcaacatggttgtccatggctattttccggcttccatttaatcatgtgagagcgaagaaacgccatattcaaaatctgcatgccgaccgcattgaacagttgaacaaatacctgacgtaaactttatggcataccacggaaaaaaagtggtcccgccgctaaacggcaggaccacttcgtgcatttcacgcgcccgtgcaccacgcatcaggcgcggtcagtccgccacggcatcacgccttggcgacctcaacggccagctcggcaccttccttcacttcgaaggaggtagccagcgtctcatgggcgatcagatccttgaactgctcgaccttggccacatcggcggccggaacggtcagcaccagggagatgcgatcggcgatgtccagaccggtgtccttgcgggcgtcctggatggcgcggatggcgtcgcgggcatagccttcggcgagcagatcggcgtcaagcgccgtgtcgagaatcgcaaagccgccggtcggcagggcggtggacaccgaggaggcggcctccgtggcgttctcctcctccacacggttgatcagctcatactcgccttcgaccagcgcaaggtcgccggacggcgtggagaccaccggcgcaccggacgcagcatcgacatgccagtcgccggacttggacgccttgatggcgaactgcacctgcttgccgaggcgcggacccgccgcgcgggcattcacacgcagctcgtgaacaatcttcagaccgtgggcggaggcgtcctccagagtcgagaactcaatattcttgatattaagttcggccttcagcagctcgtcgtaggctttgacggcgtccacgttctcgaccaccacggtgagcttggaaagcggctggcgcacgcggatcttggcggccttgcgcagggacagggtgccggagacgacctcacgcaccttctccatcgcgtccaccaaggccggatcgtcgaccagcacacggccgagttcggtgtcttcaccggtcttctcgtccaccacgaacggccaatcggccaggtgcacggactcgccaccggtcagaccacgccacacggactcggcttccatcggggccagcggcgcaagcacgcgcatgaacgcctcaagcacggtgtacagcgtgttgaacgcggaagcgtcctcattccagaaacggtcacgggtgttgcggatataccagttggtgagcacgtcgatgaagtcggagaccgcatcgcaggcgtcggagattgcgaactcgttcagcgacttctcggcggccagcaccagacgacgggtacgggccagcaggtagcggtccatctccggcagaccggcgacctcgtccgcgcgcagctggcgggcgtcgaatccggccccgccgttggccgcgttggcgtacaaggtgaagaagtagtaggagctccacaccggcaacatgacctggcgcacggtgtcgcggatgccatcggcggtgacgatcaggttgccgccgcgcagaatcggcgaagacataaggaaccagcgcatggcgtcggaaccgtacttgtcaaacacgccgttcacgtccgggtagttgcgcaagtgcttagacatcttctggccgtcggagccgagcacgatgccgtggcagatcacgttcttgaacgccgggcggtcgaacagggcggtcgccatgacgtgcagcaggtagaaccagccgcgggtctggccgatgtattccacgatgtagtcggccgggaagtgctgctcgaacttctccttgttctcgaacgggtagtggaactgcgcgaacgacatggaaccggactcgaaccagcagtcgagtacatcggaaatacggtgcatgtgcgacttgccggtcgggtcgtccgggttgacgcggaccaggttgtcgatccacggacggtgcatgttgatgttgccgtccttgtcgcgcgggtagtcaccgaagtcggccttgagctcttcgagagaaccgtaaacgtccacacgcgggtacttcggatcgtcactcacccacaccggaatcggggaaccccagaagcggttgcgggagatggaccagtcgcgcgcgttggcgagccacttgccgaactggccgtccttgacgttgcccgggatccagttgatctgctggttcaattccagcagatgcggcttgatcttggtcacggacacgaaccaggaggagaccggcttgtagatcagcggggtggcgcagcgccagcagtgcgggtaggagtgcacgtagctcttctcctggaagaggatcgcgcggcgctcttccgggatggaagcgagcgggccgtcgccggcgcgcaggttgcgcaggatcggcaggttggcgtcgaacacgaaatcgccctcgtagtcggggcactgcgcggtgaagcggcagccatcgtcgagcacgtcggtgctcttgatgcccttggcattcagcgtgttcatatcgtcttcaccgtagggggcctggtgaaccagaccggtaccttcgacggtgtcgacgtagtcggcagtgaagatcgtgtagccgttcgggccgggcacatggccttcggattcggccgtctcgcccgcgaagtacgggaagaccgggtagtagcggcggccttccagctcggagcccttgagttcgcgcacgacctcgtagttctcgccgagttccttctcgtagtgcggcagcaggtccttgccgaggtagaacttcttgccagcgaacttgccttcggtcgggcggacctcgacgtagtcgatgtcggcgccgaccacgatggcgaagttggtgggcacggtccacggggtggtggtccagaagacggcgtaggcgtcgtcttcatcgcgcatcttcacggccacggacacggtggtgtcctggcggtcctggtacacgtcggcgtccatgcgcagctcgtgcgcgctcagcggcgtgcggtccttcgggcagtacggcagcacgcggtagccctggtaggccaggcccttgtcgtagagctgcttgaaggcccacatcacggattccatgtacgggatgttcagggtcttgtagccgtgctcgaagtccacccaacgggcctgacgatgcacgtagttctgccattcgttggtgtacttcagcacggaagcgcggcaggcgtcgttgaacttgtcgatgcccatcttctcgatctggtcgaccgagtcgatgccgagttccttctgcgcctcaagctcggcgggcaggccgtgggtgtcccagccgaacacgcggttgaccttgcggcccttcatggtctggtagcgcgggatcacgtccttggcgtagccggtcagcaggtggccgtagtgcggcagaccgttcgcaaaaggcgggccatcgaagaacacgaattcgttctggctgtggtcgccggaagggttgcgttcaacggacttctggaaggtgtcgtccttgtcccagtagtcgagaacggtctcctccatgtcggggaagctggggttcggcgcgacgtgcgcggtctcgccgccctcgttcgccttgggatatacgttttcgctcaccgtaaatctcctgttagtactgtgcactggtcctacaggagcgtcattgatggcgattgccgggcgccgacgtgtgccggctgggttcacgaatgtcacgtaccgaaccgtggggccgatcgcgtcaatcgcctcgcagccggaactgactgtgttccgcccggaacagccctgtctgccgttcctgcctacgaggacgatgacgggcgctggtatgcgctccgcaccgcggtaccacctcgcttatcgcaccggttgcgccgctccgaactgttgcactcggagccgcgagcctgcgcgaccgcttgtgttcggctgtctcgggccgatcccgtcggttctactgggcgattgccgccgttcttccgaagactccccgctgataacggatcactgcctcacaacggtgcatatcgtaacacgccacgcggtcaaatcgatgggaatgttcatcaggaatgttcattctttctcatttttgtattcatcgcgtgcaccattgtcagcaaacacgctaggctcctttaccggcgatattgcacatctggctcaggggcggctcccgtatgggccggagaaaggattattgaggaatgacgtacgatttcacgtcgattatggacaggcatggcaaggatgcgattgcggtcgatgggttgggaaccgacctaggtttcgctcccgacccaccgagggacggatttgacgtgattccgatgtgggtggcggacatgaatttcccgaccgtgcccacggttccgcaggccattatcgaacgcgcgcaacaccccgtctacgggtacttctcccccaccgacgactattacaactccattatcgactggcaatccacgcgcaatggggttaccggattgaccagcgaggcgatcggctatgagaacggggtcttgggcggcgtgatcagtacgctgaccgcgttcgccgctcctggcgacagcgtgctcctgcacagcccgacctacatcgggttcaccatgtgcatcgagaacaacggctatcgcatcgtccacagcccgctcaagttggacgagcacggcgtatggcgcatggattacgaggatatggataagaagctcaaggagcatcacatccatgtggccgtgttctgcagccctcacaatccttgcgggcgcgtgtgggagcgttgggaaatcgagaaggccatggaagtgtacaaggccaacgattgcgtggtcatttccgacgagatttggtccgatttgactctggggaatcaccagcacatccccacccagtcggtcagcgaggacgcacgcaatagaaccgcggcgttctacgcgcccagcaagaccttcaacctcgccgggctcgtgggcagctaccacattatctataaccccatgctgcgcgaccggatcgtggccaagggctcgaagtcccactataacgagatgaacgtgctttccatgcatgcgcttatcggtgcctacaagcctgaggggcatgagtggctcgacgaactcaaagaggtgctcaccggcaatgtcgactacgcctatgactacatcaccaagcatttccaaggggtgagtttggccaagccggagggcacctacatgctgctgctcgactgcgagcagtggtgtaaggctcatggtttgactttggcggaattggagaagcgcggctgggatgtgggcgtcgattggcaggacggcagcatgttccaggctccctacagcatccgtgtcaaccttgcgttgcccttaagccgcatcaaggaggccatgcgccgccttgaccaatacgtattcaacgcgtaaacggcatgcatccgcgattgcggtgtcctggaaagacgaatgccgccaacgaggtttgtgcccgttggcggcattcgtcatagagaagccgagccaatctaccttcacaactaatcgtcgaggctgtccacaccgagcttctcttccagctcgatgacaatgcgctcgtgcatcttttcgtcgatcttcaccgtgaacatgaagacgagaagactcagcacgatgaaggcaagcgggatgtagaacgcgaaggtctcgaaggtgcgcacgttggcggcggtcatgtcggcggcggtggcggagccgaccataccggcggccacggccacgaagccgacgatgccgttggacagcgcgcccgcgatcttgtcgagcatcggacgcacggagagggttacggcctcgttgcgcttgccggtcttgagctggccgtattcgatggaatcggtcagggagaggatcgcggtcatctggatgaacgtgccaggcaggtagaacagaatcaacgccacgatcaccacgggcaggctggccgaatcgagaatgaacagcacatagccgattgccataagtaccatgccgccgcagaacaggtatcggcgcggtatgcggcggttcagggccgggtagagcggcgccatgaccaagcccgcgatcacggggatcacgccggtgatggcgaaggcatccggcaggttaagcacgaacttgaacagatagaacatcacgccgttggtggccacattcgccactgcatacagcaggtagctcaacgccacccacagcagctggtcattttttacgatagcggcgaacgcctgcagcgggttgccgctctgatctgccctggaacgtaggacgctttcgttttccttggtgccgaacgccacggtccatgcggtcaggatgccgagcaatgcggtgatgatgccgaatgccgtccagcccgactgactttcggcgcgagaaccagtgaacatgaaactgaaagtggtcacgatcggtaccacgacaatggtgctgccgttatagccaatcgaaccggtgaacgtaccgagcgcagtatatacgctgcgttcgtgcgagtcggaggagatggcgggaatcatgccccagtaggagatgtcacgcatcgaatagaacacgtcgaggacgatgaacaccacgacgaacagcacgatgaaccaagtctggttcacgttgaccagcccgaacagaccggtgtagaccatgacgagcagcacggcggagaccaagccgccgatgaactgccacgggcggaaccggccgaagcgggtgttggtgttgtccaccaagttacccagtaacgggtcaaggaagatctctgcgatacggattatcacgataaggcttgtgatcagtgcgatgagtttggtggccaaggctttctcgacattgacgaacagcacgctggtcacgtaaacgacgaaataggtgctcagcgcgttatagaacgccgactggcctagattaccgaaagcataggcggcacggcgcctcagagtctctgctttggtaggacgatttatctggccggattcatctccggccggattcggtgattgggattcgctctccggtgactgcgaaacggacattgacattttctccttagagtcattctcggtgaggtcttctccgacctcgttggagagtgtacatcattaccaagatttaataaatcttttcactaattattgtcaatagaaccaatctcaaaaccaacgtcgcagcactcgcaaaaatcgcataattccaacgaatacacacctctatcaccatatgaattatcgacagcgcgacacaccgccacagaaaatacctccagcaacttgcaatctgcaccatcaggttttaccataatcagtaaagagttttaccctctgaatcgacaacgtggttatcaactcaaggaaagcggttatgcagcatcccatccccaccaccatcgcatcatctgattggctcaccgatccgaccgtattcgccgtcaaccgcgaaccagcccattccgaccatcgcttctacgatcacgtaccgcagccgaacgaaacgatgagcctcaagcaaaaccttgacggcttgtggaatgtcgccgtgacgaccgccccggttttcggcttccccatgaacgattccggcaacgctgaatctccggatttcaccgcaaccgattatgacgacaccggtttcagccgcatcgccgttccctcaacactggaaaccaagggcttgctgaaccataagtacgtcaacgtgcagtacccctgggatggccacagcgaccccaaggctcccaacatccccactgatagtcacgtagccatttaccgccgcactttcgagacaagcacccccgtctccgccgccatcgaaaacaagcgccgcatcacgctgaccttccacggcgcctccaccgccatctacgtctggctcaacggctccttcgtcggctacgccgaggactcctacacacccagcgaattcgacgtcaccgaggcactgatttccggaaccaatacactggccgtggcctgctatgaatacgccaccgcaagttggctggaagatcaggacttttggcgcatgcacggtctgttccgctccgttgaactcaccgcgcaacccactgtgcacatcgaagacctgcacatcaccgccgatttcgaggcgaccacccatgccggcaccatcgacgcccatgccgtgatccgcaacatcgccggcgccaagcagctcagcgccgcactcatggatgccaacggcacgccggtctggcaggattcctatgccatgtccgacatcgtcgacacctccggcgtaccctgctgcggcaccgcagacaccgcgatcgacagcaccgccgtgcaattccgcgcgaatctgtccaacattcgtccatggagcgccgaaaagccccacttgtacacgctgacgcttaccgtgcgcgcagcagacaacagcatcatcgaagtggtgccgcaacgtctcggcttccgccatttcgaaatcgttgacggcattatgcggctcaacggcaagcgcatcatcttccgcggcgccaaccgccacgagttcgacgcgcgtttgggccgtgccatcaccgagcaggagatgctcaccgacatcatcacctgcaagcgcaacaatatcaacgctattcgcacctcccactacccgaatcagacgagattctacgaactgtgcgatgaatacggcctgtacctgatcgacgagacgaaccttgagacccacggcagctggaccattcccggtgatgtggagacccctgaaaccgccattccgggcagcaatcccatctgggaaggcccttgcgtggaccgtatcgccagcatgatcgggcgcgaccgcaatcatccgagcgtactgatctggtctctgggtaacgaatcgtacgcaggcgaggtgttccgcgcgatgtaccgcttcgctcacgcggccgactccacgcgacccgtgcattacgaaggcgtggtgcatgaccgcccctttgacgacgtgaccgacatcgagacccgcatgtatgccaagcccgcggaaatcgaggaatatctgaccaatgatccgaagaagccctatatctcctgcgaatatatgcacgccatgggcaattcggtcggcggcatgcatctgtacaccgagctggagcgttatccgcattatcagggcggctttatctgggacttcatcgatcaggccctgtggcagcagctggacgacggcaccgaacgcctgacctacggtggcgactgggacgatcgtccctgcgactatgagttcgccggcgacggcctagtcttcgccgaccactctccctcaccgaagctgcaagaggtcaagcgtctgtacgctcccgtggtactgaccgtaagcgaccacgatgtgaccatcgaaaaccgcaatctgttcgtctccaccattgatttcgcgttcacggcgaaactgctggcggacggcaatgccatctggcaggccgactaccgctttgatgtgcccgccggcgagacccgcaccttcccgattgacttcccgtcggtggacgccgctggcgaaatcacctatgaggtcgatcagtcgctggcaacggcaacaccgtgggcaccagccggctatgaactggcgttcggccaacacaccgttcagtcagtcgtgccggcttccgccggaaccgattcgaccgcgtgcggcgcggttccctccacggctgattccgatacttccgataccggtacagtaacggttggccgctggaacatcggcgtggtcagcggtgacggacgtaccgaagcgttgctttcacgcacgcagggcggcatggtgtcattcaagcgtgacggtcgcgaaatggtgttgcgccgtccggcgatcacctgcttccgcccgctgaccgacaatgatcgcggcaatggcagcggcttcgaccgcgtgcgctggttcggtgccggccgttatgcacgtatagcgaatcagcagttctcgcaaaccgagactggtgtcatcgccgaatacacatatacgttggccgagccgggcgaaacccaagttgccgtgcgctatgaggtggatgccgccagcggacgtgtacatctggccgcccgatatgccggtgccaccgatgcgccgacgctgccggcattcggattggaatggacacttcccaagcagtacgagaacctgcgcttctacggccttggccccgaggagacctatcgcgaccgtctgcacggtggcaagctcggcattttcgagcgcaccgcggccgaagacaatgcaccgtatctggtgccgcaggagaccggcaaccatgaagacttgcgttgggccgaagtgcttgacgcccaaggacacggcatgcgtatcagccaggccggcagcgaacatttcgcggcgagcctgttgccgtacagctcgctcatgctggaagaggcgacccaccagaacgagttgccgccggtccgtcacacgttcctgcgcctgttggccgcgcaaatgggcgtgggcggagacgattcatggggcgcgcccgtccatgagcagtaccagctgcccgccgatcgcgcctacacgctcgacgtgaatctggaactgttctaacagcgataaagaagctccctccacagagggagcttctttatcgcacagagggagcttctttatcgtgctggtacgaaactgtcacgcactactagggtggtggagatgaaggtgtggtggtgcagcgtgcgccgactggagatggcctcggcaagcatcgtaatcgcagtatcggccatctcattctgatcgatatcgtaactggtcaatgtcggcgaagtgtactgggcgatggcctggttattgatactgatcacactggtatcgcgaggcaccagcactcccgcagcggtaaacgcctgcagtacgccgactgcaatcgtgtccgcagccacgatgaacgcatccggcatgtcatctcgatgatcgttagccgctttctcccctagagtgcgcccggtgtccacagtgaacgcgccttgcgcgtaaatcaggccttccgcatccagccccaaacgctcggtccaattgcggaatgcggttaatcggctgtcttccgggtattcgtgcaaacccatcgtgaagccagtaccgccgatatagccgatgcgtcgtttgcccgaggacaccaacacatccaatgcgtccaaaatggtttggcttaaatccggttgcaccgaatcgaacaggccgggcgcaggattgatgtcgatgaatacgccataaggcaataccagatggagtttcaacagttcatccgaagaaggtacggacggtccgatggaaatgaagccgtcgaaatcaccggcgttggcaatcagatcgtcgatatgggaaaacgacgtgagttccatgtgctgggctctggcattgtcgccgagcacggaccgcagttcatcgaaataggcgtccgccagttcttcctcgcgggtggcgttgtcgagtacggccacacggcgtggcaatacgatacggcgtgatccggtagcgtagccaagctgctcgctgacctcgatgatgcgacgtcgcgtctcctctttgacagacaatgtcgggtccccattgagcagccgggataccgtggcctgcgagaaacctgattcctgcgcgatttccttcatcgtgaccatagttgagccttccacgcctcagtacgtaacaatacgcagtatttcagtaaataactttactacatagtgtaactcacgtcatgcgggtatgacgccgtatggttgcagcatcgtcgatccgcagcgctgatgagaacgtgcatgtttcaggccctccgataattatcgggcaggcgggaatccccagaccgtggagtcaatgcgctggattttcccggacttgtcaaagacaacggtgatgtccggcgcagtaaaactgccggtcgaatccccgaatcggtacggatcactccagtcgataacggcatgcatcgtcacggtccgagttttcgcgtcataggactcattcgagtactcgatactgttatgcgtggccgtagtcccgcccagaccgccgccattgccttgatgcatttgctgacaatacttcgtaaaatccgcgccgagaacattcgacactgcatagcgcctaaatgaacgtgttaggtctgcatccaattcacggcctgcaagactctgcactcagcaattacttcgcaccaaaccgctcacgaatctgagcggcagtaccataagaggcttgcgcaccgaccccagtcgcggcgtacgcggaaacgtacgaggccaactgcgcgctgtccgccaacgcatgacccgaggcaagtccggccagaaccgtgcccataaaggcatctccgcacccggtagtgtcgatggccgcaaccgcaactggcgcaatacgatagatatcatcaccatcgatgaccaccgacccatccccgccaagcgtaattaccgcctgattaaagccgaagtcatgcatctgccgcgccacatcagaccagtccagtccatcccaatcgtcatcgtcaggctcggcgatgtccagcagctgtgccatttcatgttcattgaccagcagaatgtccgaagcctcgataagttcagcgggtagttcagcaacgaatggcgaatcgttgagcaataccttgagcccggcatcatggcagaggcgagcgcatgccgtgaccgtttccatcggactctccaaacacagtcccagcacatcggcggcaaccaatgcgtcagatgactggcgcacatagtcgacagacacctcaccattggaaccagccgaatatacgatggtgttctcaccattcgcgtccacggtaattaccgtagtgccactgggacctgcaacggcagcgatatgcgaagtatccacaccagcatcgcgcaaatgctccagcagaaaatccgcattggcatcttccccgactgcaccaaacatccgcacctgcgctccaattcgcgcagccgccgacgcctgattcgctgatttgcctcccggcaataaggtcagcgggccaccgttgacggtctctcccggtttcggcaaccgctcagtaacgaccgtgtaatcaacattcattgatccgaccacggacacactgccgtgcaggtggtcgagcaagtcaagacatgatgctgacatgatgcatttcctttcggccttcttgtttggcctgtcttctatgttctgcgcttgttctacgtttcagcaaaatcacgatggaaacacaatcgtgcgggtatgcaaatgcccggagtctgaagtcaaatcccgggcattgcacgtattcggggccaaatcgtctgcgcgattgatatgttctgctgacgactgacgcctagcggattgtgatggttatatcagcatcacgcacccatcggcaggaagattgccatggacaggatgaacatgacgattacgccagcgatcatcggcacactggtacggcgcacaatgtcgattgggctcttcttgatggagccggcgacgatcatcaccacagcggagaccggcgagacagcgcgcagcagattgccagcgagacccatcgggatggacacagcgagcacattgataccagcagcagcggccagcggaaccatgagcggaaccatcgcgaagaacagtgcggtaccggaaccggagagtagcacgatgagcgcagtgaggccgacaaggataagcggcagcacgaagcccataccagagccggacaggccggtcattgcgttctgcagttcggtgatcagaccaatggacttaagaccaatgacgaacacagaagcagcgaccaacagtgccacaatcggcattgcgccacccatgcccttgaagaaggactcggtgccagcgagggtttccttgcccttgcgagtgcggatgagctcgcagataatggcgatcacgaaggagagaatggaagcgagttcaacactcaggtcgatctttgcgccggtggtggaagtgatggcgaacacgatgagaagcatgatgatcggcagcagcggcaaaatcgcatacacagtgcggtagagagcgctaccttcgacagccttaacctcagccaggtcaacatcaccgtcggtcaaatccgagccagcgcgcttgtccatgaacttctgccagaagtagtgtgccagtgccatgacgagcaaggtcgggatggaaacgagcacgtgataacggaagacgtaatcgctggcggtcaggccggagaacatgtcggtcttagcgagttcagcggcgatggcaacattgtcggagccaagcggggtcggcataatcgttgcagtagtggcaatgactgcagctgcgctcagcaggctcataccagcttggcgaagcaccgggtacagcgttgccataaggatgatagccaggttggaagcactcggaatgaccagagacaacaggttgcccaacaagaaggtaatcggcacgagtatatacggggacttgatgtgcgcaatcggcttggcgagcacacttaccgtgacttcattggctccgatatgggacatgtagccggtgtagccaccaaggatgaggatgatgaagccagcagaagtgagcgtgctcacgaactgatcgcctacaaccttgaacggatcaagccaagtgacaccactggaaacgaagtcggtgaatgagatgtccttgcccatcagcaatgcgatgtacatcagcacaatgccgatgaggaacagggaaatcttgatgtccattttcttcacgagcataaagcccacaatgccaaccgcggcaattgccacgaggtacataatcaccagttccatcggtctggtcctttctttgttctcttattctctgttgttgaattcacgaatactgatgcgctcaggggcgccggtgttagcggcgtcgaagagacaagggactatgcacaatgggcgatgccgtccatgaaccagtcgcagaatcgatctgcgtgaacgccggtggtgacggtggcattcggttcgcgcttaaggtagcccttaagatcaacgaccgtacaccctgcagtgagttcgccagcgatttctacgtccacaaatgccttagtcatgtcgaataggtcaggctccagcaagcatgcgactgcgcaagcgtcatacattttgagaccggtgccgaagctgcgcttgcggtagcgctggaacaggtcatgagccatcagaccgaccttgcccatatccttaagctgagcggttttctccggcggaatcacagttcccaagccggcgtccagtgtggccatagtaatgtcaagaccagaagtgagcacaatcttggcggcttcagggtcaacgaaaatattgaattcggccataacacccttgttgccgcgagtgaccgaaccacccatgagcacaatgcgctcaatacgcgacttgacttccggaaaagtttttagcaacagtgcgatgttggtcagcggaccgattggcatgacggtgacgggttcagcagaagccatgatctcgtcgcgcattgcttcgacagcatgcttatccagcagaagttcagttttgggctcagggaaatcgaatccctccataccggttttaccgtggatatcgcttgcatcatcaagctgacggatcagcggttcagcagcgccacgagcgaccggtacatccttaccgtagtaggccatcagcttgagcgcgttcgtcgttgtcgcttcaatgctgacattgccagcaaccgtagtaatcagccgcacgtcgaagcgcgggttgaacactgccagtgcgatggcgacggcgtcatcgatgccggggtcagtgtcgataatcagagggatctgcttcattgcttgttcggttcctttcgtggtgtgttgatatacgtgttatgcgtagtgctcggcgagccgattacttgattccgcttgtggcggtggattcagctgcgctgagcggaacgggatcaacgaattggactaatccgctgccataacccggtgccggccggcgcaggaacccatgctcttcgtagaacgattccttgccaggtgttgccatcaggccaatgtacgcatggttgcagcagtgttctcgaatgcgtgtgataagtgcgcgcagcaccgccgtaccgactccacccccttggtattgcggtaataccacgagatctttgatgaagaatgcgatacgtccatcgccgaccacacgaccaattccggccacctgaccatcaacgtaggcaaccacggaatacagcccaccatccagcgccatacgcgcgtcttcgcggtcgtaatggtagaaacccacagcgtcgcgaacgctgacgtacagttcggctgtcagcgcgtcttgctgaatcgatatgcacattgcccgctcacctcctctgtgagtttcctccaaaccgatcatcgttgatcatcgccattgataaaacgtttaatcaactaatgaaaattatgatataaccttttaccaatgctgtcaacgatgtcggcacgtcagcactgttcagcgcataaacccagccttcatgcacctgataaacgctgcaatatcagggcacacgccacataggagccccaaccgaatcacgcagtacaaacgatgacgggacatagcgcgattcaccacgactgcaatcattatttataatcatgtcgagcaacatatccacgccctggcgacccatatcctcagcttgctgcgaaataatcgcgacttgcggagtcagcagacggaatacggcaatgtcatcgaatgaaatcactgacatttcactaccaatatcaatgccgcggtcatgcagcaaaccaatcatcgtgatcatgtcaggcgagtaagcgcaaataatcgccgtaacatctgctcttacaagttcatttagtcctgcttcgcgcgaaacatatgtagaatcacagtcgacaaccgccgcagttccctcccccaactgcgtcacctgtgccacagcagaacggaatgccgcttcacgctcatttatattggacgagcccagtgacgagtgtgacacaaatccaatgtgacgatgccctaagcgcacaagttcggcaaccgcctcgcaaacacctgggtatgggtcggacactacgaatggcaccgaatttactcccgataccaaacgatccacgaacaccagtggtagctcgcgcgcgataagcgactgcataccaggcgaattgacaccttgcggcaccacgattgccccgtcaatacgttgcccaagcagattgtcaataaacgcatcctggcgttccactgtttctgctgaagtaccaatcagcgtggaatagccctgggcatacaactcgtcttccattgacgagactaaatcagcgaaatacggattgcgcaaatcaggaaccagcaggccaacagtcttagtatccgacgagcgcatggaacgagcacgttgatcgggcacataccccatttcctcaacagttttcagcaccaactgtcgcgtatcactagaaaagcggcctttattgtgaagtatctgggaaacagtagcagccgatacaccggcacgttgagcaacatccttcaacgtcacgaacgccatagtcccctccttgcggccgatacatcgtcaaagcaacaattcaaatgtacccttttcaccgccaatattcgcaatcctgcgccaacacacggctctcaacatagaaaaccgcaccccaaccaccggatgagaattgcttcaacccgataatcgaggtgcggtttttgcaggcgtaccggctactccagctccaccgcgccggtgtacagctggtagtactcgcccttttgcgcgatcagctcgtcatgcgaaccacgctcgatgatgttgccgtggtcgagcaccatgatcacatcggaattgcgcacggtggacaggcggtgggcgatgacgaagaccgtacggcccttcatcaggttatccataccagcttgcacaacctcttcagtacgcgtatcaatcgaggacgtggcctcgtcaaggatcagcgcaggcggatcggccaccgccgcgcgagcgatggagatcagctggcgctggccctgggacaggccggaaccgtcgccttcgagcaccgtgttgtatcccccgggcagcatgcggatgaagctgtccgcattgaccagacgcgcggcctcgatgcattcctcatcggtggcgttcaggcggccgtaacggatgttgtccatcacggtgccggtgaacaggttcacgtcctgcagcacgatgcccaaagacctgcgcaggtcaggcttcttgatgccggccacggagataccatcatacagaatctggccttcctgaatgtcgtagaaccggttgatgaggttggtcacggtggtcttgccggcaccggtggcgccgacgagcgcgatcttctggccgggcttggcgaaccaggtgatgccgtgcagcaccggcttgtccgggttgtagccgaaggtcacgttggtgaagcgcacgtcgccgcgcagcagggtcagtcggccgtcgggcgaggtgatcgcctgctccttggccttcatcgccacctcgcgggccgagcccttgagcttttctgcggccttcagagacctcgtaccgtcgtcgccgacctcgcgcttccatgcccagtggccggtctcgtggtcgacttcggtcatggtgcggccatcctcgccaagttccacgttcacgagcgtcacggtgcccttgtcttcctcgatgggctcatccatcagcttgaagatacgggaggcaccggcgagcgccatcatcaccatggtcagctgctgagagacctgaccgatcgggttgatgaacgagcgggacagggtcagcagggagacgagcgtgccgagggtgagcggcttgacgccggtcagaccgatgtcgttgacgccggccagcgagacggcggcgccgacgatggcaagcaggatgtagagcaggtagcccatgttgccgacgaccggcatggtgacgttgccccaggtgttcgcttcggcggacgcctcgaagagttcctcgttcttctcgtcgaaggtcttctgggtggcgtcttcatggttgaagaccttgatgaccttctggccgttgacggattcctccacgaaggcgttcacgtcgccgatccactgctgctgcttgacaaagtagcggccggagcggctcacgatcttgcgcacgatgaagtagagcagaacggtgaacacgattacgaacgcggtgaatggaatggacagccacagcatggacagcagcgccgcgaccgcggagataatcgaggagaacatctgcgggaacgactgcgagatggcctggcgcagcgtatcggtgtcgttggtgtagtggctcatgatgtcgccgtgctcgtggctgtcgaagtagcggatcggcagcttctgctggtgggcgaacatgtcgtcacgaatcttcttgagcgtgccctgctcgacggtgacgatcagccactgccacagccaggacgccacgatgccggccacatacaggcccgccatcaggctgatggcccgcagcagcggggcccagtcggagttcgactcccccaccatcggcaggatgtacgtgtcgatgagcgactggaggaacagcgcggaaccggcctgcgcggcggcaccgaccaagatgcacaccacgatggcgatgacacgccacttgtactggaagatgtagctgaagatgcgcttgatggtgccaggctcggctttgcccatggcgggcttgcggttcttgaaactctggtcgctgctcatcgtgcttctccttccttggtatcggctgcattggcatcagctgcgctggtatcggccgtgggcatggtcactgtcaccgtcacggtttcggacggctcagcggtagatgactcagcagcctgttcggcagcggccagttcttcgggctgggcctggttcttggtctgggattcgtagatggaacggtattcatcgcaggtggcgagcagttcgtcgtgtgtgccggacgccatgatgcggccggaatccatcaccagaatcatgtcggattcctgcacggaggccacgcgctgggcgatgatgatcttcgtggtgtccagaatctcgttgtggaacgcggaacggatcagcttgtccgtcttggtatcgacggcgctggtcgaatcgtcgagaatcagaatcttcggcttcttcagcagcgcacgggcgatgcacaggcgctggcgctgtccgccggacacattggtaccgccctgctcgatgtacgtgtcgtacttatcggggaattcctgaacgaatccatcggcctgcgcgagctgcgcagcatggcgaatctcttcatcggtggcgttcgggttgccccacctgaggttttcggcaatagtgccggagaacagcacgttcttctgcaacaccatggccacctgatcgcgcagcgcctcgagatcgtagtcgcgtacatccacgccgccgaccttcagcgaaccggagctcacgtcgtacagtcgcggcacgagctgtaccagagacgactttgccgaaccagtaccgccgacaatgccgacggtcatgccggagcggatcttcaggttgatgtcgtcaagcacgggcttttcggaactgtcggagtagcggaaggtgacatggtcgaattcgatggagccgtcggccatgtcagtcaccggctgtgccgggttctgcaccgtgctttcctcctgcagcacctggcagatacgctcggcagaagcctgagaaataatcaccatgacgaagatcatggacagcatcatcatggccataaggatctgcatggcgtaggtgaccagtgcggtcaggtcgccggtggtcaggcccacggcggggttgttgccggaggcgacgatctgctgcgcgcccatccatgcgatgaggatcatcgaaccgtagatgcagatcatcatcagcgggctgttgaagctcatgatgcgctcagccttggtgaagtccttgaagatgcgctgggagatgcggccgaacttggagacctcgaaggattcgcggttataggacttgaccacgcggatgccctgcaggttctcgtcgaccacgttgttcaacgcatcgtaggtgtgaaacacgcgctcgaacaccggatgcacgagcacggccagaccgcacaggccgatggccagaatcgggatgcaggccaggaacaccatggaaatcgacggggagatacggaacgagaacagccaggatacgaccaccataatcggggcacgcacgcccagacgaatgatcatcatgtaggcgttctgcaggttcgtcacgtcggtggtcagtcgggtcacgatcgaaccggtggagaaccggtcaatattggtgaagctgaagccctgcaccttctcgaactggtccttgcgcaggttcttggcgaagcccgcgccggccacggccgcgtactttccggacaggaagccggcacccagcgaaaccatcgcgcacaccagcagaatcacgccgaacttgacggtggccggcatgctgccaccggtgataccctcatcgatcagcgaagccatgatggtcggaatcaggatttccagaataccttcgaccgccacgaacaccggagccaggatgctggctttcttgtattcacgaatcgaatggcccagcgtgcgcagtacatgtttgggcttgtccggttcgacggctttgcgcgcctgcgcgattgcctctgcggtatcactcattcgttctcctccttcgtgttagcaacctccgctccgtcttgatcgggagccatcaccacaggtgactgagggagtgtttgatgttcaaattcatgttgtgcgcggtcgatgttcgcgcgcatgcgactgacgtagtcacgtagggctgctttctcgctttcggaaaagccatcaaccaacagacgttcgacgcgttcgccgttcgctttgagatcggcgacgatggcgtccgccttatcggtcaggacgatacgcttgcaacgggcatcatgcgccaccgattcgcgggcaataagccctttcttttccataagcgccagcacgcgcgaagcggtggagcgggtgatacagaacttctgttcgatggtgtgctggtagatttcacgattccggttacgagccaggaacatgatgatatgcgcgttgccgccagtggtctccttagcggaaagcggcatgctctcaccgagatagcggtcgacggctttggtcaccgctcgcatctcaatgctgagaatatgctgatccattgtcctccgtaccatgcgaggccatgcgcgtatgcgccttcaccccacattgttgcatacgcaacaattcatgataaagagacccatatacaacagttgcatatacaacaatcggtgtgttgcctagacaacgaatcccacatatgccctatacacaaactggctcccttctctgaatctcagaaaagggagctggcagtttgcgtagtattacttgctcagcttggcgtactcgtcaaccatgaactgggcgatcttcttgccgccttcgcccaacagggtgggcagcgagttgatgggcatggagttgaggaacatgcgcatcatcgcattatccggaagcttcggcagctcgccggcctcgccggcggcggccacggcggccacgatcttggcgccgaacggatcggcctcccactcgccgtaggtggaccattcggtgagcggctgggtcttgccatcgccatcgagggccacggcaacggtgtcggcaatgtcgcgggagctcacgcccacttcgatggcatattcgccagactccacatgccagtcgttatacttttcggaccagtaggcgaacgcgcgctcgtcgaggtcgatggtcacggtcttggactcaccggacttgaggaacaccttggtaaagcccttaagctcgtgcttcgggcgagccacgtcagccttgcccggtgcaacgtacacctgcacggtttcggaggcatccacatcggaggtgttggtcacggtggcggtcacggtggcggtgttcgcgccggtcttggcaacggcgacgtcagcgatctcgaacgtggcatagctcaggccgtagccgaacgggtagtccacaaccttgccgtaggtgtcgtagtagcggtagccgacgaacacgccctcgccgtagtcgacgtggccttcctcgcccggccagttcagcatgctcgggtcatcgttgatgtccagcggaatcgactgggcgagcttgccggacgggctgacctggccgaagatcacatcggcgagcgccgggccaccggactggccgagcaaccaggattcgaggatgcccttggcgttcttggcccacggggccacggagaccacggagccgttggacagcacgaccacgacgttctggttcgcggcggcgacctgttcgagcagggcgatctgcttggcgggcatgtcgagggtgtcgcggtcgaagccctcggattccgcggcttccggcaggcccaggaacatgaggacaacgtcggcgttcttggcggtttccacggcctcggattcgagggccgggtcggccggttccagatcgagcgtgaagccgggggcgaagtcggccttgatgccgcgctcggcgagcgtgtcgaggaagctggtcatcttggtggggtgatgtgggaggagccgccgccctggtagcgcggggtgcgggcgaattcgccgataacggcgatcttctggggcgtggcggacggattggcgactgggtcggcgttcagcggcagaatcgcatcgtcgttcttgagcatcacaatggattcaatagcggcctgatgggcgacttcatcgtgggcgtccacatcgaaacggtaattatcgatgctcattgcagcgcgggtcttgtttaccaagtcaatcatgccctgagccatacgatcgagctgggcggggatgattaggccgtcgcggacggcgtagacaatctggtcgtcggtgtagctcggcggcatttccagattcaggcctgcattcagggaggccccacggtcatgatcggcgccccagaggactcactcgcttaggtgagattctgcgtcccctaagcaaatcctcatagagctttctaggaggaagacgacatcgcttggaatcatccagataataatccaagccacatagatgagcgaaatttcccgagtcccaaacaatggcaagagtcagatcatcttcacagtgattttttattgaacggccttcaagtcgctcatgatacaggagagccgcagcatgggcttgcgccaatgcatactcctttgtcttcgttatattcacggctccccctttgccgaaaaataagggagggacatctgagccagatgtccctcctgagatgaaaagccatgttttacagtcttctgcatgactatcatccactactttcgaagtggaatcggtagtggcttcggttggcccaaccgtatcacccagccactgggctaggcaccctgctttcgcggtattcgtccgcgcggacgaatcaagtgccagcggcggctgacttctcatctcgaacccgcaacccaccccgccgcaaaggataggccgggtcacgaagctcactctctaccttacacaattggctcgaatcatgccaccagagagcgatttcgttctcattacaccatccaaccggcgtgccagacgtgagtgagatcccaagggtcgaggcgtgacgtgtcggattgcgggtcgatggtaggcaagaaatcacgattaccacgtaattggtagctccaatagatttgcccggcggacacgttccatgccttgcgttgcatggcggcgatctcgcggtaaatagagcctctgatagatgcactgtgcatggcgttttccttggagcggccaccatcgcctgtacgcttatcgaccacccgatttaccagaccattagccacgcaccactcccctacaatcaccggcgtatagcgcgcggcccggcggatgcggcgttcgttccagcgcacgaacaagcgataccagcccatcagccaccgatccgggatcagacggaacagcgggaattgctcggccatgaccagatagacatgcgtatcgagcatgacgccccgcatgccctcgcgcacgaaccagtcccgccaacggcccagtcggaagccgtcatggaacacgatgacttgattccctgccagaatcgggcgcaaccggtggtatgtctcgcggtagaaacgcttgaggaacgccatcggaataggcccgcttcctcgcgcttcggaccggtctttcgcctgcctgctcgatggtgacatggcatacgtcagccagtcaatcggctcattcagcacttcgataccgaacagcgccgcgtggtcgcgataccggcgagccagacggaccagcacatccagcgcataggcgaccgctcgcgggctacgatgccagcgcaccacgccggtgaggccgccgttatcgaatccgttctgcgagccgggcaccgtgtgcaggtcgataagaatcttgagcccggtccgctcggcccagtcgaacgctctgtccagatactcggtacagcccgggtgaccgggcacatccccgaacacgaaatacggcactggaatacgcaccagattgcagccatgtgcggcaatgttccgaaaatcggcctcggtaatatacgtgtcgcgatgccgcgtcagcaaagcctccagctcagccgacttcgtagcccgatgcagccagatctcgtccgcctcgccgctggcggcaaaaatccccggcttcatccaccgctccagcaccagccaattgccgaggttcaccccattaattcgttcgccaacacccagcgcgcccgatgccatacctgtcacgctaatcgttcaatgcttcaccgtagcgagcgaccaacccctgatttgcacgctcaaactcggggatgtaatcagcgatgatggcgtccacaagacgccgagctcgttcttcatcatagatatgagcagaatcattgcgatcgcgcagcatgcgcagccacaacgattcgtccatgaaatcatagtattgaaaagcggttttgagcacatctcgcggagagccggaagcggaaacagggtctccctcataagccagcagcgccttgaacagtttccaaccaagctcgaactgcaacccgaacttgtcaataatgccgctctggatgaaatcattgccgagatcctgttcgggagccttgcgcagcgaattcaatgcggaaacgtaattctcatactttttcatacagcacctttccgctacgctcaatctccgccctcagcgatgaagaaatcggctcatccagattgatgacatcaactttaagcagtgaccacagattgtcctgaaggttctgctccaagcgattgaaatcgggacaaccggccacggcaagatcgatatcgcttttaggccggttcacgccctttgcgcgagaaccgaacagcacgaccttgcgagcgccggcatcagcggcaaacgcgcgaatctggtcgtacacgtgctcgataggaaccatgacacctcccgccgcatccaacagtcccggaccaatcccggaccacccgcgcttccatcatacggccgcggcccactcaccgcacggagcccgaaccacccgaacgcggcgacgtagttgcgggaggcgggctggcgctgtagggtgtgcgggaagttcctgacgtctacttttcaggaggtgaatcctcatgttcaccacgttttctctggccatcattctcgactgcaccgtacgcattgtgctcggcacggcattgggcgcgctgatagggctcgaacgccagttgcgcgcccgaagtgctcggcgtgcgctgggatgtggagcacatcaccacgtccgactgacgctgaccagcaacatcgcaacagtacaacaagccaacaagtgggatggggcatcgagcctcatcccactttgttattatccggcgattgtcagactcactcacgccacggtgaacgtggtgcgcttcaggtcctcacggcgcgaggagtggccgatgagcagttcgaattcgccgggctcgacgatgcggttggcgtccgggtccacgatcgtgcagttcgccaccgggatctcgaagatgacggtcttggtctcgccgggttccagtgcgacgcgctggaacgccttcaattcgcggtcggtccagctgtaggaggtcacgatgtcgccgatgtaggcctgcatgatctccacgccggcgcgctcgccggtgttggtgagggtgatttcggcacgtacggtgtcggtttcggcgaatgtgccgtcggcgttgcttgcgccgcccgtaatggtcggttcgccgtatgcgaacgtcgtgtagctcaggccttcgccgaacgcgaacgccggatcctgggtgaggtcggcgtaccggtcgccgtgctggccgcgaatctggttgtagtagaccggcagctggcccgcgtggcgcgggaaggtgatcggcagtcggcccgacgggctggtcaggcccaggattatttcggcgatggcctgaccgccgcgcatgcccgggttcggcgcccacaggatggagccggtgccggtttcagggtcgctgacgcgcttggcgaatacactggactcgcccacgatggaggcgggcaacacctgcggcttggagctgatgagcacggtgaccatcggcttgccggtttcgcgcgagacggcggcgagcgcgtcgagcagggcgttctggccaccgagcagttcgagcgtggcggtggagcaggtttcgccgaccagctggaccacgtcgccgaccacggccacgatcagatcggactggcgggcgttggccacggcttcgtcgatcattgctcgatcgacggcggcggaaacgccgattttcgggcgaggctggccgtccgggtagaactcgccggcagggtcaggcacgaggtcgatgacgttcgcgccgcgcgagtagaccacttcgcaatcgtcggaggcgagctgggtcaggccgtcgagcacggtggtaatcatgcctcgaggctggccatccggcatccaggagacctgaccggagttgccggtccagtcgccgagctggttctgggcgtcgtcggcaagcgggcctaccacagcgatgcgcttggccttgtttgcggcgaacggcagggcgccgtcgttgcgcagcagggcgacggattcgcgggcgagttccaggttggtctgctggtgttcggcggagccgatgaccgccttgatgcgttcggcatccggcaggcgcgggtcttcgaacaggccgaggcggaatttcagggccaggatgcgggctaccgcatcgtcaatcagggattcgtcgagcagaccggtttttacggcttcgatggctccctcatagaactgtggggtggtcatgaccaggtcgttgccggccttgaccgcatcggctgcggcgtgcacgtaatcgggcttgacatgctgttcccataccgagcggccgacgttgtcccagtcggtgatcagcgtgccattgtattgccatgcgccgcgcagcttgtcggtcagcagccatttgttgaacgtgaccggcacgccttcgatggactcgtagccgagcatgaacgtgccgcagccttccttggccacgcgttcgaacggcggcaggaaccaggattcgagcttgcggtgggagaggtcggcttcggaggcgtcacggccgccctgggtctcggagtatccggcgaagtgcttggcgcaggcgaggatcgcgtccttcggcagcgtctcgccggcctgggcaccgccctgatagcccttgaccatggcggaggccatctcaccgatgagcatggggtcctcgccgaaggtctcgtccacgcgaccccagcgggtgtcgcgcgcgatgcacagcaccggggagaacgtccagtgcacgccggtcgaggagacttcttcggcggtggcacggccggccgcttcgacggccttcgggtcccagctcaacgccatgccgagctgggaggggaagatcgtggcgccgggccagaaggagtagccgtggatgcagtcgtcgccgatgacgagtgggatgccgagacgggtcttggtgttcacggtttcgacggcgcgcggcaggtcctcggggctggtgtgcaggatggagccgacgtgcttgttcacgatgagctcgtcgaggtcgccaccgcgggcgtcgagctgcatcatctggccgaccttctcttcgagggtcatgcgggagagcaggtcggcgatgcgctcggaggcgggcaggtcggggttcttgtagggcagcgtttcgactgtggtttccggtgtggtcgcggtcatggttgtgttcgcctttctgggttccgtgcggtcactcgatgacgaaggtgttgaaggagcgcggggcgagcgtggccttgaagccacgggaggcgtcggccgggtcggcgaactcgaacgggcgttcgtcctccagcgcgttctgggtcacgaccacgatggtgccgtccgggttgcggaaggcgatggccatggagttgaagtggctggtggtgccgagcaccttcgcgccggggcgcacgtacttggagaagtggcgcatcacgtagtattcggggttgtggcgcacctcgtgcgtgtcggcggtgatggtgaacagggagttctggcgcgaccccggccagccgaccaccgaccggggttttcgtaatcctagaccaaacacacccggcacctggcaggccgcggccggtacgacaagggccagaacgcccgccaggacgctccggcccgaatcacggccggcatggaacccggtcagcgctggaacacgtcggggtgcttcggatctccgggaatatcgtcgagcaggccctcgaggccgaggaactcacgccagaagtcgagcggctggccatacgggttggattcgcggccgtgcgcctggatgttcgccttggcttcgaacacgtcttcctcggtgagcccgtcgaagtagctttcgagacggatgcggttggacggcacgtagtacagggacgcgatgatctcggtgagccgttcgacgcgttcgatcggcagcgaatcccagtggcggaactcgatgaagttcttgagacgcacgtcgttgaaatgcgtggagatgatgtggttgatttcgtacgcgttgagctcgcggtccgggtagacctcgccagcgttctcacggaaggcggcgcgatgcagctccttgcggctcagccccgattccaccgcttcgggcgtgtgcgtcaggtcggcgaacatcagcggcgtggacagcacgtcacgcgcgtagtcctcccagccgaaacgctggtcgaacaggccgggggtcacgttggtgcgctggaagtcgaggtagtcccacatgcgctggcgcagcagcggatacgggttgagacggccctcgaagtaggggtgttgcggaagaaccatgcgagaatcggcccgatggcggtgccgacgcgcatcttatcgatcgaatccttctcgtcgacatagtcgatgctcacctgggtggaggcggagcagcgcatcatgcacggaccgaactggccgacgcggccaaggaagtcggtcatcgcgtcatagcggcctttcggattgaccggcacgtcgacgaaactcgacttcggctggtatccgtagttgacgaaacggaagcccagctcctcgaggatcgggtccgcctcacaccggaagtcggcgtacaggccgttgaggtcgcccggctcatgaagcacgccgatggaagcctccacctggccgcccggttcgagcgacaccgcaacgccttcgcgcgcgagtccgaccagatggccgttctcccagtattccttgctttcgtcataatacggagcgagccgtttgaggaacgcttcgatgccgttcggctcgtagtagcttacggccgtgtcgtcggcgtcatgcaccggcagatgctcaatctcgacacctaaaccaccggtgccgcgcttggagcgccccgcctcgaagaacttcagaaggctctcgacatgcttcgggttcggctcggcgagcaggtgcgcatagctgattctgggagtgaccatgaacggtatcgtaggcgagtcgcgcgacgcgcgtcgccgcgcgcccgcgaatcggctatatctttttccgataaccggcacgtcgccggacatccgccatatcacgccgcaacgccgcaccgcgccgtcgcaccacaccgcgccgccacgcccccatcaccgcacgccacgcctccgcaacgccgcgccacaccgtacggctttgccgttatgcgcgatgtcggatacactcattgatttgtaaaccttgtttacagaaacgtccggcagagaggccggaccacaccatcaacccaccatcaacccacggcgaacagccggaataaaagaaaaacaacagaaaacaacagaacacggaaaacagcaacaacccatacaaaacaccggcaaccataagcacgtcggaagcacaccggaacgcacaccgaagcgcaccggcgaccgctccggttccacaccgaaaccacgccgaaggccataccggaaacggaccgaggacatatcggacacgcccggcaccccaccggcacgccggtgcgccacaatcgaaaggaaggaaagcggcatgacatcccgtcagggcagacaagccatagccgcgacggccgcaatgggcgtggccgtcgcgctggcgttgccgaccgctgcgttcgcgcagtcagcaacgcaaggaaaggagaccgctacgaccacgtcatcaggcaccacctactacgtgtcgtcggcacacggcgacgacgccaacgcgggcaccagcgaaaacgcgccctggaagtccctgaccaaggtcaacgacatcgcctcggacctcggtccgggcgattcggtgctgctggaatacggctccgaattcaacgaccagtacctgcacatcaaggacaccgccggcaacgccgacgcgccgatcacgatctccgcctacggcgacgccgacgaaggcaagccggtcatcgcgtcgaacggcgtcaaaggcagccagtgggagcaggactaccgtgccaacgtcggcaaccacaagaacaagggcaccgtctcaaccacgctgctactcaaggacgtgtcgtacatcaccgtctccaacctggagatcaccaacgacgacgcggacgtctacgatccgatcgacacgtggaagtggaccgacacccctgattccgacggcacaaaactcgaccgcagcgcctcgcgcatggaccgcaccggcgtggccggcatcgccgagaacggcgcgacgatgagcaacgtgacgctcgacaacctttacatccacgacgtggacggcaacatctacaacaagcacatggccaacggcggcatctacttcatggcccactaccccatggagaacacgagcgccgaaaccgacgtctggctcagggagcacgtctcacgcttcgaccacgtcaccatcagaaacagcaccgtcaaggacgtggatcgttggggcatcgccgtcggctacaccgcctacctcaactacatcgacgcgaactacggcgacggctccatcgacgacgccctcatcgcgaagtacggttccaccaacgtgcgcatcgagaacaactacgtcaagggcgccggcggcgacgccatcaccctgatgtactgcgaccgcccggtcatcgaacacaatgtgggcgacagcgtctcgaagcacatcaacacgcaggactacacgcagcccggctcctacggcggacgcgtggcggccggcatctggccgtggcgttgcaaggatccagtgttccagtacaacgagatgtacaacaacctcaacgccgagcacggcaacggcgacggccaggcgtgggacgccgactacggcgacggcacgctgtaccagtacaactactcgtacggcaacagcttcgcctcgctgatgatctgcaactggtacgcggttaacaccacgttccgatacaatatctcgcagaacgaccgtcagggcgtgttcgacctgccgtcgaacggccccggcaaccacatctacaacaacaccgtctacgtggacgccgacagccaggtgctgactaagcgttccaactcgcagtccctgttcgagaacaacatcttcatcaacgcgaccaacacgaagaagacggagacctggaaccgcggcagccagaacggcggccagacgtacgacaacaacatgtacgtcaactacgcgaacaagcccacctccgacgccaacgccatcgaggccgacgacgtgtccgcagtgcttgcgggcgccggttcggctccgacatccgccctcaagagcggcgccgagcatgcgcgcaccggcgagaaagccgcgttcgacggctaccgtccggtcgcgggctcgaaggcgatcaacgccggcaaggtcgtctccgacctcaacgactacgcggtggagaacgacttcctcggcaacgcagtcaagggcaggcccgatctgggcgccgtggaaagcgacgtggtgtccgtcacgatggcctcctccaagtacgagaccggaaccgaaaccgattccgggaccggtgacaagaccaaggtcatccacgtgaccttcaccgacaagaacccggtgaccgtcaaggaactgctctccaacgtgtccgccgacaagggcgtggacaaggccgtgtaccgagtcgccgacgccaagtccggcaagtccgccgacgccaggtccgccgagtccgaaccgaacatgctcgaccgcctgctctccctgctcccaggctccgaccggaacgccaaggacgacgagacgaagctcgccgactccgaaccggtccgcgatggcgacatcctgcgcttctccgccgaaggcacggacgagaccgacgagtacacgatccgccagcgcatcacgtgggattgggtcgcggactacgagcaaggcgtcgccgacttcgactggaaggcgcagcgccgcacgtccgccggcggcgagtggaccaccatctccgcatacgacggctcgtggccgaacaccgtgtacgaccagtactacggtgtcggcgtcaacggcaccctcgccgaactctccggcgaccgcaagcagacgcacggcctgctgatcgacaagcccggcgacggcctgcccacggccatggcgtggaaggcgccggagtccggcaccgtcatgctgtcgctcaagacgttcgccgacaagatcgctgaaccgtacctgcgtcagaacgcggacaacgccggcaagaaggtcacattgtcgctgatgcgcaacgacgagacgctctgttcggccgacgacctgtccgtctatcagaagtcctccgaacagttcgcgcagtgcctcgccgagcacggttcgatcgacgtgcaggaaggcgactggatccgcatcgtcgccgacgccgagaccggagtcaaggcgccgtcgctgcacatcagcccggtcatcacatatgaggacaaggcgcccgccgcgccgaagcagaacgtgcgctacgacgtctcgtacgccgcgacggacgccgtcgtcggcacgcagtcggccgtcgccgccgcgttcaccgcggacggcggcgaggccgacgcgccggacggcgtcgcgttcgccttcaaggacggcggcgatgagggcgaggcctcgcccgtcatcgacgcgtccaccggcgccgtcaccttcacgcccgccgccggacagtacggcgcgaccgtcacccgcaccgtcgtcgtcacgtacgcggacggttcgagcgacgagacgaccgtcacgttccgtgtcgcgcaatcgcacgcgcagcgtctcaacgtgctgtacccgaccgtgcgcggcgacgccggcacggacctgaagcgcacgccgaagttcacgctgaaggcggacggcgcggccgcgtctgtgccggaaggcacgacgttcgcgctcggcgcgaacgcgccggccggcgcgagtgtcgacatggcgaacggcacggtcacgctgaacagcggggtcggcggcaccgtcaccgtgcccgtcacggtgacgttcgccgacgacggcgccagcgtctcctccaccgcccgcttcgaggtgaccgcgcccgccgcgctcggctcgtccgagttggagaccgcgactgtcgacggtgtgaacgtcgtctacgcgccgttctccgccgacagtccgatgaccgtcgcgcagctgctcgccaaggtgacggccgaaccgtccggcgccgataagggcgtgtaccgtgacggcgtgcggttggaggccggcgcagaactcgccgagaacgacgtgctccgcttctccgcgaaaggttccaccgtgtccgacgactacgtggtgaagtcgaagaccacgtgggattgggtgaacgacttccaggtgcgcgtgcagggtccgatctggtacgggcagcgtcagaccgaggccgacggcgtgtggtcggatatcgccgacttcgacgcgacgtatccgaactggatgtacgagacctactacggtccgggcgtggactacgcgaaccacagcctgcccaccgaccgctccgccatccatggcctgatcagcgattcgcccgcgtccgctggtggctccgccatggcgtggaaggcgccgaaggccggcacggtgaaggtgtccatccgcgaggacgagccgtacctgcgccaggacggcagcaacggcaaggcgttgacgcttcgtctcatgcacgacgacaaggtggtgtgcttcgccgacctgaccgtctccaagcagcgttccgaggagttcgccaactgcgtcgccgacaagggcgagatcgcggtcgaggcgggcgattggatccgcgtcaccgcgacgtccgcgtccggcatgaacaagccgtccgcgcacatctccccggtcatcgcctacatggccgcctccacgccgggccccgaacccgttccggtggacaagtccacgctgaaggccacggtcgaggaggctctgggattggccgagtcggactacacggatgagtcgtgggccgcgctcgtcgccgcgcgcgacgccgcgcagaccgtgctggacgacgatgccgccaccgccgaacaggtcgagaccgcgcagaacgcactgcgtgacgccatcgacggattggagaagaagccggtcgatccggacccgaacccgaaaccggatccgaaccccgatcccgatccgacgcccgacccggaccccgaccccggccccgacaccaagccgggtgacggttccggcaacggttccggcacgggcaacggttccggttccggcaacggttccaccggttccggcagcgacggcgcgaccaccggcggcaagctgaccgccaccggcgccgacgtggccggcgcggccgcgatggtcgcgctgaccgcggccgccggcatcggactggccgccgcggcccgtcgccgcaggtgaccgatgccacgtaggcaccggttcgccgccgccatcgccgcagtcgcggtggcggcggtcctgctcgtcacattgaccgtcgccgtcgtcacgcacggcgacggcgccttcgcgcccgcaggcacgcctgcgggcgcgggcgcatccgccggcatcggctccgataccggctccaatgcaagcgaggattccgacatgttccccaccatcgtcttcggcgacaccgtcatcgaacgcaaggagtacgtcgcggcgctcaaggcgcaacacggcgcggcgcggctgtactttcggcagacgtacggcgtcgacccggccgaggacggctgggataaggcgcacgacggcgaggtcccgtgccgttggctcgcgagccgtgccatcgacgaactgcgacgtcggcacgccgcgtacctcatcggcgtggatctcgggcaggtggccgacgactcctatgcgagcatcgtcgcgcgcatggaggccgtgaacagcggcaacgcggaactgaaatcggacggcggcatcgtctacggccgtaccggcttcgacatcgacagctacctgagctacgaactgtccgcgttgaagaacgcctatacgggcgacgagtcgaaccccggcatgagcctgtccgacgacgaggtgcgacgctactacgacgagcacgactggacaaaggacggcgtcgacgggaagactccgctggacgaggtgcgcggcaacgtgaaggcgcagatgcggtcggaacgttacgacgagctcgtgagccagcgcgccgaagcgatcgacgtgaccgacctgccatgggacgcgctgtaccggttcacggcaggcaggctcgggtaggacgggtgtgaccggtgccggccgaaaagcaccagaacgaataaggcgggtgtcccgttccatacggaatgggacacccgccttgtcgtaggccgcagaccggtttgcccggtctgcgccggtctggtgccgaccgggcgtcggttggacgtcggtttgaggtcagtcggcggcagtgaagccctgcggctcgtcgccgtcggcgaacttcgccttgtgcgccttcttcgcggccgcgatcatcagcttgatgcggttgagctggttcgcctcggaggcgcccggatcgtagtcgatggacacgatgttggcctccgggtgcaggcggcggatcttgccgaacatgccgcggccggtcacatggttcggcaggcaggcgaacggctgcgcgcagatcacgttcgggcatccctgttcgataagctcgaggatctcggcggtgagcagccagccttcgccggcctgcacgccgatcgacgtgacctcggcagccttctcgacgagttcgggcatcggatcgtcttgcttgaacttgccgtgagaggtggcgatggccgccttgatcggcgcgttgtagcggtcgaggctccaacgcatgagcgcgtacaacgtcttgttgccgccggtgccgagatacttctcgttccagtcggtgatgtacgggcgcgtggtcatgaactccatgatgccgggcaccacggcctcgcaatcctgcgattcgatgacgtcgacgacatggttgttcgcatccggctggtatttgacgaggatctcgccgaccacgccgacgcgcaccttgcgcggcacgtccttcaacggcagagcgtcgaagctcttcacgatctctcgggcgagcacggggtacggcaggtagcggcgcttgagccacggggtcttcgcggccgtcttcgagaagccgtggtgttcgagcgcctcgcgcacgatcacgtcccactgctcgtacaggcggttcgccgcgcccttctccacctcgtacgggcgcacgcggtacaggcacttcatgagcaggtcgccgaggatcagcgccttgacggtgcggtgcagcagcgcgggcgtcaccttgaagcccggattgtcctccaggccctgcgtggagatcgcgatgaccgggatctgcgggtaacccgcgtcgatcagggccttgcggatcaggccgaagtagttggtggctcggcacatgccgccggtctgcgtaatcgcgagacacaccttgtctggatcgtatttgccttcgagaatcgcgtcgatgagctgtccgatgaccatgatggccggatagcaggcgtcgttgttcacgtatttgaggccagtctccacgtcttcgcgcgaggcgtgcttgaggatgtcgaacttgtagccgccggagcggatcaccgattcgacgagggagaagtggatcgggctcatctgcggggcgacgatcgtgtagtccttcttcatgtccttgacgaacttctcacggtgcgcgtaacgggacatggtcgcgttgttgtggccggacttcgacttcgcggacttcgacttggcgttcgcggcatcgttcgtggtgccgtcgccgagcgcggcgagacgcacatcggcgatgtcgcgcttcgcggcgcgcttggacgcgtcgcgcatcgccttggtgagcttcgggttcgcggccatcgtcgcgtcgagcaggacctgacggcccggcgtgggcgccttggagccggtcttgcggaatccggtggacttcggcgcgttcgcgggggcggcggcgtcgctgccggcatcggccgcgtccacgggcctgtcggcggccttaaccttcgcttcggcggcggcgacggcggcctgcgcttcggcgagcgcggcctgcgcggtggcgagatcggattcggcctgctcctgcgccttgcgggcggcggcctgcgcggcggcgtgagccgcgttgcgcggggcgtcggactcggcggaaccggactcgtcggacgtggcgagcgcggccttggccatgcgcgccttgttcgcctcgcgttcctcgacggcggccttgagcgagcgcaggcggatcttcgccgcgccgaggttggagacctcgtcgatcttgagcagcgtgtacacgtcggccttgtcggcgaggatctcggccacctggtcggtggtgatggcgtcgaggccgcagccgaacgagttgagctgcacgagttcgaggcccggataggaggcgacgaagtgcgcggccgcgtagaggcgcgaatggtaggcccactggttggtgacgcgcaacggcatgcggttgacggtgaccttgcggtcgtcgacgtggcggaatccgttcgcgttcttcttgcgcgggtcctcttcgccttcggacaggaagtcggtcaggtcgagcttctcccccggctgcagttcgcagatcgaatcctcggagaggacgaccatgccgagcgcgcagatggtttcggggatgccgtggttgatttccgggtcgatgtggtaggggcgtccggcaagcacgatgccgcggcagtcgtgctccttcatgtaggcgagggctttgaggccttcctgctggacgtcgtgtttgaagaccttgtcttcggcgtaggcggccttgacagcagtttcggcctcttcgcggctgacgctcgcccatgcgaactcctcgacgatacggtcgaccatgagctcgtggttggcgaggttgaagtacgggtgcatgtagcgcacgtcggggtcacgcagttcgggcatgttcgcgccgacgacgagcggatagttggcgacgaccgggcagttgtagtggttgtccgtgttgggcacgaggttgtcctcgtaactgacgcacgggtagaagatcgtcttcatgcccttgttgagaagccatttgatgtggccgtgcacgagcttggccgggtagcagatgttctcggaggcgatcgattcgatgccggtttcgaacagttcgtggctggaacggccggagatcatcaccttgaagcccagcgaggtgagcagcgtgaaccagaacgggtagttctcgtacatgttgagggcgcgcgggatgccgatttcgcctcgggtggcgttcttgtcggtgaggcggcggtaggcgaagcaacgcttgtacttgtagtcgtacaggttcggacggtcggagcgtttcttcttggcgtcgccgccgcgttcgcagcggttgccggtcacgaagcgcgagccgtcggagaacgtggtgatggtgagcttgcagtggttctggcacagcttgcacacgtcgcgttcggtggtcatcgacatttcgttgagggcttcgccggtgaggattgacgagacggtgtggcgcacgccgtcgacgacgatttcgccggcgtgcgcggcggcgttcggctcgtcgccggcggcggactcctcagccgccgccgcgtcgacggaacgcccgtccgcgccgacgtgcgcgttgtcgtcgtccgcgatgtcctcgtagtgcatgcgggcggtgagggccgcgccgaacgcgcccatgaggccggcgatgttcggtcgggtgacttcgcgttcggtgagcagttcgaacgcgcgcagcacggcgtcgttgaggaacgtaccgccctggaccaccacagtgtcgccgagttcgccggaatcgcgcagcttgatgaccttgtacagggcgttgcgcaccacggagtagcacaggccggcagcgatgtcctcgatggaggcgccttccttctgcgcctgcttgaccgaggagttcatgaacacggtgcaacgcgaaccgaggtccaccggatgggtggaagccagagccttttgcgtgaattcctgaatcgtcaggcccatggacatggcgaaggtctgcaggaacgaaccacagccggacgagcaggcctcgttgacggcgattgaatcgataacgccatcggtgatggccaagtacttcatatcctggccgccgatgtcgatgacggcggtgacgccggggctgaccatttcggcgccacgatagtgggccatggtctccaccacgccctcgtccaagtgcaggccggtggtgatgaggccttcgccgtatccggtggcgcaggagcgtgcgatccacgcgccttcgggcagctcagactgaatcttcttgacgatgttgatggcggcggtcagcgggctgccttcgttgttggcgtagctggaccagacgatttcacggtcgtcgttgacgagcgtggccttgatggtggtggaaccggcgtcgatgcccaggaagtgcgggccatgcgcgccttcgagggtgccgatgtggatgtgttccttgtggtggcgcttgttgaagtcctcgcggtcggcctcggtggggaacagcggcggcatggtgggcgtgttggagggcaggttcttcagctcgtccaaacgcttcaggatttcgtcgcaggtgtaggcctcgaaatggtggccctgatcgtcggaatccgtgtcggcctgcaatgccgaaccgtaggccacatacaggtgggcgtcggtcggcacgatgaactcgtcgaccttgccctcaagcgcgcgctggaatgcggcgcgcagctcggacatgaagaacaacgggccgccgaggaagatgacggtgccgtgaatcgggcgtccggaagccaggccggcgatggtctgcgtggccactgcggtgaagatggaggcggccaaatcgggcttggcggcaccatcattgatgagcggctgcaaatcggttttggcgaacacaccacaacgcgaggcgattggatacaggttctcgtagctcttggccatctcgttgaggccggcggcgtcggtgtcgagcagcgtggacatctggtcaatgaacgcgccggtaccacctgcgcacgaaccgttcatgcgttgttcgggcgtgggtttcaggtaggtgattttggcgtcctcgccgccgagctcgatgatgacatcggcctgcgggtattccttgtcgattgcctcggtttcggcgatgacctcctgaatgaaaggcacatgcagattgtcagcaagcgccagaccgccggaaccggtgatagacaggcgaatcggttcgtcgccgcgtccgaggtccacaagcttcttgtggatgtcgaccaacaggccggccacggtggcacgcacgttggcgtggtggcgtcggtaatcggagaagagggtgtctcccagggaatcggactgatcaagcaccacggccttgacggtggtggaaccgatgtccaatcccacacgcaggggcttcgggtgtgaagcgggctttacgctcgcgtcagtggcgatgtcaaccatgtgttcctcttaattccgacttccgggagtgcacgctttgaggcatcatgaaccgtttcgggacggctggcagataccctgcggacggcttcgcccggctacttcttatggaatattagtccgaccacctgcccaacatggcacgaggcgaggcgatttcgctcacgggaaggccttttcccaacagttccaacgatattgctgagtgcggcattccagaactgctactacgaggcctgttggccttcgccggcttcgcggtctttcaaatagatttcggggatatctcgttcttgatcgtggagcttggcccagatgaccggttcgccggcttccagagacttgggcacatcgaggatgcgctggtttctggagccgcggaattgcagcagcgagtccttctggtctctgaggtagcggccgtcgacgagaatgtcgatgagatgtagcaattcaagcttgtctggggtttctccggggcgcatgagttcttcccatgtgtagccggtccacgaccagatatctttggtatgaccgaattcctggcggatacgttgtgcgagcggcaccagcacgggagtgttgaggaatggctcgccgccaaggaacgtaatgccttgcacccatggggctttcagatcttcgatgattttgtcttcaagtttttgcgtgtattcgtggccggcttggaaatcccagatggaggcgttgaagcagtcgacgcagtggaaggggcaaccggagacgtaaagggagttgcgcacgccttctccgtcggtgacaatgaaggttttgtagtcggcgatcatccgcttggacatgcgccggccatcccattgaccggctttcggatcgttggcaagaccgttggagggtacggaggggccacgcccggtctcgccggccgcaaagtcatggcgcttgggttcgggcttggtcgtatgcagctccggcatgattccctccttacggaaagcattagctcccgctggcgggagctgtccgtcatcagacggactgagggtggtcaacaccataaaggatgaccgccctcagtctcgcttacgctctacagctcccgtcagcgggagcaagtataaaccctacttggtctcttcgaaccactcgcgagtggttccgtcatccagcgtcacacgaccggtttcgccgctcatgtgcttgactcggtgggcaatttcctcgtgacggccgtgcaccatcgggcgctggaccgggctgccgagatagccgcaggtgcgcttggtgacgttgcacttgtccgggttggagttaccgcactccgggcacttgaagccttcctcggtcggctcgaagtcgccctggaagccgcacacgaagcagtggtcgatcggggtgttggtacccaggtagccgatgccgatgttgtaggcgtaatcccacacggcttcgagcgccttcgggttgtcctgcaggcacgggtactcgcagtagttgatgaagccgccggaagcgtagtacgggaagtccttctcgtagctgagcttctccatcggagtgggctgcaaccacaccgggtagtggaaggagttggtgtagaagtcgtgatcagtcacgccttcgatacggccgaacttttcacggtccatgcggttgaagcggtcggtcagggattcagccggagtggagtacacggaatagtggtaaccctccgctttgctccactgcttgcacagctcgttcatgcgcttgacgatggacagcgcgaactccttgccttccggatcccagccgtggtcgcgaatccagttcttgccatagaagaccgcagtggtctcggcaaggccgatgtagccgagcgacacggtggcacgctcgttcttgaacagctggtccacgttgtcgttggcaccaagacgaccaaacgcaccaaagcggaacagggtcggggcgttgaccggggtggcttccttgcagcgcatgatgcggaactggagggcctgatgggcgacttccatacgctcgtcgaacagcttccagaagcgagccttgtcaccgtgggattcgatggcgatacgcggcacgttgacggtgaccacgccgaggttcatacggccgtcttcttcatccttgccggtctccgggttgatccaaccctgcaggaaggagcggcaacccatcggagccttgaaggagcctgtgatcttgacgatgttctcgtagaacaccacatccgggtacatgcgcttggtggcggactcgagggcaagctgcttcagatcgtagttcgggtcacccgggtcggcgttcacgccgtgcttcacagtaaagacgagcttcgggaagatggcggtgtggtgttccttgccgaggccgcgaatacggttcagcaggattgcgcgctgcacttcacgagagaaccagtcggtgccgagaccaaagccgacagtcacgaacggggtctggccgttggacacacggttggagttgatctggtattccatggtctgcatggcatcatagatggccttgcgggtacgaatcttggcgaggatttcacgctcttgctcaagttcgtcaacgtcggtgtggaacggggtgtccatcggcagcggttcacgggaaccgaaatgcagcttggcgggctcgttcttcttggcgctctcgacctgacgacgggcgaattcaaccggcatgccgtcggggatggtctcacgagcttcctcaaggaacttctcgtaatccttcttggcatactgggcaagatgctcgtcggcacggttggcggtctggccaccatactggctggaggccacgtccttcatgatctgggtaatctgggtggccgcaatggcgatggacttcggggaagccatcggagcgttgccaagagtgaagccattggccaacatgtcccagaagttcggcaaggagcagttggactgggcagtgaacggcgaatagtcggcatcgtggaagtgaatgtcgcccttcatgtgggcgttggacaccgccggcggcagcatgttgaacgcggcggccttggacacggcaccggccagcagatcacgctgggtggagtagacgttggaatccttgttcgcgttctcgtgaatcagggtcgggtcatgattaatgaagcgagcaacggcctcgttgacatcagtggccttggcacgctgaatgtctttgtcgagacggtaattggtgtaggcgcgagccacatcgtacaggtgggcgtcaatgagggcgtgctccacgagattctggatgtcctcgattttggcggggccggtgtaacgccccttgatttcgccttcgacttggttggcgaaaccacggatcatggcatcttcttcggggccgacttccttgttcaggtcgccgaaagcagacttgaccgcagagatgatgttgatggggtcgaagtcgaccacacgaccatcacgcttctcaacgagcacggtggaggccttggcggccaccttggtctcgttatcggtgacggtttcctccagcacctgtgcgcccatcgggcacccctttcctataaggcgaacactctcctgagttccgcattttggccgcactcgacgtgggccacacgaaattacattgatatcgttttcttgaacctctagaagaatacggcatccccacccctatatctagtgctcaacagtggtgtgtcgaactatttatagggtttttcggctatttttcgccaaaactacaagtgtgtgattagcgtaactgttttctgctcgcgtgtcgcacagcgagctcactgacgactctcaatcgtcagtgcaacgcatatctcactcctcttcatagcacccgtttcttcgccataatgactcctttcttctgatgcaccagaccatctccatcatcggctgatacatcgcttcgtacggttcttgcattcatcatcacaccgttttcaggcgacggtaaatttttaccgtcatcaaccaacgcacttatagtggagtgcatgactactgcaatgggctactcatctaccggccgtccaccgaccgccgcttcactggcctcgtctggctttgagccgggtcaaggcactttcgcgcccgatcggggcgccatcaatctgccgaatgagcctcgccctatcgatcagctgcctgcacgcgccgctgaaaccaccgcgcaaaatccgtggccggtaagcgtgctgagccagaagttctacggtgccgtggaacgatggccgtccgcgtgggtcaccggccagatcacgcagatcaatacccgtcgcgccggctcggcctacatcacgctgcgcgacgacttcgaggatatcgccatggaagtcaatggcttcggcaggttcgcggccgcagccagccagttcgttcagggcgaccgcgtggtgattcacggcaaaccgaacctgtggatgaagcgcacttcgctgtcgttgcgcggggacacgattctcaaggtcggagccggtggcagcctcaaggccatgatcgacgaattgcgcaagcagcttaagggcgagggcctgttcgatgccgatcacaaactgcctctcccggagtttccgaagactattggcctgatttgcgcacctcaggcacgtgcggaaggcgatgtgatcaccaatgtgaaccttcgttggccttccgtaaccttcaaggtggtccatgtgcatgttcagggcgagcaatgcccggccgaggtggttcaggccattgcacaactcgatgccgacccgagcgtggatgtgatcatcgtggcccgtggcggcggctcgtttgaggatctcatcggtttctcggatgagcgtgtggttcgtgcggcgtatgcctgcactacaccattaatctcctccatcgggcatgaggatgactggacattgctggatctggtcgccgatctgcgcgcctccacccctaccgatgcggccaagcgcgtggtgccggatgtgcgtgagcagtcgcagctcatcgaaggtgccatcgaccgtatgcgactgcgggtccgttcgcgcgtggagaacgagattcgacttatcgagggatatgcgaaccgcccgagcctgacacagccgcacaccatgcttgagcctcatcagcgcttaattgacgactcgttgcaacggctcgatatcgggctgcgacgcatcgtggacgatgcccagctcaccgtcgagcgagctcacgcctcactgaccgcactcagcccgcaatccacgttgaaccgaggctatgcggtggtgcagtccgccgatggccacgtactagacgatgcttcgcaggtaagccctggggatggcatcaccgtcaccttgaagaagggtgtcattaccgcaaccaccacatccgcaaccgcgtgacacgccatacgcagccacgcatatataccgtatatataaggagaacatcatgaccgaaaacgccacatccaccgacatgaacacccccgccacgtccctgacggacaaggaacgcgagctcatcgcccagatgccatatgaggaggcgcgcgacaagctgattcaggctgtccaggcactggaaaccggcggcctcaatcttgaccagtcgatgcgtcaatgggagatcggcgaggccttggctaagcgcgcccagggtctgctcaacgacgtccgtgccaagctcgaccaagcacaagccgagcaagccgccaacgaagccaccgcaggcacgcagtccaacctcgactgagttgcctcccggcgcggcatcccgcggctcgcacctgagtccggactggactgagttctgcttcccggcatacgatagtggtgattaggccacattggcagcagtttatagaagggaaatcccatgtcaacgttgattcttgtattccatccgcatcttaaggacggctcgcgcgtgaacgcccgcctgctcgccgaactcaccgcacagggcgaggacgacatcatcgtgcgcgacgaatacgccgaatacccgaacttctccgtcaacgccgacacagagcacgagctgctggaggccgccgaccgcgtaatcctccagttcccgttctactggtactcctccccgcgctgctcaaggaatgggaagacgaggtcatcaccgcaggctgggcctacggtggaggccacgcactcaagggcaaggagctcaagctggtggtcaccactggttccgacgccgccaagtaccgcaaggatggcgagtacagccacaccatggaggagctgctgagcccgtttgaggtcgtggcgtacaagatcggcatgaactatgctgagccgttcctggtgcagggcaccgccaccatcggcgatgcggagctggatcaggccgccgccgattatgtttcggcgattttggactgaataagctgaggccgggtgcaagtcgcacccggccttgttgtttcgcgggctagccgcggtctctcccagtcagcctgcggctgacagttccctcgtcagagagagcttattttttggatcagagggagttgatagctacttcttcaacggcacgtagatcacgtcgtcaatgagctcgcgatagtgctcaacgatttgcgcgcgacgggtcttcaggctcggggtcagcatgccgttggcctcggtgaattcgtctggcagaatctcgaacttacgaatcgactcggcgcgggaaacgccctcgttggcggcgttcaccgcacgctccacctcagcgtgaacgatggcgttcttggccagcgaggccagatcgggttccggcttggcgccctgggattccagccatttgttggcatccgccagatccagcgtgaccagagcggccacgaacggcttcttatcgccaataaccaagcactggttgaccacgggcgaggtcattacggaagcctcaagcagacccggcgacacgttcttgccgccggcggtgatgatgaggtctttcttacggccggtgatggagatgaagccgtcttcggagatatcgcccagatcgccggtgtgcagccagccatcggtgatctgctgggtggtgacttcggggttgttgtggtagcccttgcacaccagcggtcctttgaccaccagctcgccgtcctcggcgatgccggcggtgataccgcacatcggcatgccgatggtgccgatgcggttgtcctctggcaagctcacacacaccgggccgcaggtttcggtcatgccatagccctcaagcaccggcatgccgatgccgttgaagaagtgggaaagctcagagtccatcggggcaccgccggtaatggcgaagtcggcgttcggaccgaaaatcgtgcgaatcttcttgtacaccacctgctcatagaaggcgtgggcgatacgtccggcaatcggcagctgttcgcccttctgctcggccttggaccattcgcgcgcgttttcggcggcgcgcatgaacatcttgccagcgaatccggtgccggcgcgctgggaggcggcgttgtagaccttctcgtacacacgcggcacggcgagcagcagcgtgggaccgaaggtctcgaagtccttgaccatcgtcttcatattggagctcagggccagcgaaatcgtgccgccgaagctgaagaattccatgaatcgggcgaacacgtggctcaacggcaggaacagcagcaggcggcggttgggccatgcgccggcgcgcggcatgtactgcaatgcggagagtaccaggaaagcgaagttgcggtgggtcagttccacgcccttcggggtgccagtggagccggacgtgtagacgatggtggcgcggtcgtcgccgtgggaggcttccttgtattcccagaattcggcatcggtgacgctttcgccataggtcttgatggcgttcaggccgccggcctcgattacgaacacgttgcgcagggtgggtacctcgctgcgcacggattcgatcttgtcgcgctgtccgtcatcttcggcgatggcgagcgtgactttggaatcgttgaaaatccagctgacctggctggcggagttggtctcatacaccggcacagtgagcgcgccgatggacataatcgccatatccagcgcggtccattcccagcgggtgtgcgagacgatggcgactgaatcgcccttattgacgccaagtccgatcaggcccttggccagatcgatgaccatgtcacggaatacttgggcactgtacgggtgccaagtgccatcatcgcccttgtattcgatcatggcaccttcgggatcgcgcttggcgcggttatcgagcagatcgaacaggttgatgtcgctgtcaatcggctccttgacgggattggtgaactgcttgacgatacgagtatcgtttatggccttatcagcgatgttttcagtcatactccccatgtaactccacggatgctacaaaacacgcgcgaaacagcggattgtccagaccaaatggccccggcaatccgttatttcgggcaaaccaggtaaatctgccgcaccgtacattcagcagattactcggcggagttattggcctttttcagctcgtcgcgaatctcctgcagcgtggcgagagtctgctcttcaacgctaggcccctgttcttcagcgtcagcctcatcctggatagcagtaagatcacgaagcttattaatcggcaaaatcacgcagaaatacaccgccacgccaacaagcaggaagttaatcagcgcgttaagaatcgcaccaaatgaaacggtcgagttgttgaacgtgatggtcagtagtccggaaagatccggtacgccgccaatcatgccgattaatggactgatgagattgtcgacgatggaattgaccacagcggtaacggcagagcccatcaccacacctaccgccatatcaatcattgatccgcgcgacaggaatttcttaaagccattcaacggacctttatcagtcaaagcaacaactttgcgagcggttcctcccgtggccttggcaaagtcggtggcaatattcatgggattgtggttactcataacggcactccttacgaaattcagacacttcacttgtatccgactggttttcccacgactccattatgccgcttgttggaatatccctataccactgcggcgttcccgtacatgactatgtacgagaacgccgccaaccctgcttgcagagaacctgttagagctgtttagaactggatgtaatcgacttccgtatgctcgccggtttccaagtatttcgccacatcatcaggaccgacgaacaccagttcgaccgcttgcgcaatcatcagattgacacgatccattggcgtaaggttttcgaaatagccgtacaccgggattcccagcgcatgcgcatatccgatttcgaacatcgtgcccgggtcctcgtccataagattggcgaccacggctttagcagcattaatgccatggatatcgtccgcaaagcatccttcagggcctacttcttcgatctggctgacaaaccgcggcttgaacagtaccttgccatggtcttccaatatcttttccaaacgttccatacttgccgtttgttcaggatcgaagaacggaccggccacatagaagtcatactgtttgtcttcactcatggtctctagtcatagcgcagccgcgtcggacgccagccgttattttcactgtatggacaaggggtcgtatcgtgaacattactacgggataaccgtcaatgactacgtacgttgcccccgatcagcacactccgccactttcgccccctcccgtatcgtcgagcacgcgaaccaagccgaccaaatggccgccatcccatgcgctgatcaccgtatccgaatgctgcaatgccttgaacaaccgttccggccactgcgccgattcccaacctaccgacttgaacagcgcctcaacctgctcaacagtaaaccgcttctcttccgtgtattcgatagccatggaccctcacgacaaccgtgaagccccacatgtctttgcatagtttcacacgacgggatgatggatagtggaacctatacgtttacacatgcctaatgcccatggctcatcaccgatgaatagaggctgagataccgtcatgtttccgaagccaagtgcccgagatcggattcgaaccgacgacacccgctttaggagagcggtgctctatccactgagctactcgggcaacgacgtttcattgtacacggccacacgcccagtcgcatcatgttcgcgtggcagcttgcgcaagccatccggcaacctgagcaagccacatggaggaacccgacatcaggtcatggcccggtctttcgtgccagtttggtgcgaactgctcttgcgcacggcgaaaagacactgaaagacaagccgtacacggtacagtggcaaatcgcacgaaaagcaaagtaacagtaaacaagccggaggaaagggcagcatggcaaaggcacggagtactaccacaggcgcaagcgtacgagctcgcgccgctgccaagccacgctctgccagagccacggcacgcccagtatccaagtctgccgtgaagccacacaaacggcatcgtctgcttggttttctcgccacgatgttcgcgcttcttgcccttgccggcgctgccgcccgcgcgctgcctgccgatttacaggaactgccatttgcgccgattgtggtatcggcaacgccatggttcacgttgcttggcttgattgccctgctgttggccatcgtgtcgcggcgtatccttgccgcactaatcgccatcgccgcaatcgcatgcaatggctattggcaatatccgttcttctactcgaccgatccactcccccaagccgcgcagaacgccgtggccgcagcctcccccaacaccagcgatgcctacgcgcgcgtcatgaccttcaatgtgtataaggggcaggccgacccgcaagccatcgtcgagctggttcgcgatcagcgcgtcgaagtgcttgctttgcaggagaccaccgaggatttcgtcaaaaaactcaatgaggctggtattgagcattatctgccgtatgcgcaggtctcatcgtctgacggcgtattcggtaacggcctctggtcggccacgccacttgccgatccgaccgacgatgacgtgaattccagcgcctcattcatgcccggcggcacggtggatatgggtggccagcagattcgattcgtatccgtgcacaccaccgctcccgtacccggctactggcggcagtggaagcgatcgctggatgagttgggtctgatgcgcgagcatacggatacacggtatattttcatgggcgatttcaacgccacttacgatcacacgccattccgtgattttcttggcgaccggttcgtggatgccgcacgtgaatccggacatgggtttacgttctcatggcccacgaaccgtgcggctgtgccaatgttcgccggtattgaccacgtggtgcttgatcagggcatgaaggccggacaatgcaaggtggtcaaagtcgagggctctgatcatgcggcattgttggctaccgtggcggttgggtgattcccctcaataggactagaaaccgaggcgggtgcggccgaattggtcgagccagcgcaaaatcgcgccttcacgcagcgcccacgggcagatctcgacttcctgaatattcagggccttcatgatctcgtcggccaccacgccgccgcccacaatctgcatcgtgcgttcaggcgtgatgccgggcaaagccacgcgctgctcaggcgcgatcgccgccaaacgaggaatccagtcttccaactgctcacgagtcataatccatgaatcttcgcggcccggcgcacgcatcaccgcaccgcacaggcgagccagcgagcggaaggtcttggaggtgccaactgcatgattcgggtgcttggattgcgggaaaaccttgaccatcggctccagaatcttgcgcacgttcttacgcacgtcttccaactcgtcgggcgtggccatgccggaaggcagaaattcagtggtgacgcggcccgcgccagccggggcggaaagcgctacggtcggctcttcgtcggagcccatcgccacttcgagcgaaccgccgccgatgtccagcaccagcagtcggccggcatcccaaccataccaacggcgggcggccaggaaggtcaggcgagcctcatccgtgccagacagcacagtgacgccctgaccaatcagttcctcgatcttgtgaatcactttgttgccgttcggcgcctcgcgcagggcggaggtggccataaccagcagctgggtgatttcgtattcctcggccagccgcatgcactgggacacggcttccagaatcgcctcgatgccggacttcttgattgagccgtcgtcctttaaatacttcatcaggcgcactgtggatttggtgctggcctcggggtcagggcgagcgccgggggcggcgtcgacgataagcatgtggatagtgttcgaaccgatatcaagcacaccaagtcgcgtggtatgcgaacgcagattgaccatgattcctattcctgaccttacctaacccgtgatggccgaacaacgggccgaccatcgcaatcagccagccgtgcgccaccatggcgagtcgttcggccggcaaccaacaccgtgaggccagccgaacatcacacaaactcgactactgtacaacaatcacaccggctgccgcgccgttcacagcgattcgacgaacgttccgagacgttccagcccctcggtcagggcctcacgtgaggcggcatagctcaggcgcacatgcgtatccgccgtggccgcgccgaagtcgcggccaggagtcagagccacatgggcttcatccagcgcgcgttcgcagaacgtccaggcatccagaccagtgcgggagatgtcgaagtaggcgtagaacgcgccattcggctccacctcaaccggcaaaccgatgcgcttgagcccgtcaatcacaatgcggcgacgggccagcaattcctgacgacgagcttcgcattccgccaagctttccggcgtgaagcaggcgagcgccgcatgttgcgtgggcgtgtgggcgcacaggtagtagttggtggccagatcgtcaaccgcttccagcacagtgggctcgtccggcagaatcgcccagccgaggcgccagccggtcatgccgaagaacttggagaagctgttgcatacgatggcatcggggtcgcaggccagtacggacttgacttcggtaccgtccggctcccggtcagccaaatcaaggtaggtttcgtccacgatgcgccatgcgccgcggctggcggccaacttgcacacctcgtccaatacgttgaagtcgatggtggtgccggtggggttggacggcgacgtgatcattacggccttggtcttgctcgtccagtactggctgcacaggtcggcggtcaggtggaagcgggtggcggccgaggtcggcacatcgatgacccggccttcaaacgaccgcacaagttcgcggttgcatgggtaggaggggtcggccacaatcacatcgtcaccggggtccacggtcagcgcggtggccaacagcagagcggccgaaccgccggcggtcacgcagatacgcttggggtcgatgtcaaggtcatgacgctcgcggtagaagtcggcgatggcctgacgcagttcaggtaggcccatggcggcggtgtacggcagggcccggccgtcgtactgttcgcgcatggcgtcgcgtacggcgggcggcgcgccgaaatcgggctcgccaaggcttaatttgatgacgctggtaccttgggcgatcatcttgtctgcttgttcgccgaataccatggcacggaagggattggcctcacgcgctcggcgggacatgactggagacgcggccggagattggggctgctgcgctgcttcgttttccatatttcggttctatccgcctcacgggacaaggtttcttcttctataatcactgtaggtcgattgagtgcaccaacccgtattcaaggagaaataatgagtcgattcaatggcaaacgcgccgagttcgaggccagcggcgaaaagatcaacgtcgcgattctgggtgcgggccgcatagctcacaccatggccgacaccctgacccagatggctgaagattcactgtattcctcatggattcacccgtatgcggtagcggcccgtgatattacgcgcgcgcaggcttttgccgaccaatggcattttgacaaggcttatggatcgtatgaggagttggtggcggacccggatgtggatctggtgtatatcgccaccccgcacagtctgcacgccgaacaggcgatcctgtgtatgaaagccggcaagaacgtgctggtggagaagtcgttcaccgcgaacgccgggcaagcacgtgaggcgctggccgtggccgaggaaaccggcatgctgtgcacggaggccatctggacgcgctacatgcccagccgcaagctcatcaacgaagttatcgagtccggcgagatcggcgaggtgaaagcggcgaacgccaacctgtgctatccggtgtccggcaaggcacgtatgaccgatccggcctgtgccggtggcgcgctgctcgatgtgggcgtgtatccgctgaacttcctggatatggcggtcggcgccgaccatggccgtacacttgatcatttcgatacgtcgatggtgcccgccgaaaccggtgtggatgcgcagaattccaccacgttgtattacagcgacggcacgatggccgtgtccaccagttcgatgctggtttcctccgaccgcggcggctatgtgtggggcaccgagggttatctggtggtcaccaatatcaacaatcccgagtccatcgacatctatgacaacgcccacaagcccgtgcgcagcattgcggtgccgccgcagttgaccggttatgagtatgaggtggccgacgcggccaacgcgctgctggacggcaagatcgaatgcgaggcgatgccgcacgccgacaccatccgcatcatggagctgatggatgcgattcgtgaccgttggggcctgaagttcccgtttgaatcctgatttcagctcccctccagaggggagctgaaattattccgctgaatctgcatctccttcaacaatctgctcatacagccgtacgaggcgttcgtcgcgcacggctttcgttaattcgcactcccatacggtaattacacgccagccagcggcctccagttcggctcgctgcgcgatgtctcgattgtgattgcgcagtagtttcgcctgccagaattccacgttcgatttcggcatcgaatgtttggaacatccttcatgcatgtgccagaaacagccgttgacaaacacgatggcgtggtatttcggcagtactacatccgggtgtccggggtaacgcttgtcgttcttgcggaatcgcaaccccttgcgaaacaggtagctgcgtaccagtacctcaattttggtgtctttgccacgaatatgcgacatcgtgtacgaacgggtaccccgctcatacttctccactggctgtttcttgcgattcacgcactccagactaccgtgacgttgcggcgagaatgagagcctgaacgaacgatcacccatcttgcccgtccgtgtctcttatcgcgggcaacaatcatctgccggtcgagactgcccgattagactgagttcaatggatgacatgacgattcgtagggccacggcggccgatattccccagatcgacgaactgctgcggcaggtgctcgaagtgcatcatgccggccgaccggatctgttcaaaggcggtgtcaagaaatacacggacgaggaattgaaggcgattctggccaacgatcagacccctgtgttcgtggcggttgcgccatctgccaatgacggcaatgacgccgaacataacgccgactcccccgccaccgaccaagtgcttggctacgcattctgcgtgttccagcagcacctcaacagcaatatcctgaccgatatcaaaaccctgtacatcgatgatctatgcgttgacgagtggtcccgcggccaccatgtaggctccaccttgtatcgctacgtgctcgacttcgcccgtcaatccggctgccacaacgtaacgctcaacgtctgggcctgcaaccccaaagcccaagccttctacgaacgcatgggactcactccatattacatcggcatggagcaggtgctgtagcgccgccgtttcagcagcacgatgatggcgatgatcgcagcgaggctgcatagggccacgccatatacaaagcccggagttccgaaattcatgaggcagattgtgatgttaccggtagtggttaccgaaaacacgacgataagcgcgacgatacgaatcatatccagcagtccagctgcttgagccaacagacgctccggtaccaccaatttggccgccgtgcacagcaaagtcgcctgaacggcgagcagaatcgcccattcccagaacatggacggttctttaagcaacgtggtctccggaaacatagacaccacctcattgataaaccacggcgccacaacaatctccacatatgcgagcccaatacaacacacgacaagcaccacggcaatggcatagcgccaagcgacgtctgttttgcgagatttacgagaaatgaatgcgataccagcgttcatggctatgctccttaatccaatatcaatatcaatggatgaacctgcactgcaccgtatgccaccatcataatatatcgaatatcgatataaaaatatcgaaaaacactttcaccattcacctacacatccgcaaacccatgaatacacatgttcttaatcgggatggggagtgcacaaagaagctctgtcaccccagcagattgaggagatcgtccttggtgagggtggcgatggaggcgggggcttcggtgagggcgctggcgccggtgccggcttcgtcggcaagcaaggaagcgtcggtgaactggcgggcgagctcgctcttagtatgctgaagctccaagatacgttcttcgatggtgtccttggccaccacctgatacacgttgacgtcttcggtctggccgatacgatgtgctcggtcggtggcctgatcctgtgcggcggcgttccaccatgggtcggcgtggatgaccacgctggcaccggtcaggttcagtccggtgttgccggccttcagggaaatcaggaaggcaggcgtatcgtccgcattgaactggtcgacgagttcgagacgcttcttcttgggcgtggagccggtgatggtgtagtagcgcaggccttgcgcgtcgaaacgttcggcgatcagatcaaggaagctggtgaactgggagaagatcagcgccttcttgccttcgttcacacaggtttccaccagttcggtgatggcggcaagcttggccgattgatccttggcatcggcgtacagcagcctcggatcgcagcagatctggcgcaacttggtcaactcggcgaggatgcgaatcttcgacgtgttgaaatcggcttcttcgctgtgttcgagctgcattctgagccgctgctcgtgagccgcatacagtttgcgctgttcgccggcaagccgcacggtcagcgtggtctctagcttgtccggcaaatcggtcaacacctgggacttcagcctgcgcttgatgaacacgcccaccaacgactgcaattggcgagatacccgagcggcctcaggattgacttgtgcggcggcccgaccttcagccgtgctgccatccgcggcccgggcattggagatgggcaactcataacgctcatggaatcgcttatatgagccgagcagccccggcatcaggaagtcgaaaatgctccatagttcggagagtcggttttcgatcggcgtgccagtcaaggcgaaacgatggtcggcggccacggccttgaccgctttggctattttcgtggtgtgattcttgatgtactgggcttcatccaatgccatgacattgaaacgttgctcattggcggtgtaatcatcgacatctcggcgcagcaggtcgtatgaggtgatgagcacggtgggttcatccgcccggaacgcacggccgatggcggtacggcgctcggctttggtaccggccaccaccacggcattgaagctcggggcgaacttggtgaattcggcaccccagttgtacaccaaggacgccgggcacacgatcagcgatgggccaaggctgccgtcgcccatctcgccggtattccgctgatatcgagacaggagcaacgcgataagctgcacggatttacccaagcccatctcatcggccagaatgccgccaaaacccttgtcgcacaacgtgttcagccattgaaagccttcgacctgataagggcgcagaatatgcttgagactatccggcacttcatacgacttagggtcgatgatcttgagatcgtcgatgtattcggtgaacgaagcgtccttgactacatcggagccgtcatccggcagctcaccatccagtaggaatgctcgaccgcccggcaactcgatcagtccggagttgagctgctgctcgctcagatcgaggtcgctggccaatcggtccaacgtgctgagattcgcgccgctgagtttgacaagcgtgccgtccttcaactgatggaatcgttgacgccgacggtacgaagatagcaaggcacccacttcgtccggcggcacttcatcagcgaggggtgatatctccaccaagttgcctttgatggacaatccgactttgacgcttggtggcttgggcgcgatcagccggtcaaaagccggtgtggtgaagacctcccccacttcctttagtgccggcaatccctcgtcaaagagacgaacgatctgcgtggtgtcatcgcgatcgatagtggccgcatcagacacgaattttttggtggcctttcgcgcggccggcgttcggaacccattcaccgtctgatgagtggcggccgcaacgcgcttgcgctggtcaggcatggtaaagaattcacgcactacatcaatcgcaagatgctcagcgtcgaaatcacgcccaatcacgccccgagacaaggggatggaacgctcgccctcagcatgcaccgtcgggccatcgggtagcaacgggacaatggcatcgccgtagcgtgccttgacctcgcattgcacaccatgctcatcacgatccagataaaactggaggctgcattccgtaggacttaattcagccagctcgcgaggaatctcactggcctccaacagtccggcaccaaccagctgaggcaatagcgtgcgtgcgaatagggcgatgtcatcgccggcaatgacctgtccctcgccatcgggttcaaacaggtctcccaatagtcctcgcaacggaatcaatcgtttcgggcaacggacgaatcggcatcctgctgcgcttttacgctgagagcccgccaccatggcggataccgcaccggccggattagtggaggcgagcaacagccatacattcttgccgccgtcaatcacggtttccaccgctggcactccggtaagcaggtatccggcatccggaccatacgtattgaaatcacgccgcgcaatgcgcatgagaaaatctggctcgccaccatcaactggcaccgatgcaggctgcccggagaaccatgtgttcagcacgagctgtacgcctctgccctcacgtacggacagcaaccgggccacttccggtgctgaaagcgtcagatgacggtcgatggcgatatgcccgtaatacctgtcctgctgctcggccgcacgacgcacggccatcgcatcatcaaggacgtccagcagggggcgcgaatcatcatcgagcatatccggcgtatgaataaaggcaagcttctgcccataatccgcatagtcgccgttcgccatggcaagcacaaattgcggaatcgatttcagcacatagctggacccattggaagccgagccgatcttgaactccacgctccacacgccgtcgatgaaactcaatatcgggacaagctgcacctgccccaagcccacagtctcgctgtcaccctgatacccgccgcctcgggtgccggcacgagagccgtatccgctttttgtacgccgagcatttgcaccgtttttcccttgcgtggcatcaaaccgacgcataaccgcattgcgacgacgaattttggcttgagcgtcttgcctatcggcgtgctccatatagtcaatcagcgtccgagacggtcgtgcggccccggcacggtagccttcaaaacgctgcggatcatcgcagaatatgaaggcgagcgcaatcatgtgcttgcacatgccatagccacggccgtaagccgggcatgagcacttgccgccgacggcttctcccgtatcgaggtcgaattgcacgctggtacgatacctactcgatgggctggtggtgccacgtagaataccgtcaagctcggcatacccggttcgatgattttcgctgtataccggattgataaccatggtggccgctttgcgcgcaatgctacgggcacgagcgagcacggcattcgacgatgacgattccacatcgttgcgtaacgcaaggatagggacggcatgggcttcggcacgcttcgcagacccggcgaaatggccttcgtcctcatcgtcgaaccatacggaacgtccttgcctgaaacgatagggcatcaccgcatcggcggcggacaaactgtccgttccaccaaacgttacgtctctgctgccggccgcgcctgagctaccaagtattccacccgtctcaccagaaatgccgcctactccgccgcttttaccggcatagatgcccctgcccccattagtgtcatcagtgtcatctatgtcataccgaccgtcgtcgtaatcggcatcttcgtcgtctcctcttttccaaggattgcgacgacgcaacgcatggccccaggaaacgccggaatcatcatcctcataaggcaggaggccatcgtcatccgcattatcgggaacatggccaaacacaccataccctttgctcatgggcgagcctcctttccagcgaatgtatttcaacccaacgtttccatcctagacgaagcgcgcggtagccttaatgtatggatgcagacaagccggcgcaacgcaaatcctatgcagggaacaccaccctcgaaatcttcgaggtgctgtggcgtcacagttactttgggcatggcctgaccgtgcggcaaatactcgatgagcttgcccgtaaacaccagctggaagatccaagcgagctgccgaccgagaagaccatacgaaaccagctcaaaaagctgacctccacggaatttctcggcagacatatcgggcatctcaccgaaagcgaccttgccggcatcgaatgcaagaatccacaacccggctggtatcttgatgcattcctgtccactgccgaaatgcgactgctactagacagtcttaccctatctcgcatcagcctcgacaccatggacgacctcatcggtaaaatccgcgagctcgcaggcgccgccgggcaggcagtaggctacctggaccatgtggccacctacacgcatatcaacggtgagttcctatccactatcgaccagctgaatcaagccatcgaagaaggccacggcgtaaccttccaataccgtgattacggaccggatggcaccttgataccgcataaaagccgtacgggtgcaggccgaattacctacaccgccgacccttaccaaatggtgtacaagaacggacgctattacctcatctgccacctgcatggcgaagacaacctccgcattttcgtggtcaaccgaatcgccaacgtcagcgccaaaggcaggaacggcacagtgccactggaaaaaccagcaccagctgattttgacgcagtgaacttcatgcgccaccgtccataccccgtagccgatgccccgattcgcatccgcatggccgtacgagacgaatccatgctcaacaacgtgttcgaatggttcgacgaccctcaaatcaaacattcaccggacggcacacagttcgaagtcatcgtcgatgctcccgaacgcgctgtgttctggtgggcattgcagtattcctgggatggccgcgtagtgattcttgagcccgattcgctcaagcgcaaactctatgatgccgggcgtcgcatggccacagcctatgctcccgaatgatgcaacatcacatcgcacacctccttgtcgagttgttcaccagcgaatttcaccggagaacctatcatcccatcgccaatcacactcggtaattttttaccgggaaatacgatttcaagccatttcgcgggcatcgtccctcacctaggcgcacataaggctaaggtgggaatcattaatcgcatcgcgcgtccacaagcgtgcactagcgcgtacaacaataaggagcaactatgagcgaagagcgtaccgcatggggctggggtctggccagcgtagacgccgccggcaccaccctggacgtctggtaccccgaactgaatctcggtgaggcaccggccgagtccgatcgcccgaaccacaatttcggtactttggctcacgatgaggccgacgcccgtggcattcgccgcgtgccggtattcgtcgtcagccagttggacgagccgatcagtaatgccgcagacgcttacctgaagctccatttgatgagcatgcgcatggccaagccgaacacgctgaacctcgacggcatcttcgcccagctcgccaatgtggtgtggaccaactacggccccttcgccgttgaagacttcacgctgcgcaaggccgacgtcgaacgcgcctccaccgaagccgctctcgctttcgcctcccaggccggactgcctgccgcagctcctgccgccactgtcaacgtgttcggtgtggataagttcccgcgcatgatcgattacgtagtgcccaccggcgtgcgcctcggcgacgccgaccgcgtgcgcctcggcgcttacttgtcttccggcaccaccgtgatgcacgccggattcgtgaacttcaatgccggcacgctcggcgtttccatggtcgaaggccgtgtttcgcaaggcgtggtcgtgggtgacggttccgacatcggcggcggtgcctccatcatgggcaccttgtccggtggcggcaagctgcgcaattccatcggcgagcactcgctgctcggcgccaacgccggtatcggcatctctctgggcgataactgcaccgtcgaagccggtctgtacatcaccgccggcactaagatcaccatctgggacaaggccaaggccgccgctggcgaaccgctggaagtggtcaagggtgctgagctctccggcaaagacaacattctgtttatccgcaactcggtgaacggccgcatcgaagcccgctaccgcaaggtgggaattaagctcaacgccaagctgcacaagaactgaaattgaaataatggagcgttatcttcgttgcccctcggtcgacgtaccttcgtacgccttccctcggtgcgcctcgataccgcacacattatttcaatttcagaactagccctgctagttcttatgcagccgtcgcagcatagctggtttgcgctgtacatatagaaagcgcctcactggaatctccagcgaagcgctttctcaaaccaacaatcaccgctcgtccatcggcacgaaatcgcgctcgaccggaccggtgtagacctggcgtgggcggccgatcttggtattcgggtcggccaacatctcacggtactgcgcaatccaaccgggaatgcggcccagcgcgaacagcgtggtgaacatggccggatcgaagccgatcgcccgataaatcaagcccgtgtagaagtcgacgttcggatacaggttgcgcgatacgaaatattcgtcattcagcgcaatatcttcaagctcggtggccacggcgaacagcgcgcgctcgtcagacggcagcttctgcgtatcttcgcgctccatgatcttttccagatacttcctggcaatcgccgcgcgcggatcatacgacttgtatacacggtggccaaggccggaaatcttctggccattctccttggcatcacgcacgaactcggccacagacttgccggaatcacgaatcgccttcaattggcgcagtacggcctcattcgcaccaccatgcaacggaccagacagcgcattgacgccagcggccaccgccgaatacaggttggcgtgggcggaaccggcgatacgcaccaccgaggtcgagcagttctgctcatggtcggcatgaataatcaacaaacgacccaaagcatgcacatacagcgggtcggattcaaacggctcgtacggcacagcgaagcacatgcgcaggaagtcgtccacatagccgcgcgcgtaatcggggtacagcatcggctcatcgcgacgacggcggaagatgtacgacacaatcgtacgggccttggccatgatgatcttggcggcctcatcaagctggtcgttgtcagaaatatcggtggtgtccgggtagaacgtggccagcgcattgatggcggaggcaagcacgctcatcgggtgagcggagcgcgggaacgaacccatgaaggtacggaagtcttcgccaaccatcgtcttgtgattgatgtccgcacagaactgctcatactcagccctgctcggcagctcgccgtggcgcagcagccacgccacctccagaaaatcggagttctcgcacagttgctcgatggggtaaccgcagtagcgcaaaatcgaatgcttgccgtcgatgtaggtgattttcgattcgcactgcgcggtggtgaggaatccgggatcaagcgttacccagccatcgttgcgcagtttggaaacgacgatgccatccggccctgcactagccttaaccacgggcaggttgaacttgttcgaatcgacatcaagttgtgccgttgccattcgcgcaccttcctcttcatgaaccacttaccccaaacattaacgttcacgcgttcgcgaacactagtgttcggtactctatgtcttctgtgttaccgctggcgaatgccggtcgatacacgaaagccgaagtgcgctcatgctatcaaagcaaacgcacttcggcttgttacgtctcgaattcgcgggaaaaccgcgaacagacggacggctaatgagacgctgatcgcccatcacaggccaatcaggcacctaccatacgccaaacgccgatcagaggttggtgcgatcggtgaagacgatcgggccgttctcggtgatggcgatggtgtgctcggagtgggcgccgcgcgagccgtcggaggcacgcagggtccagccgtccttcggatcctggaagatctcgtcggtggtcttgaggaaccacggttcgatggcgatgaccaggccttcgcgcagcttgtagccgtggtgggcgcggccgtcgttcggcacgtgcgggtcgccgtgcatgatgtggcccacgccgtgaccgccgaactcgaggttgatcgggtagccgtattcgcgcgcgacgtcgccgatggtgttggagatgtcgccgagacggttgccgggcttggccacgtcgatggcggcggcgagcgcttcctcagtgcacttgatgatgcgcaggtcttcggggtccgggtctttgccgaccacgaagctgacggcggaatcggccacccagccgtccacagagatggcgagatcgagggagacgaggtcgccgtccttcaggctgtagtcgtacggcacgccgtgcagcacggcgtcgttgacggaggtgcagatgtagtgggcgaacgggccggtgccgaagtcaggagcgtagtcaacatagcaggattcggcgcccttgcggtccacgatcttcttgtggacgaactcgtcgatttcgagcaggttggtaccaactttggtggtctcctgcagttccttcagaatgccgccgacaaaacgaccagccggcttcatttcctcgatttcacgaggggttttcagttcgatcatgagattctttctaccttgttgagacttgttctcaactctagaccagcccgaggtcaaccgccagaagcctacctgaaatccactcgcagcccattaatagccaaggccgagaaaaagcgcccggcagcacatagcctgcacgggcgctttggattgattgtctggggactggttgcatgaagcgtgagattacttgcgacgcttgccgaaagtgaacgcgcgaatcactgaagtaatccccatcaccaccatggcgcatccgccgaagataatcatgaatacggcggagctcagcgggctcatcagcaccacgaagccggcgataatcgagatgatggcataggcgatggcccagccggaatgcgggatacgccacgattcaaccagcgacagcacgccttccataatccatccgaaaccgaccatcaaagtaatgagtaatgccagcgtctgaccggtcatgccgtagttgcgcacaaccaccacgccgccaaaggtcagcagaatgccgacgaacacgtccagcacacgccagccgcccggcagacccggctccacgagagcgctgacgatgcgcaccacgccggaaatcacgaaatacacgccgagcaacaatgcggccaaagccagcgtcttgttcggcaccagcaacagcgcagcgcccaaggcgatggcggccacgcccaccacgccgtaaatgatgcgaatcttggtcttggctttttccggcagccattcctcgatcaggcggaatggactgaaattgccgacataccagttggtctgctgccagccgggttgactttgatcgccccatggaccattcggctgcccgtccgcttggctattcgattggccgtccgcctgataccgccgaccgtccggcccccatgccggctggccgttcgggtcatagttcggattgtaggcgtacgggccgtagtacgggttctggttcggttcgccttgtggctggccgttctgcgcatgctgattctgagtgtcttgcgctcccggcgcaccttgcggaggatattggccgccatgattgctgtcatacgcaccatactgcggttggcccggttgacccgccggattcggctggttcggctggctctggttgggctggcccgtctggccattccactggtcctcgttcggattgctcatcgtaactccttagctcaaggtccatgttcagattccacatactatgatagacaagttgtctaatttgaaccatcaccacaattaggcaatctgtctagttcactgacagcgcaatgcccataacgcaatatctgcaccatcaacgcttctcccccgccgcgattaggcttagggccatgaccaacgaaaccgaaacgctgacgtcgggcatcgacccggcatcgttctcctccgtcatcaagccgaccaacgacctgttccgctacgtgaatggcccatggatcgacacctaccgattgcccgacgatcgttcgcgctacggctccttcgacaagcttgccgaagacgccgaaaaccaagtacgcgacatcctcgacgccgacgactgcccggctgtcaagtctgaggccctgtaccgctcattcctcaacaccgacgccatagaggccgccgggcttgacccaatccgcgacgagcttgacctcatcgattccgccatcgacaaggccgcactcacgcgcgtgctcggcacgatcaacccagccggcggccccgatctgttcggcttggccgtttacggcgacccgggcgacccggaccgcaacatcgcccaccttgagcaggccggcctttgtctgccggatgaagcctactatcgcgaggatcactacgctcccgtgcgcgaagcatacgtggcgatggtcgccacccagctggtgaacgccggatacgcgcccgccgccgagtccaacggtggcgatgagctgccgtccaacaccggcgatgacgagagcaacgctcccgccacggttcccagcgaagccgcgctcggcatggcccgccacttccttgccgtggaaaccaagatcgccgccaaccattgggacaatgtggccacgcgcgactcggtgaagacctacaaccccaccgattacgccgatctggccgccacgctgaaaaacttcgatctcggttcttggatcgacgcttggcagaccgcttatgacgccaccgaagccgccaaggctcagccgattgatttcaagtctgtgttcgcgcgcgtcattgtgcacgagccgagcttcctcactggtcttgatgcgttctgggccgaggccgatctggccgaccttaagctgtgggcccgtgttcacatgattctgggcttcgcctcctccctgtctcgcgacttcgacaccaccaactttgacttctacggcaaggtgctctccggtgccaagaagcagcgcgatcgttggaagcgcgcggtgagcctggtcaacggcatttgtggtgaagatgtgggccgcgaatacgtgcgcctgcacttccccgaaagctcgaagcgccgcatggaagagctggtcgccaatctgattgacgcctaccgcgtgtccatcaccaattccgattggctgggcgaggacaccaaggccaaggctctggagaagatctccaagttcacgccgaagatcggctacaccaaccactggcgcgattattcggcgctgagtgtttccgcggatgcgctgcccgccgagaacgccaaggccgcgaacctgtacgagaccggctatcagctggccaaggtcggcaagtcggtcgacaaggacgaatggctgatgaatccgcagacggtgaacgcctactacgagccgagcatgaacgtcatcgtgttcccggccgcgattctgcagcccccgttcttcgacccgaaggccgaggatgcggcgaattatggcggtatcggcgcagtgatcggacacgagatcggccatggcttcgacgatcagggttcgcagtatgacggcgacggcaagctcaacaactggtggaccgacgaggatcgcaagaacttcgaggcccgcaccggcgcattgatcgcccagtacaacagctttgtgccgctgcagctggcagagaagtacgctgacgagtctgataaggcgccgcacgtgaacggcgcgctgaccatcggcgagaacatcggcgatttgggcggcgtgaacatcgcgctcaaggcgtatgcattcgcgctcggcaaggcggcaggtaagcccgacgccgaagaagacggctcccccgccgccatcaaggcactgctcgataccgcccccgaaatggacggattcaccggcctgcagcgcttcttcctgagctacgcctccatctggcgcaccaagaaccgcgacgagctggccgaacagtacctgcagatcgacccgcattctccagccgaattccgcaccaacggcatcgccagcaacgtggacctcttctacgatgcctttggcgtgaccgaaggcgacgccatgtggctcgcgcccaaggaccgtgtgagcatttggtaatccccgttatgtaagagaaaaccgctgtgcttgcctcgattacaggcgaacacagcggtttttcatgatgtatggttggcactcagaattcggattcgctgggatcggaagattcggcgaaaccgtcgacgtaggtttgttgggctgcggactgtggctgattagcgccagcgtccggttgcgacatgacggcatcggccatggacgcagccgctgactcggttgatggcgacggcgattggccggaatcggaggtgaccccaaattcgacggggccagattccgacgaggtcgcatacgggtcaatgcccacaccggatgcggcaccgtccacactatattgcgttggcctcatgtgcggtgacgatgctcgttgcccgtttccgccatccatgccttcggcggcaccattgacattgccgttaccgttgccaccattgcctccgttcccattaccggcacgctgtggcttgatcagcgacgtggtgccgaaggtcaggtcatgcccaatgttggtggcttcgagaacggttctactgcgcggttcgccttgctcattggtccactgctcggtgatgagtgagccgaccacaatgatgcggtcaccgcggcgaaccgaactggcggcgttcacggccaaagcacggaacgctttgacgcccacccatgcggttccgtaatcctcccattgtctggtagtcgggttgagtcgactgcgggtgctgcccatacggaatgtcagcacgcggaaactctcagttccgcctagtgtcggatcaccggccacaaagccggtgacggtcactgctgcttgttgatttgccatgatcggtcctttcctcggcctgctggcctgttgtttggatgtggaccgccggagcctgtctccggcttcattgccggcttgcacgccccagcggtacctccactgtgaggcatgacgtttgaagcgcacaagggcaactggcaaatgtggatactgtgacgcagttgaaattttaagaatgtggataagtttcggttatccacaacaaagcgccattctgcgactgggcagaatggcgcttgatgcgattaacgccgaggctgagtaagtgggactcagctgagggcggcgaagcgctcggcgagcgcgtcggcggcttcggcggcgggcacggcgaccttgttttcgccgttgcggtcgcgcagttcgatggtgccgtcgttgacgtaatcgcggccgaccacggcgaccagcggcacgccgatcagctcggcatccttgaacttgacgcccggagacaccttcttgcggtcatcgtaaataacctcaaggcccttggcctcaagctcggcgaccagcttctcggcaccttcaaacgccacggcgtccttgccggtggccaccacgtgcacggcggccggggcaatcacggacggccaagccaagccggcttcgtcgtggtgtgtttcggcgatgcaggccagcacgcgggaaacaccgatgccatagcagcccatccacaccggcacggccttgccgttctggtcgagcaccttcaggtccagtgccttggagtacttgagacccagctggaacacctggccgatttccacaccacgctcgaagctcaacggaccggaaccatccgggctcatgtcgccgtggcgaacctcaacggcttccaccacgccgtcgaccttgaagtcacggccgtacaccaggttgtagtagtcgacctcgttctcatcggcaccagtgaaccaagcggaacccttgaccacgtgcgcgtcgatcaggtagcgaaccgggttcttcacgccagcagcctcggcctgcgggccaagcaccatcggtccgatgtaaccgggcaccagttcggggtgctgcttcaggtcttcctcagtggcttcctcaagttcggcgggcgcgaactgggcttccagtcgcttcatatccaccgtacggtcgccgggcacgccgacgacaatcacttcacgccacggctcgtcatgctcttcatcctcagggtgcttgacggtgatcaccacgttcttgaggatgtcggaagcctgccattcacggccatcagtacgcgggtggtcggcgttggcacgctcgatcatgttatcgatggtcttggcatccggggtggcttccttggaagcggcgggagtggtggaagcatcgatttccggtagttccggagtgctcagggcctccacattccatgccttgccggaaggtgccagcgcgaaggtatcttcgccgatcggcatcggagccaggaactcctcggatgcggagccgcccatcgggccggacatggcgaacacaggtacgtacttcaggtcaagacgctggaagatacgctcgtaagcgccgcgctcgtcatagtaggccttgcgcatgccttcttcatcgatggtgaaggagtaggcgtccttcatgacgaattcacgaccacggatcaggccggcgcgcggacggaactcgtcgcggtacttggtctggatctggtacagggtgacgggcaggtccttgtaagaggagtacatgtccttgaccagaagggtgaacatctcctcgtgggtgggggccagcaggtaatcggcctcgtggcgatccttcaaacggaagatgttatcgccgtactcctcccagcgatgggtggcctcgtagggttcgcgcggcagcagggccgggaagtgcacttcctgggcgccgatgccgttgatctcctcgcggatgatggcctcgatcttgttcagcacgcgcagaccgagcggcagccaggtccagataccgggtgcggccttgcggatatagccggcgcgctgcagcagcttggctgaatcgacatcggcatcagcggggtcctcgcgcagggtgcgcaggaacatggttgacatacgaagggtattggaagtcatgtgttccacgatattcgcgtgaaccgacaagcccgcctgctattcgcactattccgaccttcatcttggcattcggactcactcgtgcaacaatgacggctagaagggtagaagggcacgatgacgcaaccgaccgagcaacaggggaatcagccggaatcctcggagcagccggtgtatcaaccggccccagcatgggccccgcaattttctgctgcagcccccgcaattcccaacggcagttccacaacaagcggtatcgcaacagccaatggccatgccaccgtttgcgcaatcgcctatgtcggtcccggaacaagcggcctgcccgtatcaaccgtaacagccgggccgggcctatgcttctccctgcccctacccgaatccggcaatggcccagccgaaccaaccatcagtcgcgcaagagcgattcgggcgttcgtcgggacggctgaccgcatcacaggttattgagacatgcgccaccattcttgccggcgtaatactcctcggtcttgcatggaccaacccgcaaccgtatgccccggtggatcttatcgccggcctgtccggagcggccgcgctgattgtgggtgtgcgtttgccgcaagtacgcccgatgctgcgtagctggccggcattgtggcttgctttgggcggcatcattctgattgtggcagccgcgcgctatgaggcgagcctcaaatcgatgaggacgattgccgcgcgtattggcgatctgcggtgaatcgcgcgggcgacctgaggcagattaccaacgtccggcgatagcagtcctgcatacggggcagtgcccattgccaccgtatccggcagataaacgattggcaatgattcgataccaatcgcgttccacgagcttggcccggcattcagggtttgggcaatacgtggtatcgccttcacgatcatgcacgttgcctgtgtacacataattgagtccctcttcgagggcgatgtctcgggcgcgggtcagagtctcgtgcggggtgggcggtacgtccatcatgcggtaactggggtggaatgcggagaagtgcagcggcacgtccggacccaagtgctcgcgtatccatgtacattcagcatgcagctgggcgtcgtcatcgttgaatccagggatgagtagcgtggtgagctccacccacacgtgttcgccttctggtgtgcgtgcctcgttgaccgcatagtcgatggtctcgagcacatcggccagatgagtgccggtcactttccaatagaactcttcggtgaagcctttgaggtcgatgttggcggcgtccatggccgcgtagaagtcgggccgggcttcggcgctcatgtatccggcagtcacggcgatgggatggatgccgagcgctcggcaggcttcggccgtgtcgatggcatattcggcgaacacgatcggatcgttataggtgaacgccaccgaatcgatgccccggtcggccgcgacctgcgcgattttctccggactggcttccatgccgagccggtcgaagctgcgggctttggcaatatcccagttttggcagaatcggcaaccggaattgcagccagccgtgccgaaactcagcacactggaaccggggtggaagtggttgagcggcttcttttccactgggtccacggcgaagccggagctgcggccgtaggtgtcggagacgatgagtccgtcgtggtttgagcggacgaagcaaaagccgcgttggccgggcttgaggacgcagcggcgcgggcatagttcgcagcgagcgcggttggtaccgtcgtggaattgcgtttgccagcgggctatggcggggttacgaacatctgtgactgacgccgtatgaccgcacgattcccgatgaccaccctccggcgcttcgcgccacctcttgccagcgggaggagatatggttgctgcgttaatgctcggcataggcggtcacctcgtagcgttgacagtcgatttcgctatcggtccagtcgtaggaagggcggataccggctttggcgagcaggtgagcgacgaaatcgtgcggatcgggcagctcatcccacacttgtggcaggaatgtggcgctgcggccacgacggtcggcgagaatcagaccgtctttgccggggcgtaatacttcctcaagttcagtgcgcgaacgtaccgggcgttcgacgttgctgccgtcccgtttgacggcgtcggtctgaggtccggattgcagcgatgccagagtcgcggtcttcgagccggtaccgcgcgaatcggcgtcacaggagttcactgtaatcggctcgggctcacccaagacggatacctccacgttgagcagcgggtattccgcggcggtgaccggggtgaaacgtgggtcgcgggtggcggcatccactgcgtgctcggccacgtccttgccgagcgagcggtgggcgaccagcgaaccaatgcacccgcgtagccggccaccctcggtcagggtgacgaaacaggcaccgggctcgttcagccatgggtttgcggcaagaatggacgcggtcgaatcagcggcggtcggatgctcgatatgcagccgttcccggatagcggcacgggcaagtttcagcagcacctcaccgtgggatggcgtacccgatgtgcctaagtcatctgcaccggctagagcatctgcttccggcttggattcccacgcggcaaacgagacatatcccactaccggctcgtcggcgtctcgcattgcggggcgaggttggccggcgagcgccaccacgccgtcgtcgccggaagtggaacagccgagctcgaagagcctcatgtccttgcggccttttaacacatccagaaggccgttgatcgggtatgcgccacaggcccggcgagggtgaatcggcagatgcaaagccgcaatgtccgcaatggtctggtcatccaacgcgcgggcgacttcgtgcggatgatagtgcgagagatccgaactaatcacgatgacggtttccgggccaccccacaaagcacgcaacacatcacccacctcttgtggcgtggcatcgcccgcgttcaacggcacgatagtgaggtctgggccgagcacggtctgcaggaacggaatctgcacttctaccgcatgttcttgtgcgtgggttggggcattgacgatcattgcgggagccggcgcgcccggacgggcatgtgtaccggagcgcaatggctcattgacagacaggcccagagccttacgctcggctgcaatgtctaccggcacagtgcccagcggcgtttcaaacgccgctgccgtggaacaggcgacgcctcgcacggccacgcggtgagtcggccctacgattaccgcgcgagtcacgctcccccgcccacgctccaagagcgcgtaagcgagcgcagctgccgtgccggaatatatgtatccggcgtgcggcactattaccgccctcggcacccacgctggaagtgtgggctccaactgttgcagaagctttcggccgtaatcgagctgctggttgattagctgtttgagcgcggtgcggtcagccggataaaacgaaccggccaccgctgacggacgtattgcgccagtgattttgccgctgccgtctgccgcgcttgctgcatctgacgcactagccacactgaccgtatcgatttgcacaccggctcgggcggcctcgcgaacctcattgtttccacgaaatatctcggatagcaccataactaccacctcttattccatggtagctgctacggagcgcttctaaagatcagaacaacgcgtcctgggcgaagtcatcgtcgggattggcaccgaattcgtccggctcggcgggtttgaacgcgtttgcaccttcatcggccaactggtcggaggccgcggccgaggcttcgcgcaggtcgccgtcgagcaccacggcatcgggcgagacgaggaacatgcgttcgttgacgccggccaaatagaggccgcccagcgattcgactcgggacagcgccacatatcccatgcctggcgcgaaggtgcgcttcaggtccatgaccgcacggtcaagcgtcatgccttgcgacttgtggatggtgatgccccacgcgcagcgcaacggcacctggaagacggaggcgagcacggtgtcgccgtccatcatctcccatgtggcctgtttcatggtgacgatgttgccgttctcgaattccacgatcggccagccgcccttgttctcctgtgcgaagccacgcacggtgccgagcgagccgttgacgtactggcgatcggtgtcgttgcgcagggccatgacagccgcgccttccttgagtatcaatcgctcggggccaacatgttctttttgagtcggtcgaccaggttggcagggcctgctgtctcggcgtggaactcgtgtggatcaagcatgatctggttcaggcgcatgtcgttgagattgtcggcctgccggttcaccgggaacaggtggacggcgacctggccgggctcgggcagtttgcccagacgagtgacgagcacgtcacggtcggactgggtcacgtcgccttcgcgaatgtcggtgagcacggtcagcagttcgccggtatcctgacggtgctgttcggtcagatagcagatcaccgggttgagttcgggccataccagcgattcggtgatgaagccttcggggttcaagccggcacgggcataccgttcgcgactggcgatgaattcgggcgtgggggcgatgaggtcgcggttgcgcccggacaccgaaaccggcggcagctggaagaagtcgccggacaagacaacctggatgccaccgaacgggcgtggatcacggcgtacttcgcggcagacttggtcgaccatgtcgaacagccaagcgtgcagcatggaaacctcgtcaatgacgaggatgtccgtggcctgaatcttgcgtttgcgccgggatttgatgagtttgagcaggctggcgctcagggcggtggccacgccgacgccgctccacgaatgaatggtttggccgttgatatgcgtggaggcgatgcctgtggacgcggtgactgctacactggcgccgtcggcccgagcctggcggatgaactcgttcaagacataggtcttaccggcaccgggcgcaccggtcaggaacacgttcgcgccggcgttcagaatggccagggcttcggtttggcgcatatcaacctctctagactcccctcagggaggggagccaagtacggcggactacttattgaggatgctggtggctacgatgtcggcggcgatggccttggatgcggcatcgtccgggccgggggcgggagccataaacgccttacggtagtagcgcagctcgtccaaggactcgatgatgtctgcgagagcacgatggccaccgttctttggcgggcggttctcgtacacggccgggtaccagcggcgggcgagctccttgaatgtgctcacatccacgctgcggtaatgcaggtggctcatgaggttcggcatgtaatggtcgaggaacttcttatcggagccgatggtgttgccggccagcagcgggcgcacgccttccgacgtgaagcgcagcacgtattcggtgaccttctgctcggcctcggccaggctcaggccattctcccactcgttgatcaggccggaacgggtgtgcatctggcgcacgaaatcgttcatatggttcacggccttctcggacggcttgatgacgtaatccacgccctcgtccagcacattcaggtcaaagtcagtgggcactacggacacctcgacgagttcgtcgccgccgaagatatccaagcccgtcatttcgcagtcaatccaaatcaggcgcgaatcctttgcgctgtaagtttctgcatcatggctgtcgaccatggtaagcctcttttcgtcatgtcacccgttattacaagaacagttcagactataccccagcgcatacaagctatctcgagccacatacgcgaaaagggcctgcataagcagacccttttcacaaggaatcaacccctaactagcgcaagctagcgggcatcaaccgatcagttgttgtggaagccggagtagttcggggcttcggtggtcatcacgatatcgtgcgggtgcgattcgcgcagaccggcgtcggtgatgcggatgaacttgccacgctccggcatctcggcgatgttgtgggcgccgatgtagaacatggactggtgcaggccaccgagcatctggtagagcacggcgttcagcggtccgcggtacggcacttcgccttccacgccttccggcacgaccttgtcgctggaggtcacgtcggcctggaagtagcggtccttggagtaggacttcttgccgcgcggggccatggcaccgagggagcccatgccacggtacagcttgtactgcttgccgtgcaggagcaccttctcgcccggggcttcctcacagccagcgagcgtgccgccgagcatcacggaggaagcgccagccacgagggccttggcgatgtcaccggagtagtggatgccaccgtcggcgatgcagggcacgccagcggcacggcaggcctgggcagcctcgtacacggcggtgagctgcgggacaccgacaccggcaacgatacgggtggtgcagatagagccggggccaataccgaccttgacggcgtccgcgccagcctcaatcatggcctgagcaccggagcgggtgccgacgttgccgccgatgatctgcacgccgtcgaaggcggagtcgtgcttcaggcgggaaatcatgtcgagtgccagacgggcctcaccgttggcggtgtcgaccacgagcacgtccacgccagcctccatcagagcggaggcacgctgccaggcgtcgccgaggaagccgacgccggcggccacgcgcagacgaccctgctcatccttggtggcgtccgggtactgctcggtcttgacgaagtccttgacggtgatcaggccggtcaggtggccttcctcgtcaacgagcggcagcttctcaaccttgtgctgggcgagcagacggtgagcgtcgtccttggaaatgttggacgggccagtgaccaggttctccttggtcatgacatccttaaccttcagggtgtcgtaatcctcggaggcgatgaagcgcatatcacggttggtgatgatgccgacgagcttgttttccttgtccacaaccggcagaccggagatgtggaacttgccgcacagcttgtcgaggtcggccagagtgacctcggggttgacggtcagcgggtcggtgatcataccggactcggaacgcttgaccacatcgacctgagcggcctggtcgtcgatggacagattgcggtgcagcacaccgataccaccgttacgagccatggcgatggccatctcggactcggtcacggtatccatggcagcggagaggaccggggccttcatcacgatcttgcgagtcagatgagtgctggtgtccacttcggagggaatgacatccgtctcgttcggcagcagcaacacatcatcataagcaaggccgagcttggcgaaaatcggaggaaggggagcatacgccgattgggcgttcaattcatcgaggtttgtagccatacaaacactatatgaacacgcgctgaccttcacgacacacgcttgtgagcgctcacttatccgctgccgggtcctgcacctcacccgcctgcgagtcccgcgaatccgcaggcgaatcagtcatcgaatccgctgcctgagagccaatcgaatcccggctctcccctactgcagactgcgacttaaccgtagcatgctgcgcgttcttgcgtgcggattcgagcgtcaggttctcggcttggatctcgggaatacgatgccgcagataggggtacatcgtggctatggtcagcaccaccacggcgatgggcatgcccacggccacatgctgcgctttgaagaacagaatcgtcagcgaaccgaatgcgatcagcgcggcccatccccacaggatcagcacggcgccacgcaccgaatgcccgatcttcagcatgcgatggtgcaggtgcatacggtccggatgcatgggcgactggcctttggccaaacgccgcacaatcgccagacacatgtcgagcacaggcaggaacaacaccagaatcggcagcagaattggcatgaacaccggcagatagatgctggcatgaatcgaggccgggtcaagacgtccggtcatcacaatcgaagcgcaggtgatgagatagccaagcagcatcgaaccggaatcacccataaacagtttggcgggatgccaattatgcagcaggaagcccacgcagatacccaccatcatcacgtcgatcagcgtggccaacgaagcataactcggggaagaccgggcgatgatatacgaataggcggcgaacgctatgccaccaatcgccacgataccggccgccaggccatcgaggccatcaacgaaattgaccgcgttaatcgaggcgacaatcaggaatgcggtgatcgccatggacagactcggcgaggcggtaatcagcgaaccgcccaaaggcagtgagatgatctgcaatccgccccaagccacgaatacggaaatcagcagctgaccggcaagtttcagcatccaatcgagatcccacaggtcatcggccatgcccagcagactgatcatgatgccgccggcaagaatcacccacatctggtaattgccgttgaacaatcccgagagaaaaggcagccgactggcgaatacggtagccacggcaaaaccgatcagcatgccaaggccacccatgcgcggcgtgggaatggtgtgcacgtctcgggcacgcacctcgccaaccgcaccgatttcgatggcgacgtggcgaatcagcggagtcaccagccaggtgacgccaccggcgatggcggcaatcagtaggtagattctcatgcgccgagtccaccgccgttgaggtggagggccttgcgaatcacgttttgggcgatgacgccttcacgcaggatctcgatgccgtcgcgcgcgtacggatcggctttgacgacggtgctggagacatggccttgggtgggaccgccgtccagatacaggtcgacttcgctgccgaacgcgtcaaccgcctcctggacggtctgcgcgctttcgtcgccggaacggttggcgctggacgcggccagcgggccagtcgccttgagaatcgcgaggcacagcgccgaattggggatgcggatgccttgcgtgccggggcgaccatcggcggtgtcggccaaagtctccaacgtgcagtcgggccgggctacggcaatcggcgagaacgcgccaggcagaaacgccgccgacaaacgattcagcggggacggcaggtcgagaccgagctcatcaagctggtcggtggatgcgagcagtacctgcaacgccttatagcgcgggcgacgcttgagccggtagatacggtcgatagcggccttattacgcggatcgcacgccactccatataccgtatccgttggaatgacgaccaatccaccatcccggatgacacgcgccgcctgtgccagcgattcatccgtgactttcagcgttgttccgccttccacgctcacgccacctccgttcgcttgtgtattcacaatctaccattgcaccattgcgccccgacttgcatagttcatcatcgctcgtttgccgtactgccgttttccgattcgccccacacgcacagaccgtagatacaatgagtccatccatgctctttcgcgaaattacaggagtgttcaatgagcgaaatcaatgctgaatccaccaccatgcctcccgtcgaactgcgtatgccgcgcgccagcgagcgcgaggagatgctcgccggcaaactgtacaattcggtagaccctgaattgaatgccctgcgcgagaaggccggcgacctgtgcgcgcgcttcaacgccgcgtcgcgtaccgatcatgccgcccgtgccgcgattctcgatgagctgctgcccggccacggtgccggccttgacgtgatggggccgattttcttcgactatggctgcaacatcaccatcggagagcgcgtgttcgccaacttcaacttcactgtgctggattgttgcccggtgacgattggcgacgacgtgctgttcggcccgaacgtttcgctgctgccaccgatgcatccgttgcgttggcaggatcgtaacgtgaggcaggcacctgatggttccgcatacgactgcgagtatggcaagccgattgtcatcggctcgaactgctggtttggcggcaatgtgacggtaatcggcggcgtgacgatcggcgagggttgcgtgatcggtgccggctcggtggtgacgcgcgatattccgccgcacaccgtggccgtgggtaatccggcccgtccgattcgcgagattacggataaggatgcttccgcgctacagtattacgcgcagtgatatatgaatgctcccgctggcgagctgtcagcggagctgactgagggtggttgccggaaatctccgataaccaccctcagcctcacttcgtgaggtagctcccgccagcgggagcatagtaatgtgagacgtcacgcgccgaggtacgccttgcgcaccttctcgtcgtgcagcaggtcggaggccttgccctccatggtgatcttgccggtctcgagcacgtaggcgcgatccgcgatggacagggccatcttcgcgttctgctccacgagcagcacggtgatgccacgcttgcgcagcgtgacgatgatgtcgaagatctccttgaccagcagcggggacagacccatcgacggctcatccatgaggatggtcttcggatggctcatcagggcgcggcccatggccaccatctgctgctcaccgccggaaagcgtgccggccagctggcggcgacgttccttcaaacgcgggaagtagtcgaacaccatctcaagatccttacccagactggactggtctttgagactgaacgcgcccatctctaggttctcctgcacgctcatgcgggtgaacacgtggcggccttccggcacatgggccatgcccagcgtgacgatcttgttcgcatgcgttttgagcagatcgtggccatcataggtaatgctgccggatttggcaggcaccagaccggtgatggtgtgcagggtggtggtcttgccggcgccgttggctccgatcagggagacgatctcgccgtcgttcaccttgaggctaatgcccttgaccgcgtcgatcgcgccataggaaacgcatagatccttgatttccagcatcagcgcgctccttccgtcagtgtcttggcaatgcttggctccggttccgccttggtggtggaatcgccgtccgcgtcatcgttgttgtcgctgcccaagtaggcggagatgacctgcgggttgttggcgatctcctccggcgtgccggatgcgatggtgcggccatagtccagcacctggatgcgctggcatacgctcatcaccaggctcatgtcatgttcgatgagcaggatggcgataccgaaacggtcgcggatcgtgttgatacagtgcagcagatcctcggtttcggtggggttcatgccggcggccggctcgtcgagcagcagcagtttcatgccggtggccagggcgcgtgcgatctcgagcttgcgctgctggccgtacggcaggttggccgcctgggtggtggccagtccctcgaggttgaagatgcgcagcaagtcgatggccttctcgtgcatctcgttctcctgcttccagaagcccggggtgcggaagatggcgctgcccatgtggtaggtgaacgactcatcgaaggcgacgagcacgttctcctcgacggtgagctgcttgaacaggcggatgttctggaaggttcgggcgatgccggcacgcacgacctgataggtcttcttgccgttcatccgggttccgtccagccagaactcgccttcggtgggcttgtacacgccggtcagcaggttgaacaccgtggtcttgccggcgccgttggggccgatcaggccaatgagttcgcccttgttgatggtcatgttgaagttggacacggctttcagaccaccgaaggtgatgccgagatgttcggctttgaggatgggctgggttgcgtcgctcatcgtgaggcctccttcacggtcttgtcgtcggactggtcatgctgcttggcgctggccgcgggtttcgcgcccttgccggcggcgccgcggaacagcatgcggttgaccagacgcggcagtgagaactcccaggatccgaagatgccctgcgggcggaagatcatgacgagcaccagcaccaccgagtaggcgagcatacggtagtcggcgaaggcgcgcagcagctcgggcaggatggtcaggccgatggcggagacgatcgagccggtgagcgaacccatgccgccgaacaccaccatgatcacgtagttgatggagttgagccaaccggccatggtggggttgagcgagccgatgtactgggcgaagataccgccggcgatgcccgcgaagaacgcggagatcgcgaagacgagcaccttgaggtacgtggtgttgagtccggaggcgccggcggcgatctcgtcgtcgcggatggccttgaccgcacggccgtaacgggagcggccgaacatgaagagcacgaccacggtgaccaccatgatccagaacacgacgtacaggttggcggtgcgttcgatgccgatcagcgcctgtccggcggcgcccttgtcgaggcccatgccgccggctaccttgaggttctggatgatcacgcggatgatctcaccgaagcccagcgtgatgatggccaggtagtcgccgtgcagtcgcagggcaggaatgccgatcaggatgccgaacacgcaggccaccacgccgccgatcagcgtggtgagcaggaagcgggcggtggggtcgatggcaatgccggcggcgaccatgtatttggaggtcagtgcggccacgtaggcgccgatggcctcgaaaccgcagcatcccagcgtcagctggccgagcacgccgatggtgaggttcagggaggtggtcatgatgatggcgatgcacgcggtcatcatgatgcccttgatgtaggagtcggccaagccggattcgcacagcgccatcacgatgccgaacgcggcgaggatgccgatgaagcacacaagataggactgtttggtggaaagcattgtcttcttcatctgatcagaccttctccccttcgttcttgcccataatgccggacggtttgacgagcagcacgatgatcaggatggcgaacacgatggcgtcggagaacgccgaggtgatgatgcccgccgtgatggtgccgatatacgccttggtcaggctttcgatcagaccgatggccagaccaccgatcatggcgcccgggatggaaccaatgccgccgagcacggcggcgacgaacgccttcaggcccagcatggcgcccatcataggcgagacctgcgggtaggcggcgcagtacatcagcgaggcgaccgcggccagaccggagccgatggcgaatgtcagggcgatggtggagttcacgttgatacccatgagcacggcggcctccttgtcttcggagacggcgcgcatggccttgccctgcctggtgaatttgacgaacagctgcaggcccaccatgatgaccaggccgatgacgatggtcagcagggtgtctcccggcagcttgagcttgccgaacgcgatggacggcaggtggaagatggtcgggacggtctggaagtcggcgccgaagatggcctgtgagccgttctccagcagcaacgacatggcgatggcggtgatcagggcggtcatggagttgcccttttcacgcaccggcttataggcggccttttcgacgatcacgccgacggccacgcataccaggatggcgggaatgaccgccacccaggcgggcagtcccatggccacgatggccggaatggtgagcatgagcacgtaggctccgaccatgatgaaatcgccgtgggcaaagttgatcagtcggatgatgccgtagaccatggtgtagcccaatgccaccagcgcgtacacgctgccgattttcagaccgttgaacagctggctgatgaacatgatgatctgatcggtcatagctccccctttctatcaatgttgtggttctctaccgctgcgcgcgtagagatattcgtatgtcttgcgattgatggcgcgatacgcccgcgcctggcgatatccgcatatcgacggctgtccttatgcatccgagcccgtgaaaacacgaaagggagaggaccggcaaaaccggtcgctctcctgttcatgcggaagtcatgctaggacatcgtgattatgcggtgggaattcatggaattcacttgggctgcacggtggtgttgtacaccggcttgccgtccttcatttccagcacggtcacggacttggtcggcgagccggacttgtccatggtgaacttgccggtcacaccgtcgaaggtcatgccggccacggcgttgcgcacatcctcacgggtggcgttctcgccagccttctcgatggcctgcttgatcatgtagatggtgtcgtagcccagagcggcgaacgtgttcggctcggcgttgttcttggacttgtaggacttgatgaagtcctgcaccttggtgttggtgttgtcgtcggcggagtagtgggtggtgtagtaggtcttgttgtactgggacttgtcaccggtgagcttgaggccatcgtatccgtcgggtcccatcacgtagccctcgaaacccacggagcgggcctgcgggatgatgtacgggccagccacggagtagtagtacggagcgtagagcagctcggcgccggaagcctggatcttctgcagctgggcggagtactcggtgtcgtcggcggaggaggagctttccttgtccaccacttcgaggccgagcttttcggcggccttggcgaaggcctctcccacgccggaggagtacggatcgccggtgccgtagagcacggccaccttcttgaccttcaggttctcggcggcgaagcgtgcagccacctcaccctggtaggagtccttgaagcaggtgcggaacaggtaattgccggtttcgatggagtcggaggtggcggccggggcgatggtgaccagcttggactggtcggccagcggggccacggctgcggtggtggcggaaatggtcgggccggccacggcgagcacgttgttgtcgccggcgagcttgttgtaggcgttggaggcttcggtggcgtcgcccttgtcgtccatggactcgagcttgaccttcttgccgttgatgccgcccttggcgttgatctcggagaccgccagctcgaagcccttgacctcggcctcgccgtaagcggcggcggtaccggagttggtggtcacggtgccgatggtgatggagtcgccggaggccttggcactggagctggaggaatcatccatgctgccgccggagcagcccgcgagggacaacgccataacagcggccgcgctggccgcaacgaacttagtggagaacttcacgttcatcctcttccttcttccttgggatatttcaacatcgttcatctgtcaaccaacgcgcgggatgtgcgcgtgagacgttccactcacataattcgcataccacagaactacatcacacggcttgtgaccgtcattcacgtctctctcatccgatgtttgtcgcggactgttataaccagaccggctttgaacccgcaataaattgttcttattatgagacagcgcaattacggaaacgagaatacaatcccaaggaaatgtgggattcgtggggcttaggacactgcaaacaggtagcggtcgcgacccgtccagtcctggccggtcgatgcggcagcgaatccggtggcactggcaaaggccacgagacgatccccctgggtcacgtcatgttccatgacaagcacgcccccaggcttgagaagacggcaggcccgctcgataatgcgctcgggaatcaacgtaccgtccatcgagccgccatacaaagccaattccggatcccaatcacgcacttccggctgctcgggaatatcggtctgcggcacgtagggggattggtgatgacgatatcgacggtgccgtccaattgggccaatgtggcgaaggacgtggcatccgcgatttccagatggtaattcgaggcaatggatgggtactttttcgcggtttccgacagattccttcgcgtccattcggcggtgttcggcgacagctccaccgcccacacctggctgccgggcacctcgctgacaacggacagcccaatcgcgccggagccggcgcacaaatcgaccacacaaggatggatcatgccgttttttgtcagccagtcaaggccggcctgcaccacggtttcggtttccggacgaggaatgaacactccgggaccgaccttcaggtcaaggtagcggaaaggagcatgcccggtgatgtattgcagcggctcgcgcttggcacggcggtcgagcatggcacggaagacggcaagctgtccggttgtgccaagttcctcccccataagcagagccctgtcgacgtcgcgcagttcaacgcctgccgcctcggcaaggagcaacttggcatcatgctcaggcgtctcaatacccgcttcgcgcaattgcgaagaggcttggttgatgatgtcggtaataagcactggcggtctccgttgatcggacattaggctcccctcagtcagcttcgctgacagctcccctcacagaggggagccatccggcaaagtcatttctgattggccagacggtcggcctcgtcggcttggatgtcggaatcgatgacggcctgcaggtcgccgtcgagcacggcgtcaaggttgtaagccttgtaattcgtgcgatggtcgacgatacggttttccgggaagttgtatgtgcggattcgctcggagcgatcaagcgaacgtacctgcgagtgacgcatgtcggcggcctcggcggcctcctgctcatgcttcatggccagcaggcgggacttcagtacgcgcaacgcggcggcacggttctgaatctgcgacttctcatcctgcatgttcaccgtgattccggttggcaggtgggtcatgcgcacggcggaatacgtggtgttcacggactggccgccggggccggagctcatgaagatgtcgattttcaggtctttcggatcgatctcgatctcgtcgtcatcctcgtcggcctcggggaacacgatgacgccggcagcggaagtctggatacggccctgcgattcggtgacggggatgcgctgcacacggtgtacgccgccctcgtacttcatcgaagcccacacgccgtcttcgggagcgggcgtgcccttggcgcggatggcgatctgcacgtccttgacgccgccgagctcggtggtgttctcggactgcacgttcacgctccagccacgcttctcggcgtaacgggtgtacatgcgcagcaggtcgccggcgaacagtgcggcttcctcgccgccggtgccggccttgatctccatgatggtgtcgcgcgcatcatccgggtcacgcgggatcagcgcggtgcgcagcttctcctcgacaccgggcagttcgtcttcaagacgcttggcttcctcggcgaagtcggcgtcctcgccggccatctcctgagcggctgccagatcgtccttcacctgcaaccaggctttgtaggcacccacgatggcacccagttcggcgtgacgacgacccagcttgcgcagcttgtccgggttggacacgacttcggggcttgccatctgttcttcgatggactggtactcctcaagcgcggttgccgccgccgggaactgttcgtctgccataacacactttcttctgtatggtgctgttctgttcgattattcgattgcgcaggtcaatgctgcaacaaaacttgtcaaagaatacaaaaaacgccagtcctcgatcgggtatgccggagcatgccaaatcgaatcggactggcgtgaagtatgctacttgctcttcttgccgtagcgcttctcgaagcgagcaacgcggccaccggtgtcaagaatcttctgcttgccggtgtagaacgggtggcactgagagcacacgtcaacgaacatgtgatcttccttgccagcggtgcgggtcacgaaggtgttgccgcacgagcacgtcacctcaacggggtgataatcaggatggataccctgctgcattttacgtctcctatggattcgggggacccgggtcgtcatgcccctatggcaagacgtgaaccggaacctaagggattgtacgcgcctatctggacgtgaagacgcgctgcgccgccgcaggagacgacgcaaaagagtggggccgcaggggcttgaaccctggaccgggcgattatgagtcgcatgctctaaccgactgagctacggccccacgttcgctgcgtaaaacagccaacttgccaaagtgtagcacgagcccgctaatgccggcacgcgcgccatgcacccataccatgcacccgccagcaacaagcagcatctcccggcgctacttctcccccatgtaccccaacgggttctcgatgaaccgtcgcaagcccatttcggccgcgccatatagcgagggatgcagcgccaccggcggcacaaacacgcgaatcttcacattcgggtatcccagaatttccgaacgcagccggccttcaagcacggtggccagctcgtcgccgaagtgcgtccacagtccacccaacagcaccgtatcgacatccaccagattcacggcggaagcgatggcggaaaccagcgcatcggcggcctgatcgaccactttggccacatccgaatccccggctcgccaacgctggaggaacatatcgatggcctcgctgctggtggcatccccatcctcggcaatgccggcagcctcgaccaaagcgcgacggcccgcaaacgcctcaagacacccgtgacgcccgcagctgcacaacggcccatccatcgccacggacagatggccgatctcgccggcgaatccgtgcgagcccatcaccacttcgccgtcgcgcaccaccgcgccgccgatgccgatatcggtagacaggtaaataaaggagtccgtgcggtccaccacattcaggaagggcgcacgttcggtggcataccccggaatctgagcgatggcggccatcttcgcctcattgccggccaccacatccagccggcgcaccacgttgaaccgggtgaggttgacgttttcccaacccagattgcgggccaccaacagccacatgtcgtcggtgacgatgcccggcagcgcaaacccggctcccaccaccttgcagccgcgtcgtttgagccggctttccaacgggaaagtcatcgcatcgagcttggcgaagatctcgtacgggtcagtgccggtcatatcctcactcacccactcccggccgagagtgtcgccgttcagatcgagtgccaggcaaccgtaaccatcggtgttgatctgcaggccgatgccggcgatggatccgccgcgaatctccagcggcgtgctgggccgcccatatgtggtggaaacgaccggctcgccttcctgcaccacgccgctttcaatgagcatcgaggccaacagcgagagcgtggccttggtcaggcccgtctccttggccagatcggcacgactcatcggtttctgcgcacgcaataaggtgtcgagcgtcaccgacaggttatggttgcgcagatcctcctgattgatcctgcgtagatttgccattggcccctacctcctcgcacccctagtctcgagcgccgcacaggcgctcacatccgtctatcacaccatgatattgtgcgtcaaacgattgaatcggaccgcaccttcgcgtgtttccgtttgcaatcgaacgttgagatacagtatagtttaatcgtctaacttattggctatggcgcgccgaaacttttgagcgcgaccctcatcgaggaggaatgcatgacgagagtactggttgccggcgtagatacgtcaacccaatcaacgaaggtccgcatcacggacgccgccaccggcgaacaggttcggttcgggcaggccaagcacccggatggcacctcggtcaacccggaattctggtgggaggccttcaccaaggccgccgagcaggccggcggccttgacgatgtcgcggccctcgcggttggcggccagcagcatggcatggtcattctcgacaagcagggcaacgtgattcgcgatgcgatgctctggaatgacaccagttccgccccgcaggccgccgccttgatcgacaagctcggtgcagctccggccgagggcgacgaaccggacgacgtgaccgcccgcggcaagcaacgctgggtcaaggccgtcggatcctcccccgtcgcctcctacacgctgaccaaggtggcgtgggtggccgagaacgagcctgagaacgccaagaagattgccgccgtctgtctgccgcacgattggctgagctggcgtatcgccggctatggcccggtggccgagggcgaggacgctcatctcgaagccctgttcaccgaccgttccgacgcttccggcaccatttactacgatgccgcgcatgacgagtaccgccgcgatctcatcgccatggtgctggcccctgccgagggcgaggaagccgccaaggcccacgccgacgccattgtgctgcccaccgtgctgggcccgcgtgaggcagccgccgtcaaggccgaccccgccattgccggcaaggacgttgaaggcggctgcatcatcggccccggcggcggagacaatgccatggcctcgctgggcctcggcatggccgtgggcgatgtgtccgtatcgctcggcacctccggcgtggccgcggccatcgctgaaaacccggtgtacgacctgaccggagcgatttctggctttgccgactgcaccggtcattatctgccgcttgcctgcaccatcaacggttcgcgcattctggacgccggtcgcgccgcccttggcgtggactacgacgagctggccgaactggcctttaaggccgagccgggtgccggcggcatcaccctggtgccgtacttcgacggcgagcgtacgccgaaccgtccggacgccaccgcctcgctgactggcctgaccctgcacaacaccaccaaggagaatctggctcgtgcgttcgtcgaaggcctgctgtgttcccagcgcgactgcctcgagctgattcgttcgctgggtgccgagatcaaccgcatcctgctcattggcggtggcgcgaagtccgtggccatccgcacgctggccccctcaatcctcggcatggacgtgacccgtccggccaccgacgaatatgtggccatcggcgccgcccgtcaggccgcctgggtgctgtccggcgaggccgaaccgctgacctggcaactcaccatcgagggcgtggagaccggcgagcccaccgaagccgtgtacgaggcatacgccaaggcgcgcggctgatacgctgccagcacaatccatgagataacaactgaataacgattcctgatgaatgccgccatggcaagcatcgcgaagagccgctgttataccgcgctcctcgctgaagcacacatggcggcatttttcgtttcccacgcaatccacaaatgcggctataatcaagtcgtttgaacaagtctggagatgatcctatgaacgaccgctcccgtatgatgctgtacgccctgaccgccgtcgcctgcgtgatgtggatatggcaatccgccaaagaagcaatggccgatggcacgatgatcagcacctcaaacatcatctttttggtatgcatcggcattgccgccgtctactgcgccgccaacgcattgatattgtggtggcgtcaacccagcaaggaggatgcggagaacgatgacgccgcggatacgcctgacggcaccgataccgacaccgcagatgccgagggatccgaggacgacaccgatgacgatgtcgaaaccgacgtcgcaaccacggatgccgatgcatcaccaaccactaatcgccagtaaccatcgttatcgttcgcccgaatcaagcgaatcatcccacttcagcaaaggaacattatggaagtaacaaccgtgtcaaccgtgatcagcgtggtgctgggcgtcatatgcgcgccttgcggcctgtttctggggctcgttcccatgaaggccggcctggtgaccgccaagcagtcaaaggcctcgcagatggtgagcttcatcgttgccatagtgttcatcggcttgctggtcgcaggacatgatctggagacctgggccatggtaatcggtctggtcatcggcttcgccgttgccaagattcccgcgctgcatgcctgggctttgcacaagtggccgttcttcgagcccaagaaagcggctcccgctcccaagcgcgtcaagaaagccaagaagaagtaagctctggccttacctattcgctgaaagcgggatatcgacatcggtatcccgtttttcattggccgtacatatccgctgaggcacatcgccgaatcatattgtcgaaatacaccccaagtcagggctgatttcgcgaagaacgtacaccgggatccatccatcgcgacaaacggaaaagggacgctgcgtgcaacagcgtccctttcggaggaggaatggaactcaggtccatccccgtggccaccgggcgggcccggaggccaggtttagctcagcctttctttttcttggagagcaggtcgtaggcgacggcggcgatgacgacgaggcccttgatggtcttgacccaggcggcgtccacgcccatgatggacaggccctggttgagcacgcccatgatcagggcgccgaccatggcgccggggatggtgccgatgccgccggtgacggccgtgccgccgatgaagcaggccgcgatggcgtccatctcgaactcatgccgggcctgtctcgttaagtgtgtaactggcgttttcattgttgtgttccctcgcttggccagcggtcggcgaaggtgatggcaaaggcgttgagcacgggcttccagcgcgcgctccatcgtatccgtcccttgccggtggggtccagcgagcggacggtcaggtacatgcacttgagcgcggcctgctcgtcggggaagtggccgcgggcgcggatggagcgcttgaatctcgcgttgagcgattcgatggcgttggtcgtgcagatcacgcgccggatctccacgtcatagtccaggaacggtatgaaccgttcccacgcgtccatccacagcctgcggatcgcgggatatctcgcctcccacttgtccagcatcgcgtcgcgggccgccgccgcggcggcggcgctcggcgcggtgtagatgggtttgacatcgcgtttgatggcgtcccagtccttcttcgacgcgtagcggaacgtgttgcgcagcagatgcaccacgcaggtctgcacgatggccagaggccataccgcgcccaccgcgtcgggcaggcctttgagcccgtcgcagatcaggaagaacacatcgtccacgccccggttcttcagctcggtgagcaccgacagccaatagcgtgcgccctccgcggcgggcgacgcccagatgcccagcacgtcgcggccgccctccagatccacgccaacggccacgtagaacgcgcggttggcgacctgcccgtcgcgcaccttgacgacggtcgcgtcgatgaacacggccgcgtacacacgatccaggggacgcgagcaccattcgtccttctcggccacgacccgctcggtgatgcgactgacggtctccctggacacgtccgccccgtagatctcctggaagtgggcgctgatctcgccggtggtcaggcccctggcatacagggacagcaccacctcgtccaccccgggcagccgccgctgccgtttcctgacgacgaccggctcgaacgagccatcgcggtctcgcggcacctcgatcccgaccggacctaccgaatcggtgaccacggtcttggcggtggtgccgttgcgcgtgttcgcggccctgccgtccttggatttcttgtgcttggcgcggcccaggtgctcggtcatctcctcgtccagggccgtctccagcacgcttttggtgaactgtttgagcagtccgtcgggccctgtcaggtccagtcctttttccttggccatgcgcacgaatgtgagcgccgcctcccgctcggcgttgcgtttttccgcgtccggcttcttcgtcggtgtcatgtttccccttgtcccagcagacatcgtccaccagcctttccgaccggccacacgaccggccagttaaggccagttacacacttcgagagacagtcccgttttcagcggaaggagagaaaggagaaagaaggaatggaaaggtgccatgcgggcataacacaacaccgcacatggcgaaactatcgaatcagcccatcgggcgcactggcatcataattgatgtgtacacgcccgatggagcgaattcaatcggtcagaccgatggtcactcgacctcagccagggcatcaatgatgtagttgttgatggtggccttgacggactcgaggtgatcggacttggtggcggcgatgagctcggactgcggcttgtcgaggctgtaggcttcgaggtcggccaaggtgacgttgccctcgtcgatgtccttgccgatgccggagtcgtaggagctgtagcgctcggcctgaagattctggatgaagccgtcctggttcatcttgtcggcaaccagcaggccggcggcgtaggcatccatgccggcgatgtgggagcggaacaggtcctcctcgtagaaggaggtacggcgcggcttggcgtcgaagttcagaccaccgtgaggtccgatggagccggcctgcaggacttcccacatgacggcgacggtctcgtacagatcggtcgggaactcgtccatatcccagccgatgagcttgtcgccctggttggcgtcgagggaaccgaggaagccggactcgcgggccacgcggatctcgtgctggtaggtgtggccggccaggttggcgtggttgccttccaagttcagcttgaagacgtcggtcaggtcgtggttgcgcaggaactcgatggcggtggcggcatcgaagtcgtactggtgcagcgtcggctccttcggcttcggctcgatcaggaactgggcctcaaagccgatttccttggcgtaatctgcgcacatgtggaagaacttggcgatgtggtcggtctcgcgcttcatctcggtgttccacaggttctcgtagccttcgcggccaccccagaacacgtagttctcggcgcccaggcgcttgccgatctccaagctcttcttgagctggccaccggcgtaggcgtagatgtcggcgaacggagaagtggcggcgccggacacgaagcgcgggttggtgaacagggaggaggtgttccacagcagcttgacaccggtggacttcatattctcgtcgatcttgtcaacgaccttgtcgaggttggcgttggtctcgcgcagggtgtcgccttcgggggcgatgtcacgatcgtggaagcagaagtactcgacgcccagcttctggaacagctcgaaggcgtagtcgaccttggccagagcctggtccatcggatcggtgtacttgtagtacgggcggtgcgcggtgccggtgccgaacggatcaaccagttcctggttgaaggtgtgccaccaagcaacgccgaagcgcagccaatccttcatcttcttgccggcaacgaccttgtcggcatcgtagtaatggaaggcgaagtcttccttcggtcctttggcgcggccgacgtactcgatcttgtcaacatcccacagacccatttgggcgctcctttgcagtaggcgatattacggattgcaggaccaataataaaacgaacgaactaagtttgtcaaatgattgaattaatacgccgcgtctcagcgtgttgctagtcattgcaatggttttcgaatgcagtcaaggcacagatagtatgggcaagccaagaaagacaactcagccaaggaaacgagacttgataattgacgtcacgcaattcctcgccggccaccgctgaggccggctccaccaccccgccaaccccaacagcaccacccccgccaacaccaccgccatggtcatcaccctgatgatcggctcgtttgtggccatcctcaaccaaacgctgatgatctccgccctgcccacgttgatgcacgagttcgacgtgcccagcagcaccgtgcaatggctgaccaccggattcatgcttaccaacggcatcatgatcccgatcaccgcgttcctcatcgagaccttcaccacccgccagctgttcctgtacgcgatgggcatatttgcagaatgatcttggcgttaatgcactggtgtccggtctggtgatgatgccgagcggcatcgccatgggcatcctgaacccggtggcaggcaagatgtatgaccgtatcggtggccggccgctcgccttactgggcttcgcgatcatgacgtctgcggctgtgctgctggtcaccatcatgaacacgcacaccgcggcggccatgcgcaccggagtgccggaagcggcggcatcggccattggcgtgcgggcttcgttccgcacggtcgccattgtgtgcgcggtctgtttggttgcgtcactcttcattcgtgatcgcggccgccgacttggacagcagcgttaggcgaatccttcaccgattgctggccttcttgatcagcgcgtccaaagtaccggcttggcgcgcggcttccacatcttcccagtcgagaccggtgtctttggccctcccgtagaaaaaccgcaccagaccggcaaagtccggtttatatccggtttcccggaatgaacgggccagcgaatcaccgatttgcgggtcatcaggccttcgtgcctcatagatcgggatggaacaggatcgccacacgcctctcacatgtgcgatgcgattgacgatcatgccgccgtgcgcaccatcgtattgcgaggcggcatgtacgtccgccacctcgtagacaccaccatgaatgatgtcctcaactgtcagacgacctttgaccgcgctggcatcgcgaatccagaacatcgaagcgaaattggtgtcatcaagttcgcgaaaatcacgtatctcgcgtgtgccgatacgttcgtccttgtcatacatgaattcggccaaggctaggaatggcgagatacctgcgcccggaccgtactgcaattcgatacgtaaatcttcggattcattgccggtcagtccaataccgctgacggcgcagtcataggcaaaccaatcccagaaccaccattcgatcctttgcagcacctgcttcggatactttttgcatgggttcagattcacttcgcgataatatatgcgtctcgcttcggcatagacggcgagattgcagcgtttgaacatctcggctacgtctttggtgtccagcattgctggcaaaccggcattttcggcagtagtagtggttgcggtgctcatggtgtttccccttcatgtgatgtggacggcgggctacgttgcccgccgtgaggcacactgtatggcgctcatgcggtggctcgcaagcccacatggcgaaatggtggataagtggaaaacccaatgattccaaggggtatggaatgtgcataacagtggataccgtcggtggataaccgcactttcttgcaggttatccactgatcgcgcagctgttatccaccgtctctgggttatccacatcgtctctggcgtgtcgtccactgtcagcagtcgatttctgcttcgttttggcgtgtataagtgcacggtgaagtgtataactccgcgcattaggcatatttgctactgagaaaggtcccgaaatcgccttcgaacgcatagctacactcagcagatgtattcagcatggcaatagacccacttaggcaccagcgaatgatttcccccccgcttatagagtcggcaaaggcccaacacctgtcccaacgccgacgctactgcactggcagcgtcggcagaggcccacgacttggcacagcaacgacgctaaaaccgcccagcatcgttacacgtccaagttttggccgctaacgacgcttaatgaacgcttagcgtcggcagcaggtcacgcactggttctccaccgacggtagcgctccttagcgaagccagcccgccactctttggcacatcaccgacgctgagagaacctccagcgaagccaaccagccaaccgctggcgacatgacaccacccacacccctcagcgaagccaacctgccagcgcatggcaccccaacaccgatgagaacacccaccccaccagtgcacaaaaggctggtcatagcggttgcgatgtaatcgcatcgtaatcgcgatgaccagcctcgggagttgggctgcaatgagcaccgatatgaatcagataatgatgccgttgcagtgatcgacttcatgctggataatctgcgcagtccaaccggcgaaggtggcgtggcgggcgcggaaccgacggttctcgtagttgacctcaatacgtcgataacgcagcgtgcggcgttcgccggtcagggacaggcatccttcctgggtatcgaaggcaccgtccgaagcggtaatcacggggttgagcatcaccgttatgcgcccgccaaggtcttcatccacaaagacgatgatgcgtttgcctacgccaatcatgttggcggccatgcccacgcaccgtgaacggttggcctccagcgtgtctacgaggtcttcgatcacctgctcgtcgccgggcccggccgcttcggacggcgtgcgcaaaaacgaccgcgaagtcataataggacgttgcatgctggaatcacgcttcttcgtgccaatgggggttctggccgaaggtgtgaccttcggggttgtccatcgcggcgatatcggccatgtcctgatcatcgagctcaaaagcggtcaggtcaaggttctggcgctggcgttccgggttcagggacttcgggatggccacgtcgccgtattggaggtgccagcgcaaaatggcctggaccacggaaataccgtgcttggcggcgatgcgcttcagatccggatcgcgcagcatctggttggcccggcccagcgggctccatgcctcggtgatgatgccgtgcgcattgtcgtaggacagctgttcgcgctgctggaagtacgggtgcagctcgacctggttgacggccggcgtcacacctgtatcgcgaatgagcaggtcgatgtggccgggcaggaagttgctgacgccaatgtgcttgaccaagccgcgttcgcgagcttcgaccagcgcttcccatgcctcgacgaactggccttggcttgggttcggccagtgaatcagatagagatcgatgtagtcgaggcccatacggcacacgctctcctcaatggtgagcagagcctcgtcgtgagcatggtggcggccgggcagcttggacgtgacgatgatgtcttcgcgcggcacgccggattcgcggatggcgcgacccaccacaccttcgttctcatagttgaacgcggagtcgatgaggcggtaaccctgatggatggcggacttgatggcgtccacaccggctaggccgttgaccttgtacgtaccgaagccggtggcgggcagttcgaggccgtcactggccttgcggatcggagtgactggtggttcatcaagcatgatagttcccctgcttctcctgtgatggaatatcggttccatcataaagccaaccaatccgctgcgggcgtactatttgacttctctcaattccggcggtcggcgagtggagaatcggaacatgagcgcggcgagaatcacgccaagcacggccatgccggtgaacaccatcatgctgcgcgggaacgcggccgtatacgaaccggccgcgtccgccccatcgttcgcggcgatggccaccacccacacattgccggacagcgcaacgaacaccacatccataatcatggtgccggcgaagccgctaaggatgaacttgggcgggaagtggttcttcagcatgccgccgaataccgggccgatggccggtgcggcacaggtggccaggccgactatgccgagcatcgcaccacgctgttcaagtggcgccttctccagaatgatgttggtgataagcggcagggagatgccggtaccgagcgacatgaccagtcgggcggcgagcagcatcgggaagttgaccgcgagcgcgcccagtaatgtgccggcggtgaaaatcacgatggccatgatgaacagtgttttggtggcgaatttgcgcaccatgaacggcgagctcggaatcgacaccgacagcaagagcagataaccggtgacaagccactgcaccaccgaggcgccgatggagaactcctccatcggcgtggagtaggcgatgttcagtgacgtttccgataggatgccgaggaaggtcaggatcgcgagcgagacgaccgcgatgacgagtttgttggagaccggttgcttgccgccgttaggcagctgtgttgcggaatgagtcacgatcttgttctctcctccattcattcagatattctgactacgacgttggaagtcttcctgcatgagtcgcagagcctcggtcaaggtgcgtaccgtggtttcgcactggtccgaggtcaatccgcccagcagttggctcaaatgcgcgtgatattcctccacatagatacggcggatatccaagccgcgttcggtgagcgtgagcgtcaccgcacgccgatcggcggcatcggcgtgtttgacgacgagtccgaggtcggccatttcgccgacgagcttggtgatgctcggcgtagtgacgccgaggaatgcgctgacgtcgcccacgcgcgcggtgccggtatcttgcccattcggttcgttgatatgccagacggcgtcgatcacgtggacatagcgcggtttcatacctttcggcaatgccggcatcagttcggtgatggtcttggccttccagcagacatccaggaggctccgcacctcattcaccggaagcaagccggtcttggtatcggttcgggaatcgcacatcgctggcccaacctccaattagttaccaatagtcattaccataagtaactatatgcaggctctagacaaacccaacggcctgcgcgcccgtgtcgagttccgtttcgacataaaaaagccagggaatccctggcttgcaatgcacatatcgctgcagatttgccgggacctatatgtccccggcaacaacagccgtatatacgctaccgatcagtgctgccctcatcatccttggcacctgccgtggcggcctcagtctccttggcgttccacccggcgacggcattccaaccactccatccgatgaccactagcaagcacagcgagaagacaatagtggcccaattgaacagcgagccatcgttattggcctcgaccagtgactgccagagccagataacgcaggccaagcaggtcaatgcatacatacgggaggtggagcgcgcggtgagtttcatggcggaaaaagtcctttgattacaagaatgacggcagataacagtgtgggatccgcaccagcggcaccggcacgaatcccacatcgaggaggagaaaggggaaggtcagctcttcttgcgcttggacatgatgtccacggcgacggccagcaggagcacgaggcccttgatggtcttcaccacggcggtgtcaacacccatgatcgacagaccctggttgataacacccatcacgaatgcaccgatcacagcgcccgggatggtaccaataccaccggtaacggccgtgccaccgatgaagcaggcggcgatggcgtccatctcgaactccataccggcctgagcagttgcggaagccagacgggagagcatgcagacagcggccactgcggacaggaagcccatgtggacgaacagcaggaagtccacgcggcgggtgttgataccggagaggatggcggccttgcggttgccaccaacggcgtacacgtggcgaccgaacacggtcttggtcaggatgaagttgtagatgaagaccagcacaccgacgatcaccagcatgatcggggtaccaccctgatcagcgttaccggaggaagccagcaggtaggtgacgaaggcgatgacgaccgcggcaagcacaattttgaggacggtcaggctcatcggctcgggcaccaggccgaccttggccacacgggcgcgcttgcgcagctggctccaggcaaagccgacgatgcacaggatgccgagcacaatggtcagaccatcgaacggaccccaccagccaaggatgttgggcaggtagttacgggcaatgccacggaattcgagggaggtaatcggcacggattcgccgacgatcacggtggcgagaccacggaagatcaacatgccggccagagtggtaatgaagcccgggatgccgatgacggcgacccagaagccctgccagacgccgacgatcaggccgacgaccagagcgatgacgatggcgagcatccagttgactccggcgcgttccatcagcagtgcacacacaccaccgatgaaggctaccaaggaaccaaccgaaaggtcgatgtgggtggcgatgatgaccatcaccataccaatggccaggatgatcacgtaagcgttctgctgaatcagggacacgaaggagttcggcttcagcagtgcgccgacaataccgtattgacgggcattgttggcaaccgtggccagcaggccggtcttttcttctttctttgcaggtgttgcagttgcggcgctcatcaggctgccacctccctttccttggtcatacccttcatcaggtattcctgggtaaatccattcttctcaacattgtcggtgacgacaccgtaggacaccgtgtaaatgcggtcacagataccgatgagctcgggcagctcggaggaaatcacgatgacggccttgcctgcatcggcaagcttatcgatgatttcgtagatctcatacttggcgccgacgtcgatgcctcgggtcggctcatcgaggatgaggatgtccggctgcgagataacccacttggcgagcagcactttctgctggttaccaccggagagggtggagacattcacatcgatgtcatggcacttgatgttgaagtccttgcggtactgttcaacttccttgcgctcaaggttgtcgtccacaaccccgcccttgctgatcttggtcagggaggccagggacgcgttctctcggatgttctgcagcaggttcagaccgttgcccttacgatcctcggtggcgtaggcgagacctgcgtcaatcgcggactgcacgttgggcatcttgacttccttgcccttgacgaacaccttgccggagatgttggaaccgtaagagtggccgaagatggacatggccatctcggtacgacccgcacccatcagacccgccagaccgacgatctcgccggcatgcacgttgatgttcgcatggtctacgatcacgcgctccgcgtcgagcggatgatgcacggtccaatcctcgacacgcaggtattcctcgcccggggtattggaggggtggttcgggtacaggttgtgcagcggacgacccaccatcttgcggatgagttcttcctggtcgagcggcgtctccggcgtcacgtacatcacaccgacggtcgaaccgtctcgaatgatggtgacattgtcggcgatggcggcgacctcgttgagtttatgagtgatgatgatgctggtcacgccctgctcgtcacgtagctgacgaaccaggtcaagcaggtgggcggaatcctcatcgttcagtgcagcggtcggctcatcgaggatgagcagcttcacgtccttggacaatgccttggcgatttcgacgagctgctgcttgccgacgccgatgtccataaccttggtatccgggtcttcgggaagtcccacacgatcgagcagcttcttcgcctcggcacgggtcttgtcccagtcgattacgccacccttggcctgctcgttgccgatgaagatgttctccgcaatggacaggaacgggctcaacgccagttcctgatgaatgattacgatgccgtcggcctcggaatcattaatagtatggtatttgcattccttgccatcaaaggtgattttgccggaatagctaccgtatgggtacacacccgaaagcacgttcatcagggtcgatttacctgcaccgttctcgccgcagatggcgtggatctcgccgcgatcgacggaaagattcacatcggtgagggctttgaccggaccgaacgtcttcgtgatgttttccatcgtcaagatggtgtcatttgatgacatgtcaccactcctcgtcacagttctgtgttcatggacatgcggcgcatatcggctatgcgccgcatgtcattgtgtttgtttacggattgcctgatgaggactacttagtcagctcgtcgaagcgatcctgggtgatgtagttggccgtgaccagatcctggaggttgtccttggtgatgttctgggggtcaagcagcttggacgggacgtcgatgttgttgttgttgaacttgccgttcaggccggagacttccttgccctcggcgatctcgacgaccatgtcgtacacggcgtcagccagcttgttcacgtccttgaacacggtctcgccctgcttatccttggcgatgttggcaactgcgatctccatggcgtcctgaccggtgatatacggccaggagtcggtgcccggcttcatgtcgggacgcttggattcgatggcgttgatcacaccctgggcgatgccgtcgtacggagtgaggaccgcgtcgagcttctcgccgtgggcgtaggtggagtcaaggatggattccatgtccttctgcgcctgctcggtcttccagctcatcacggagatcttctgccaatcctcaacggtgaagtctttggtcacgccaccctgaccgtgctgggacggggagacgagcacgcccttctcgaagtacggctgcagcagatcccaagcgcccttgaagaagtacttggcgttgttgtcatccggggaaccggtgaacagctcgatattgaacgggccggtggcgccatccttaagcttgagctggtcaatgagccacgtggcctcgagcacgccgacctgctccagctggaaggtggcgtagtagtcgacggcgtcggtgttcatgatcagtcgatcgtaggcgatgaccttggcgcctgcatcgcgggccttctcaacggcggggcccactgcggtgccatccttggaggcgaccacgacgatcttggcgtcgttgttgaccatgttctcgatgtcagcgttctgctgggccggcttatcgtcggcgaaagacaggatgaccttgtatccggccttctccagcttggccttcaggttgttgccgtccttgttccaacgctcttcggacttggtcggcatcgaaatgccgatagtggcacccttttcgatcttggcatcaccgccagttgcctggccgctacggctgccaccacaggccgcgaggcccgcgcacatggcaacgcctgccaccacggcgacgatcttcttagtgaacttcatttgctctccttcatcttcgaggggatggcgaaccctccttggtcgcccgaacctgagaataacctcaggttcatctcatagaataccgtattaagttaagttgtcaaactcaagaaagcgaatttcccgtcgtttgcgttcgaccaatgaacgcaatggcgatttttttcgcgcatcacaaggcgacacgccgaaaaatccacgctctgcgcctcgctgtgcctcatgccggtaacgactacactggattcttatggcaacaaggcttttcggttcgcagacctcgcttcgcgaggcaaaccgcgccaacttgctggccagcatccacaagttcggcgccatgacacaggtcgaactcgcagaggtgacaggactgtccactgcgaccgtgtccacgctcgtccatcagctcgtcgacgaagaccagctggagaccaaaagcaccgttcgcaacggtcgcagagccactctggtgacccttgcacggcatcagggcctcggcgtcgggctttggatcgcgcgacgtcatcttacgctttctatcgttgacttctcgaagtcaatcatcgctgagcacacgctccccctgccgttgggccacaaggcggacacaacgctggaacgcgccatgctgctcatcaatgagaccctgagcagcatcgacgccgaagccagcgagctggtcggcatcggcgtggccgtggccgcaccggtggccaccagcgaccacaccatagcgattcccggcattctgcccggatgggacggcgtcgatatcacgtccccgttgcgcacggcgttcaacgttcccgtatacgtcgataatgacgcgaatttcgcggcatacggcgaatcccgtatgggcgtggcggcaggcaaacgcaatttcgtatatatctcagccagcgacggggttggcgcaggcatcgtcatcaacggcgaaatcatgcatggcgtgaccggcctggccggtgaaatcggccatatccaggtcgacccgctgggtgccatctgttcgtgcggcaaccgcggctgccttgacaccgtcgtggcggaaaacaggctggtgcagttgctcagcgtcacacacggcaatatgacgctggacgatctggtgtcctttgccaacgaaggcgaccccggttgccgtcgcatcatcgccgacgcggccgtgcgtatcggtcaggtggcggctgatctgtgcatcagcgtggatccggaggtcattgtgctcggcggcaagctggccatgaccggcgacgtattcatccaaccgttcaatgaagcgttgcagcgcatgctgttccctgatgccgtggcacccatcgatgtactcgtgtcatcccacccggacgacaattgcgcgctaggcggcgcattatgcgccatcgagttctcggttcgcaatgacgtcagccagtgaccggtaccaggagaagagtgataagaaggaacacaccatgaggaattcgagcacacctcctctgctgcggctggaggacatctgtgtgaagttcggcttcgtcgaggcgttgaaatcggtgaatctgtccatccagcgccaggaggtcatcgccatcgtgggcgataacggcgcaggaaagtccactctgatcaaggtcatcgcgggatttctgcagccgggattcggccatatttatctcaacggcgaacaggtgaccattccctcgatcagggaggcggaccgcatgggcatcgcatcggtgttccaggggcaggagttctgcgacaacctggacgtggcctcgaacctgttcctcggcaaggagatcaatcagattggcatacgcgatgacgattcgatgaactcgcgtgcccgttccgtgctgaagaccctgagctcggcgattcgggtcggctcccctatcgcatccttatccgtcggccagcgccagaccgtggccatagcgcgcacgctgctcaatgacccgcagcttattctgctggacgaaccgaccgccgcactgtcggtgatgcagtcggcggaagtgctcgcatatatcaagcgactgcgctccgaaggccggtccgtggtgatggtctgccacgatctgccggatgtgttcgcggtatccgaccgcattgtcgtgatacgtcaggggcacgtcaccggcgtgcatcgaaccgtcgaaacgtcctatgaggagattatcgccgaaatcgccggcgtgaccaccgaacacgagtatgaggaaatcgccgagaacccgaaattcgattccatggtcaggcagcggaaactcatcgaccgcactatcagcgcggcagtgagccatggcaccggccatgactcaccattagactaacgccccgttgccggagcggcatcgtcagcgcagagccaggttggcggcaccgatgaggccggcgtcttggccggcggtggcggcgacgatcttggcatggccgcggtaggcgctgccttccaggaaacgctggtagttgtagcgggccggctccagcagaatgtcgccgacggccaccacaccgccgccgatcacaaacaggtccggatcgagcacggcggagactgcggccatcgtgcggccaagccattcgccgatcttgccgaatgcgtacaggccgagcacgtcgccttcctgggcggcctgggagaccatcgggccttccagcttggagatgtcgccgccacacagctccatgagacgcttggcatcctgcggacgacggcgcacggcggacttggcgaagttctccagcgaagtgcccgaggtgtagcgctcggcgcagccgcgcaggccgcagccgcagtggtcgccgtccgggaccatcggcaggtggccgagttcggcggccatgccgaaggagccgcggtacagctgaccgttgatcacgatggcgccgccgaggccggtgcccacggtcagggcgaccatgttggagctgccctggccggcaccgtgcacgtattcgccccagccggcgcagttggcgtcgttctcgacaacgaccggcacggcatggtcgatcagcgcgccgacgtgctcggacaggtcgtagttgatccaggccgggatgttggcggagaaggtgagcgtcttgcggtcggcgctcacgttgccggcggcggagatgccgatggcctcgatatcggtgtgtccggcggccacagcctcgcggtacacctcggcgatgtgctggttgatggcgtcggcatccatcggcgtggggacgcgccagcgctggatgatgctatcgttttcatcgcagacggcggcggcgatcttagttcctccgatatcaatggcgagcgtggtcatggcttactccttgaaggcttgtgtggcgtacgagacagcgaaaatagtaacgagttgccatgacctcccatagcgtatttttcatgatttgtcatatctcgcgcacgttctgccaatgtgaccctgcacacgtttttcaccatttataagcactgttaacgctaacgttgtcattcaatagcaaacgttgtcattcagactatcggcgtgtcgagcagagccccaaggccagcacgaaaccttcggtatttccatgcgatacggcatcggcatcgactgaaacagcttccatgccagagtcgaatggccatcaaacgactaaacaccagacacacattttggcctataaccccatatttcgccctacaccacgaaatacggcaaaagaacaaaaaagctcctgacatttgtcaggagcttggtggcgaccccggccggacttgaaccggtgacctccgccgtgacagggcggcgctctaaccaactgagctacggggccatctgtacctcaatgaagcacaagaggatatactacagcatcactggaccacggcgcgccgcccggcgcgtcgcgccacggcaatgtcaggcccatccattacccctccaagccatagcgacgcccgccattccagcccttccgataccatggtgggcggtggtttggcgtggattcgatcgttatgcggacagggcggcacaggcctgacgcggcgcaccgcgatccgtgattcgggggcgtgctccgcgctgcacacagcgtatccatcacaaactaaagactaaagaaacagcggaattccaacccctttttaaggagtaactgcacaacatggcagaattcgtatttcagatgatcaaggcccgcaagtcttacggcgaccgcgtgattctcgatgacgtgaccctgagcttcctgcccggcgcaaagatcggcgtcgtgggcccgaacggcatgggtaagtccaccctgctcaagatcatggccggcctggagaccgtgagcaacggcgaggccagcctgaccccgggcttcacggtcggcatcctgcagcaggagccgccgctggacgacaccaagaccgtgggcgagaacatcaagatggcgttcggcccgattgccgagaaggtcgcccgattcaatgaaatcggtgaggagatggccaatccggacgccgacttcgacgccctgatggaagagatgggcaagctgcagaccgagatcgacgccgccgacggctgggacctcgactcccagctcgagcaggcaatggacgccctgcagtgcccggacccggacaccccggtcaacgtgtgctccggtggcgagcgccgccgtgtggccctgtgcaagctgctgcttgaggccccggacctgctgctgctcgacgagcccaccaaccacctggacgccgagtccatcctgtggctggaacagttcctgcaccagtacaagggcgcagtcatcgccgtcacccacgatcgttacttcatggacaatgtggccgaatggatttgcgaggtcgaccgcggccacctgtacccgtacaagggcaactactccacctacttggagaccaaggccaagcgtctggagatccagggagccaaggacgccaagctcgccaagcgactgaagaacgagctcgactgggtgcgctcctccccaaggcccgtcaggccaagaacaaggcccgtctggagcgttacgaccagatggaaaacgaggcacgcaacaacaagaagctcgacttctccgagattcagattccggccggcccgcgcctgggttccaccgtgctggaagccaaccacatccacaaggccttcggcgagcgtgtgctcatcgacgacctgtccttcacgctgccgcgcaacggcatcgtcggcgtaatcggcccgaacggcgtgggtaagtccacgctgttcaagaccatcgtgggcctggagccgctgaccagcggcgagctgaagatcggcgacaccgtcaaaatcagctacgtggaccagaaccgtgagggcctggatccgaacaagaacctgtgggaagccgtgtccggcggcctcgacttcatcgaggtggccggtgtggaggtgccgacccgcgcctatgtggccagcttcggcttcaagggcgccgatcagcagaagctgactggtgtgctgtccggtggtgagcgcaaccgtctgaacctggccctgaccctgaagcagggcggcaacctgctgctgctcgacgagcccaccaacgatctggacgtcgagaccttggaatccctcgaaaacgcgctgctcgaattccctggctgcgctgtggtgatttcccacgaccgttggttcctcgaccgtgtcgccacgcatatcctcgcgtgggaaggcgacgacgacaacccggccaagtggtactggttcgaaggcaacttccaggcctaccaggagaacaaggtgacacgcctcggcgaggatgcggcccgcccgcaccgcctgcacaagaagcttgtgcgcggctgagatacgccggcattagtgccacaacgcgctttatacgtcgaaagccgtccctcaggggcggctttccccataattgccccatggctgcccgccccgcatcccataaaatcccacagtcgcctacggcaacacaccggcagcgcagcagcaacgtagcggcaatgcgccgcataacccaccgtttaccttccaaacagtctcgttacatttcgctcccggaactcttaacccccaccggatagactgccaaccataggttggaatacgataaccgaatactgaacacagcagaacaagaatcgaggaacgccatggctcaggcaaccaccgtaactccattggaccatctggtgaaggtgctgaagttgggcgagccttccgcttaccgcaatcacacatatatcaatggcgagagtatgtacttccccaccggccgcgtctacggtggccaggtcatcgcccagtcggtgatcgccgcgtccaaaacagtgggcccttcacgcctgccgcattcggtacatggctatttcattgccgccggcgatattcgtcaagacctgttgtttgacgtcgagaaccttcgcgacggccgctcgttctccgctcgtcgggtcaacgtcacccaagccgaggggtcgattctcacggccatcgcctctttccaggagaccggccaagagggtgtggaatttgccgatccgatgccggaaaacctgcccgatcccgaaacgttgacttccgccaaagaactcatgcagccgttcgccgagaagtcgccgttcgccaattactatgccgagaaatcgccgttcgatatccgccacgtgacgccgaccgtgatgctgcgcgcggacaaggattccgccgagcatgattccggcaagcagatggtgtggatgaaggccgatggccacgtcgatgtgccgcaggtcatgcatcgtgcgatgctggcgcttggctgcgatcaggtgatgatggagccggtgctgcgccgcgccggactgtcgatttccacaccgggcatttcctatgcgtccatcgaccattcgatgtggtggtatcaggatatcgatatcaacgaatggcatttgtatgtgcaggatacgcctatcgccgcgcacggacgcggactcggcattgccaaagtgtatgcgcagaatggcgacttggtggcggccatcgctcaggaagctatggtgcgcgtgccgtaggaatagtcacccctaccgcttgtaggcttgggctatgtcgctacggcgcttggcttccctgattttcgggttttcggggccttcgttcggcggtagctggcacaaccattcgccgataatgccgatgatcatgtcggcgatgcacaccacggccgcaattgcgcactcggtgacggcgtgtgcatagaaatccgcctcgatatggctcaagctcaccacaatctgaccgccataccagccggcgagcgttgcgcccgccaatcccagtgcctttgccaacaccagcgtatacaccgcgatagtgggattgatgaagctatgcggacgtttcttggggtcggtattcgcgtatttatgcacttgcagggccaagatcagcacaataacgcccagtacggccagcaatccgggcacaatccaaggcgcaccaatcagcgacagtcccgagctttcgccgtaggaggccagaccgatacccgccaacaggcccaacacggcaccgatcacatactgccaccatggtgttcgccgtgttttcatgtccggcctccttatcgttgcgttgctgtttgctgtttgcgaacggccttcgcgctttggccgttcatcttgatttgttttttcgtcattgccgtgcctggctgctcgaggccggagactggtccgtcaccgtctggtttctagcctaccgttcgtaactggttccgccatcagctcaactattcgacagtatccagttgtccgatagcaatccgacctgtccggcatccggtgccatggccaaaaggaaggccaccgggtcgccgcccagagaagcattcgggtccatatccagccaaggtgccaataccgacgcatggttacgggccgacggccaaggaatgctgcagttgggctcgtcggaagtcacgccttccatgtcaacaaggtcaaggtcgactgctaggtcatgaacgctttcgatgctgcccaatacggcaatcaggtcggcgggcggcaacttggtttcgatttggatgaccgcgctcatcgcgtccggactgtcgaaatggctgacatggtagagcggcgagatgccctgtacctgattgccaggaacactgtcgatggaaacgatggtttcgcggaacagccgttcggcatcctgcgaggtggaatccagcgaaataatcgccttgcgtgagacgggttccgactccgacgctgattcttgcttgactgcatgcccgccgagcatccagtcttcgctctcgagctgcacggcgttacggtccggcgcggcggccagcaaatcggctacaggcccctcatgggctccagcaagtttggcgttcggattcagcgccgcccaaggagccagcacaaatgcgcgctgccaagcacgcggatggggcaatgccagatccggatccgcgctggtgatgccatcaaagtcgataatgtccaagtccaacggcctggaatcccaatgattctcacgaattcgcccatggttcgcttcgatgttttgcaacgcggcgagcaattcgtggctgcccattgtggttccaagctccaccacggcgttcaggaaatccggcgtaccgtcagccatgccccacgcggccgtgcggtaaagcggcgaaataccggtcacctgtgtgccaagcagcgcgtcaatctcccgaacggcggctcgcaaggtggattccacctcgcccacattgcccccaaggccaccaccgcgttatggatggcatgcttttcagcagtgcgtccattatcggtggcacgcacgcgcgagatggagaccgatacatctgcaaaagccacgacgatgggcgcgtgaggcttgtgcacggtgacgtcgatggaggcgacggccggcgcatcggcaagaatcttatccgcgatacgttgggccagacgctcgatcaggtccacatgagggccttcgatgacagccacgatatccttggccacgcggccgtaatcgatggtgtcattgagatcgtcggattggccggcggcggccagatcaaggtgcagggtgacgtccacgacgaaggtttgtggccgttcgtgttcaaaggcgagcacaccgtgggtgccgttggcatgtacgccggtaagtgtgatggtgtccattggtaaggctttctgttcaaatgctcccctcagtcgccttcggcgccagctcccctcgcccgaggggagccaagacctagaagcaaccaaaaacagggagccaggggaatcatgcgtattcgcgccaggtgttgccggcgatgacggcggcgcggcttttggccacatcgtgtacgcgcacggcccatgcgccgtgctcggcggacagggcggacaaggctgcggtcacgtcatcgcgctgggccatggtcgggccatcagcaccggcagtacccgccccggtaagcatcgccgaaatgaagcgcttgcgggactggccaatcagcaccggatatccagtggcgcggaaggtctcgagcccggtcagcagcggtaggttatgctcgatgccgggcttggagaagcccagaccaggatcgatgataatgcgctcaggctttacgccggcggccagcacgccgtcgacttggcgcatgagttcgtcgtgcacgtcggtcaatacgccatgctcgtatacggaggtgtcttgatcggggttcgcgcccttggagccgacgagccagccgcgccaatgctgcacgacgtacaggcagtcgtggtcggcgaccacatgcggcagctcggcgtccagcgtgccgccggaaacatcgttgatgatctgtgcgccctcgctcagcgcggcggcggccacggatgcgcgcgtggtgtcgatggacagtacggcaccggccggaatcaacgtcttgacggcaccggtgatacgggccagttcgtcggcctcggacacgcgcttggcaccggggcgcgtggattcggcgccgatgtcgatgatatccgcgccggcggccatcatgtcgcgcccgtgctgggccgccttggccgggtccagccataggccgccgtccgagaacgagtcctcggtgatgttgagcacacccatcaccatggtgtgcgtggcgtcatgcaacgcctgcaaatcagtcataggtcatctccccttcattgtttccccttcgctcccctcagtcacctacggcgacagctcccctcagagaggggagcctaggttgcgtcacttgtcaagaatcagactcatggcttcggctcgggtggcggggttgcgtagcagaccgcgcaccgcagaggtcaccgtgcgggcggaagacttcttgatgccgcgcatcgacatgcacaggtgctcgcattcggtcaccacaatcacaccacgtgcgcccgcatactcgaccagcgcgtcggcgatctgctgggtcaaacgctcctgcacctgcggccggcgagcatacacctcaaccagtcgggcgagcttgctcagccccatcaccccatccttggcgggaatgtagcccacatgggccacgccatggaaaggcagcaggtgatgctcgcacaccgaatacagttcgatgtccttgaccagcaccagctcgtcggtatccacgtcgaagtgcttctccagcacatcggccggcgaggcctgcagaccggcgaacagctcgcggcacgcgcgggcgatacggtcaggcgtttccaccagtccctcgcgctcgggatcctcgccaatcgacttcaggaacagacgtacggcctcgcgcacgccttcctcgtcgtatgtgcgtttctcccgctggcaagactctatatattcgttcatctcatctctcccttgtcattgtccacaacgacgtcggcccggcctgcgtacgtgagaaaccacatgaacaggtcgggccgaatcgtcatcgtgtctactcttccggcttcatgccgaccgagcgcttgaggctttcgggaatctccaccggcggcttgtccgagtcggggcggcggtcgttggacagccacaccggacgaaccggagccttcttgatcggcgcgaagatcgccgcaagttccttctcgttcagggtctccttgaccagcagctggcggaccagctcgtcaagaatctcgcggttgtcgttgatgatggtccatgcctcggtgtgcgcggtctccaccagcttcaacacttcgtcatcgattacctcagcggtgcgatcggagtacttgcgcggctgcagaccatccatcacagtggtctgatcgtcgtcggaaccccacttgatggcgccgagcttatcagagaagccgtattcgatcaccatcgtacgggcgatgctcgtagccttctcgatatcgttcgaagcaccggtagtcgggtcgtggaagacgatttcctcggcggtgcggccacccatcgcgtaggccatctggtcgagcagctggttgcgcgactgcgagtagcggtcggaggtcggcatgacggcggtgtagccgagggcgcggcctcgcggcagaatcgtcaccttggtcaccggatcggtgttgttcaaggcggcggccaccagcgcatggccaccctcgtggtatgcggtgttgcgcagctcttccagagccatgcccttggacttgcgcttcgggccggcctgaacgcggtcgatggcctcgtcgatggcgcggttgtcgatcaactgggcaccggcacgggcgcacagcaacgcagcttcgttgagcacgttggccaaatcggcaccggtgaagcccggcgtgcgcacggcaaccatatgcaggtcgacgtccggtacgaacggcttgcccttggcgtgcaccctcagaattgcctcacggccttccagatcaggcgcggccacacctacctgacggtcgaatcgacccggacgcagcagagcggggtcaagcacgtcagggcggttggtggcggctatgatgatgaggttggtgtcgttgtcgaaaccgtccatctcgacgagcagctggttcagcgtctgctcgcgctcgtcgtggccaccgcccataccggagccacgcttgcgacccacggcatcgatctcatcgatgaagatgatggcgggagcgttcttcttggcctcatcgaacaggtcacgcacacgggaggcaccgagaccgacgaacatctcgacgaagtcggagccggccatcgagtagaacggcacgccggcctcacctgcgatggctcgggccagcaacgtcttaccggtgccgggagggccgtacagcagcacgccgcgcgggatgcgcgcacccagcgccttgtacttggacggatccttgaggaagtccttgatttcctcgacttcggccacggcctcgtcttcaccggccacatcggcgaacttggtggtgggggtctggccctcgagcagcttgccgctgtccttcttgccgcccatgccgagcatgccgccggcaccgcccatgcggctcatcagccaccagaacaaggcaaagaagatgatgaacggcaaaatcgaggtgatgaggtagctcatcacactggtctgctcgatattcgaggtccagcccttttcgagatcgccgttctccacggccttggccacctgcgcgccctgggcgaaggtgtagtagaactgcacgttcttgccgtagttggtcaccttgccggtgtcggcgttcttcttggtgtagtcattcttcagctcaaggcggacgacctgcttgttgtccgtgatctcggcgtatgtggccttgccctgattgatcagcgcgaaaccatctttagtatcgatggttttggtgccaccgccggcgaacatctggaacatcagcacaaccatgaccacgagcacggcaccccacagccagggggactgccatatcgggcggttctctttgttgcctttgccattgttcccgttattgccacggttgaacgggttggtgaacgggttgccgttgttacggttgttgttcgggttcgggttattgccgttacccggcccttgcgggaagctcatgcttgcactccttggtagacggacggcttgaggaccgcgatcgaatcgaggttgcggtagcgttcgtcaaagtcgaggccgaagccgacgacaaactcgtccggaatctcatagccggcgtacttcacatcaacgtccacctctcggcgggaaggcttgctcagcaaagcgaagacttccacggaagcggcaccacgacgtttcagttctgcgaccagccacgcgagcgtgcgtcctgaatcaacaatatcctccacaatcaaaatgtgccgtccgcgaacatcggcggacaaatcctgcctgactgtgacctcaccgctcgacactgtgcccgagccatagctcgacaggctcatgaaatcgatctgtacaggaatgctcatggcctgggtgaacgcgaccagcgtattcacggcccctttcagcaccgcaacgagcagcggattcttatcgcggtaatcctcgctcgcgagagcagccatctcgtggatcttggcatcaatctgttctttgctgaccagctcgtggtcaatatcttcctcaacgtcagcgattcgcatgcgctccatcttggcacacgcgaatgacgtgtttcttgcgattggctgaataacctctgggaagtgagacgccgccttgcccatgccaatcgacgaccagccggtcgatggcggcaatctgggcagcactggcgttcacaccggcttggctcagcgcgtgagcgatgacccgcaaccgaatcgcctctggctcacgtgcaatacgtttgacgctgatcatcaggccgatgccatggctcgaatcgttggtatcgcctgccacacaggctcgtggcgcatcggtcgataccgctgccgacgatgccggccaatcaactgccgcaaccgcctcccccatcacctcgtcggatcgctgatccagatactccttatccattctggccaaccgtgcgctttcggcgaaatggcgggtgacattgaatccagcgaatcgttcgatggccggcagcaggtcgtgacgcacccgcgagcgcaacggatagtcgttcggcaactcgccgtctaccgcatcgccattggtggggtcatcccaatattccacacctaagtcttcacagataccggtggtttcggctcgagtaagggtaagcagtggccgcgcaaaagtcgcgccactgcgtgtgaagacctgcggcatgccagccaacgcatccacgcctcgactgcgcagcaggccaatcaatacggtttccgcctgatcgtccatagtgtgggccaacagcacggcaatggcacccgattcatgcgccgcggcgcacagctcgtcataccgggcctgccgtgcggccgcttcgaggccctcgccgcgcgcctgtacggttgcgttgcgcatgatgaccgggcccagtcccaacgcgcggcaacgatccgcggcctcgctggcgacccgttcggagcctgcctgcaagccgtgatccacaatcacggcaccgcaacgcacgcccatggacgtgcatacgatatggctcaccgcagccagtgccatcgaatcgcgcccgcctgaacaggccacgagcacgagcggcgcatcggcggcaacggcatggtccccatgctgcgcgaattcgggagcctgcacatcgcatagttccacggcactcagcgttgcgcggaccgcgcctacggccttgcgcaatcgtgcggaatatgccatgtactcaccaccttttttctggttataggcactcgtgcgtttatggacgtttacggcctttgtagcccttgatggcccttgatgcctcttttacagccccgcgagcttggtgataaacgagtcgatggcgctacgcgcggcggcataatcctcaggattgttgaccaccacggcaaacgacaacgctcccccattggtgcgggacacattgccggccatcgacgtaaccgtgccgaggctgccggttttgacgcgcagcagaccagccacggcatcatccgtataccgatcctgcgccgtgcccaccaatcccgcgatggatagaccttccgcaccagcagcaccgctctcggtggtcagattacgttgttggacggccgccagcgtgcgtacggtgagccgggagccgggagacaggccggagcaatcggccatggtcagaccggatgtgtcgagaccgagatcgttcagagtggatttgaccgcttccgtgccgccttcaggactgtttgtcgctgatttcgccaaggcggtgagtctgccgaactcctcggccagcgtattgtccgaatgccgcaacgtgtatgccatgatttcggacagtgttgccgaactcaccgaagccaaaggcgtttcaccggatggagcggtgtttgccgtcacgtctccggtaacggccatgccgttcgattggagcagttcggcgaatttcgcggccacgtcgctggcggcgtgctgggacagttccgggtatccggccgaatcatcggggtcggccggcgcaggcgtatcggcggtgtattggcggcctccatcaatcgccattgatgagaccggcgtgaagtagacggtgtagtcgcttaagactgcgccgccttccgacagacctgccggaatgcgtgagtcgccgaatagggtgtcgtcgtactcgagattgacggaagtgatgcctcgctgggcgagcgcggccacggtggccttggccaaggtgttcagaccggcacgtccgttggtatggttggcgtcagaatcgcctgcagacagcagcatgtcgccattgcctttgagggtcaacgtattggtgccgtcatcggattgggtgaggaacacttgggtatccaaggtggatgccatattcagggtggatgaggcggcgagcgcggtcagcgttttcagtgtggatgcaggctcgcgtggagtgttcgactcatgttcggcagcgacggtgccttgggcgtcttcaatgatcaccgacgtatcgtttcccacgccttgcgcggacagcaattcgttgaccagcgcagaagcggccgtggaatcaatggccttgttcgcgttcaaggtgccggcgacggtgccgcctgatttggcggtggctggatcggcaaaaacaggtgcggcgacgggcttcaacgtcaataatccgggggccacgtcggtgatgtcggcggcgcagtaccccgcgaacagggcgatggtggtcagtgcggaaatgatgacggtcagtgttcggcgatgcgatcgttgggtccgccgttgcgcttcacgccgctgacggcgtgataccgctgtagataccatcgtgctccttatgccaaggcgatcatttctgcaatgaggcgaacgagtcgagtgcttccacaatcgaaagcattcgcgcatccatcagcttaccgcccagccatgtcccgagtgccaggatgccgatgccgttggccagtgcgaccggaataatcgccagccatatgccgccttcggctcccgtcagcagcatgaccagcgccacgatgccggtgggcagcatcagcagcaggctgccaagcacgtagacgaacgggaagaagccttgggccatggcgcggccttgaggcgcggagaacggcttgtccattgaggcgaccgggtacatcagcacacaggacgtgacttcggccacgcccaggccgctcaaggcgacgcccatgcccacggcgaggaagatcaggccggtgacgaggtcatcgggctgcgcccagcggccggtcagtgcgccgaccagcacgatgccggcgagatagagcagcaccatgtagacgaccatgatgccgacgtagacgcgcacgcggccgattctgtcggtccggccacgcacgccggcgatgacttccatggtgaagccgcggccgtcatatgcgagcccgttgctttccaccactgacatgaaccagccacaccagatcagcgactgccagacgaccgcgctgatgccgtgcgcctggaaggcgaagatgatcaggaacaggaccggcatggcgaaggtcatggcttggcgggggtctcgtttgagataggtgatcaggcgtgcggacaccgcgccggatgccgaatcgggcatccatgcgaatgcgccgatgcctttggcggtctcggacggactgtttgcgccgatggtgagccgttcatgcctcagacaccaagtgcatacggcgaagcagacgatccatgtgacggcaaggatggcgatgcgggcgatcagcaccgcccaagctccggtaagcgcgtcgaacggcagttggaaggccgcaccgaacggcgtccatgcggcgatggcggtcgccgcgccccaggtctcggtgttgaggctgaaggctatgccggagttgaccagaatgttcggcaactggcagatgatgacgaaagtcagcacgatgaagatgtagaacgcgcctttgccgcgtttgctggtcaccagcgtggtggatagggcgatgaccagtttggagatgctcatcatggtgatgacggccagcactgcggcgaggagggaactgatgattacggctggtcccatatgccgataggccagtgtccagagcatcagtgaggccacgccagtaagggaggggatgccggacaggccggaaagcagcaagccgaattgcaggttgcggtcggcgatgccgtagatcgcgaatttgcgtgggttcatggtggagccttcgccaagcatcatgagctggatgaagccgatgaagatggtcatggtcgcgccgaccagcacgacgactatgttgacgatgcctccgggaccaaggatgttcagcggaaagccatccgcgttcacggtgaagggcggcagtatgccgatgaaccatgcgagcacgccggtgccgatgatggtgccggccgcgagtacagcggaaaagacataggcgacggtctgccacgccgattttcgcagggtggcgagcgtgagcgtccagcgcaggcggaccagggtgatggcggtcttgatcattggcgggcctcatcggtgggtgtggcgggcgtaggcagaatcggctgaatcgtctgggccgaagttggtgcttgggcttgggcctgcccgccatcgagccacgcgagatgggcggcttcgtggcggccaccgactagttgcaggaagcggtcttcgagttcttcgccagcagcgacctcgtccaccgtgccggccgcgcataccagaccgtcgttgattacggccacatgcgtacacatcttttcgaccaatgccatcacgtgtgaggagatgatcaccgtgccgccagtcttcgcgtattcgatgagaatgtctttgaggttggcgctggacaccgggtccacggattcaaacggctcatccaagaccagaatgcgcgggctgtgaatcatcgcggaggccaggcagatcttcttggtcatgccggccgagtaatcggtgaccatcgtgttggcggccccggccaagtcgaaagcattgagcaggtcctgggcgcgacgcgtggtctcctcgcggctcatgccgcgcagcatgccggagtagacgagcaattgcaaaccggtcagtcggtcgaagatctggtcgggctggggcatgacgccgatcatgcgcttggccgtgttcacgtcgctccacacgtcatggcccagaatcatggcggtgccggcgtccggcaccaatagaccggtcaccatattgagcgtggtggttttgccggcgccgttagggcccaccagtccgtagaacgagccgattggaatgtcaagcgcgagcccgttgacggcgatcttccggtcgaagtgcttgaacaggccgcgaatggacaccgccgtattcgggttcggcggccatgcttgcggctgtggctgttgcgactgcgaagacgcgggagcggcggctggcatcatcggcggctgaaatccgacattcctttgagtattgtctaagctcatgcatctactctagcccaccagtcaaccctcagcgcagcaccccgggttgctgttggattgccccgctgagcagctccggactagcggactcggtcagcccttatgtgcgatgggcttccactgggctttggcgaagatggcctggaaggaaatcggcacgtagctgagcatgtaaatcgggaagctgagcacataggcgagcagctccttgttcgtggcaccgatctggtcgtgctcgacaatgatggtcaatgcagccaatgccatcagacccaacaccgatgtgatgatgccgctggaccaaccggccagcgattgcagctggctcgaccaactcacgaagccacacgcggcgaacagcaagcccatcaccgcgcgaatcacgcccaacacggtaaacggacacagcatcaaggtgaagtcgatgcaggagaaatcacgttcgcgaaccgcgcgtttcagcaatgccgagccataataacggaatacctgcaggaatcccttgctccaacgcaaacgctgacgccaactttgcgagaaggtaaccggctgctcgtcgtagaggatcgcagtaccgcaatagccgatgcggtcgccatgcagaatcgaatccatagtgaattcaagatcttcagtgagcaggtggaacttccatcccttgttccgcttcatcacctcgcgggagaacatgaatcccgtaccgcccacatggcaagaggaaccgagaatcatacgcgagttagacaggaatcgcgattcacggatgaaccacagcgcagaaccagaagacacccagttatccgccagattcaccgaattacggtagctggtcagaatcttgaatccggagcagaacgccttgttcatttcctcgaagtaatgcttgtccagcttgttatcggcatcgaacacgaagtaggcctcataatcatcggccacaccgatgtcgagcatatgccccaacagatacgtcagcgcatatcccttgccaaccagttcaagattgtggcgttccaccacatggcagcccaaagaccgcaccacgtcggcggtgttgtcggtgcagttgtcggccaccagccagatgtcgatgaggtcggacgggtaggtctgatcgcgaatcgacccaataaggttgccgatcacgttttcttcgttgcgcgcggagatcagtacggcataccggttggtcatcggggcgtcggggaagcgcacgggcttggcgaacagggacatcacgatgcacagtccctgatatatcatgccggcaccaccgacgattaccagaagaatatcgagtacggaaagcagggtcatcagcgccaccccgccctaggattgctggaggcagattgatcagactgcttggtttgcttgcgttgcttgggctgctcagactgctgcgtatccgcggcaccacgctgcggaatcgccacggtggcggaatcgtccaaatcggattctttcgtctcgtgtggcggaatcgcatagatctgttcctgcagcaaacgcagttcctcattcatcggcacacggctggtggaccccttggccgcacgcggcatgtgctcgccgatcggctgcagcacatgctcgccgaacgcttcggacgcctcgacgatcttggacttcttctccggagtcggatcgttcatcagtggtgagtcaatcagctcatagcgcttggtgtacgcacggaagatggcctgcagcgatgcggtgaccggcagcgccaggaacgcgccaaacgcgccgaacagcgagccgaacgccagcaccgcgaggaaggcgacggccgcgttgatatccatcgtgcgctgcgaaatcctcggcgagagaatcaggttctcgatctgctggtagacgatgatgaacaccagcaccgccacggcgtacgtccatccgcggttgccccaagcgaacagcaccggcagcgcgccgccgatataggtgccgaccgtggggatgaactgggataccacgccgcagaacagggccaacggcagccagtagggcacatgcagaatctctaagaagatggcagtgcaggtggcgttgatcaacgccagaatcgaacgggagaacaggaaggacgaaatctggccttgggccacggtccacaccagcaggaatcggcgctgcgtgttgggggccagccactggcagaaggagcggcgcagtttggggccggcggcggagatgtaatacgtggtcatgaccacggtcatgaggttcagcaggaaggagaacaggccgcccaccgtactcatggcggtaccggcaaaatcggtgacccacgaggtctggatattgttgaagatttccatgccgagattgctgatttccggcatcttgaacgtggcatactggtccacgaactcacgaatctgctcatacatggccggcaaaccgcggaccatggcaatcatctgctgtacgaacatgttgccaaatagcgtgagcagcacacccacgaccacggccacgcccaccaagctgacggcggaagccacgccacgcttccagccatgagccaccagcgccaccaccaacggttcgacggccagcgccaggaacagcgagatgatgatgtcgagcactagataggagatgtcgccccacgagcgccagcagaacatgaatacgatgacggcgagggccacatacagcagcgcgcggccgaaccattccggtggcctacgggaatctcccttggcggggaacaaagtaccaaagtcgatacgattctcgtcgtccgggtctgccccggcctctgcggcaccggttctcaacgtgtcggtgctgtttacgtttcgcacgcgttcgctcatggctccccattgtagcgaggggtttgaagctcggatacgccggcggcgtacacccgcttttctattgttgatgttatgctcaacgtttcgatcatcatcccagcgtggaacgaagccgaacgcatccgcgactgcctgctgaacgccacccgtcagaccatcatgccgcatgaggtgctggtggtggacaatcgttctacggacaacacctgtgcggttgtcgaacagttcattgccgaacatcctgaggccccggtcaaactgttgcaccagaacgatgaacaggggctgattcccacccgcaactttggcctgaacgccgcgaccggcgatgtgctgggccgttttgacgccgactgtatgatccggcctgactgggtggaggtggtctccggcatcttcaccgaagacccggccgcgatgggtgccactggtccggtgatgtattacgacatgccctcacgccatttcgggttgaaaggcgacaattccttacgcaagcgaatctaccgtgccgatggcggccagccgctgctgttcggctcgaatatggccttgcgcgcttcggcctggcatcagattgtgaatgaggtctgccgggataaggccgatgtgatgcatgaggatatcgatatttccctgcatctgatgggcaaggatctgaaaaccgtgtactcgccgcgcatgatcgccgcgatgagtgcgcgacggatggatacgtcgttgagttcgttcctgagctacatgcgacgttttaagaatacgtttgatgcgcatccgcaacatacgcgcacgcataagccggaggtgttgttcaccgccatgtatccggcgatgcacatgttctacccggtgtggcagaaagtgctgaattccgcggatatcaatccggctgaagccgcgtggatcaacgagcagatggaactggcggaggcgcaaggcaagcagctgtacgacgagacccccaccgacgaagtctacgacgaaaagcacgaaaagtagctagatatacgagccccctctgcttatgcaagctccctctgataagggagctgtcgaatgaagtgagactgaggaagagactgcgacgcagtcgctaaaacattgaatcggacgcaggccgatacctattattcagcggctacgccgcaacttctctccctcagtcagctacgctgacagctccctcatcagagggagctaatgtttactgtcattgactgatcacatcagcgacttgtaaatcgcgaggatgtcctcttcggttgcctgacgcgggttgccgggggtgcacacgtcgttgaaggcatcgtgagccagcggctcaaggtcggcctcggtggcgcccacttcggaaatcgtggtcgggttcttcagatccacggtcagcttgtggacggcctgcacggcctcttcgcgcaccttctccaggtcgccggtgtaggcgtcctcaacaccgaacgcatcggcgatgtcgcggtacttctcaccggtgaagtccttgttgtattccatgaccggggccagcagaataccgttggccacaccgtgggccacgcccagacggccgcccagcgggtgagccatgccgtgcaccagaccgaggcccacgttggagtaggccataccggtgatgtaggacgcgtaggccatctgctcgccggccggaatgtcgccgtcggcggacttggccaggttcttggcaatcatgcggatggtctgcatggacaggcagtcggacaggctccaggcacccggggtaatgtaaccctcgatggcgtgggtcagggcgtcaagtccggtggcgaccttcaggccgcgcggcatcgagtcggtcagatccgggtccacgaaagcgacgatcgggatgtcgtgcgggtcgacagccacgaacttgcgcttgttggccgtgtcggtgaccacgtagttgatggtcgtctccgaggcggtgccggcggtggtcggcacgccgaagatcgggacggacgggttcttggtatccgcgacgccttccagagaaagcacgtcggcgaactccgggttggcggtgatgatgccgatgcccttgcaggtgtcttgcggggagccaccgcccaggccgatcaggaagtccgcaccggactcggcgaacttggcgacgccgtccttgatgcactcgaccggcgggttcggcttgacgttggagaacacctcgtacggcaggccggcctcatccagaaccttggtgaccttctcggcggtgccggtctccagcagcaccgggtcggtgacgataaatgccttggtgaagccgtgctgcttggcgacggccggaatctccttgatcgcgccacgtccgaagtatgcagtctggttgaaaatcatgcggtacaccataggggctctccttttgagctagtgtcttaactggtggtccactctgtctttgagtggtccaacggttccccagtctactccgcgcatgagcattcacctgaaaacacgctgaaagaacaacactgaaaataatggcaagaaatggcggaattccgcacttgtcgaattattgtccattgaccaaaccagttccatcgcccgaaatctcaacgataagaccattttccggagtcatctgacgctctccgagaaactcgtctctcatccgcttacttcgcgcgtagcgcaatcaatatgcgagatgcctaattccattcgtgcttcatcagccgaacgcgaactggttcaccagatggtgtattcaacggtttcagtctcctgaagaggactaagatacctcgacagttggggtgatcatcataagagaatgaggtagataatggcaaatggcaaggctatgacggtcggcgagatggcgtccctgtttctcgaccccgccactcccgttcgtatcgacgctttcgacggctcgcatttcggcccggcagacgcggatttgaaggtcaaaatcgccacgccgaactgcatgtaccagctactcgcgcacccgaatgaaatcggcatcgtgcgctcatacattctgggcgatttcgacgtggacggcattgactacgccgacccgtatccggcgatgcgcaagctggtgtcgctgtccaaatacgttcgcccactcactcccacatcaattgcccgcgtatctgccggcatcctgagccatggcttcaagaagccgccggtgcccgccaccgagggcccgagcaagttcgcccgtatcaagcgtggcctgatgccgcacaccgaaaaggccgattcggaaaccgtcagcttccactacgacatgtccaacgagttctacgccgacttccttggatcctccatgacctacacttgcgcggtattcgacaacgaacacatgagccttgaagacgcacaggccaacaaactgcgcctgattctcgacaaactggacttgcagcccggccagcgcttactggacatcggctgcggctggggttcgatggtcatcaccgccgcccgtcgcggcatcaaggcgctcggcgtcaccctttccaaggaacaggccgcgtacgccaacgaatggatcgcccgtgaagggctgcaggatctggccgaagtgcgtgtgcaggactaccgcgaggtgcctgagcacgacttcgacggtatctgctcgatcggcatgatggagcacgtaggcgtcaagaactaccagagctacttcgaagagatgttccgccttctgaagccgatgggccgactgctgaaccaccagatcaccatcagccatgacaagcctcacggcaagcccggtaccgacgaattcctcgaccgttacatcttcccggacggtgatctcggcgcgcccggcttcatcgaatcgtgcatccatgacgccggcttcaacgtggtgcatcaggagaacctgcgccagcactacgcgctcaccctgcatcactggaaccagaacctctccgagcattgggacgacgcggtcaagcaggtcggctttgaacgcgccaaggtatggggtatgtacatggccgcctgcgctctgaacttcgagctcgacggcatccagattcaccagttcttggccgtcaagccggatcgcgtggcccacccggacggcaagtggtaccccctgcgccaatggtggcaggcctgattcctttttgtgggacggcacgcggtttttaccattgttcatctgccgtcccacacgattctcttcgcacgcgcatttcgcgggtgctttttctgcaatactgactctatgagcgccacagccccgaactacaaccacactgtcaccgcctgcttcgtgggatacatcactcaggcggtaatcaataacttcatgccgttgctgttcgtcacgttcgcggcgacactcggcatcgacatggcgcggctttccgccctcatcaccgtcaacttcgtcacccaactggtcgtggacgtgctggccggcaagttcgtggaccgcatcggatacaagccgtgcattatcgccgcccacctggccgcccttgccggactgctggcgttgggcttgctccccacccgcgtgccggacccgtatctcgcgattctggcggcgattttcctctacgcgctcggcggcggactcatcgaggtcatggtctcccccatcgtcgaggcctgcccgagcgaacacaaggccaaggcgatgagcctgctgcactccttctactgctggggccagctcggcaccgtggccatctccacgctgtttctgtttgcgttcggcaccggctcatggccggttctcgcttgcttgtgggcgattgtgcctgccatcggcatcgcgatgttcgctggcgctcccatgccgcgcattgtgccggaaggcacggcgaccatgcggttcgccgacttgtcgaagaagccggtgttctacctgatgttccttatgatgctgtgcgcgggcgcggccgaacagggcatgagccagtgggccagcgcgttcgccgagtccggtctgggcgtgaccaaggtgattggcgacttggcgggacctgccgcattcgccctgatgatgggcctgtcccgcacgatttacggagtgctggggcatcgactggatctcacggcattcattgccagcagttccgtactgtgcgtggccatgtatctgaccgcagccctaaccacggcaccggtactgggtctgcttgcctgtgcgctcaccggtttttcagtgggtattatgtggcccggaacgttctcgatggctgcagacgccatgcccggtggcggtacgctgatgttcgcgctactagccgtggccggcgacctcggatgcgccggcggccctgccgtagtgggactggtggcctctgccaatggcgacagtcttaagaccgggttgctgttcggatcgatgttcgcattggtgctgttggcgtgcgtagttgcggcgaggaagacagttgttggcgaacgcgagcctttgcattgaccggccagcccgccattttggcctataacccccgccggagtaggtacgcgacggatatgcaaaagccccgcacaaggcggggcttcattatggtggctccgaacggcgtcgatccgttgacctagcgattttcagtcgctcgctctaccaactgagctacagagccatgaacagtcaaaaacccggataatccgggcttcataaccattccagcgaccccggccggacttgaaccggtgacctccgccgtgacagggcggcgctctaaccaactgagctacggggccattgttctcacttgcgtgaggcaacagatgtatatattactgaaattcgccagtcatgcaaacttcggcgtgttccgcataatttcaaggtttttgctatcaccagcacgcgaacacgtctgtcacaaacatccacaaaacgacgaagggcgcgaccggaaccccggccacgcccttatggacggaaacgcttcgcggcatccaccgcaaagtgaccgtcaatctcagtcagcctgcttccaggtgtcgacgtcgatgtggtgttcggggttggcctgccaggcatcccacgcggacttgacgatgtcttccacgtcgtacttggcatgccagcccatctcctcgttgatgcgcttcggggagccgatcaggtgcggcgggtcgccggcgcggcgggccatgacagcctcggtgaacggcagaccggtgaccttcttgacttcgtcgacgatctggcgcacggaggtgccttcgccggtgccgacgttgaaggcgtcgtacttgcgctcgtcacggtcgaggtacttgagggcggcgatgtgggcgtcggccaagtcggagacgtggatgtagtcgcgcacgcaggtgccgtccggagtcgggtagtcgtcgccgaagatagcgggagccttgccctgcttgaggcgattgaacagcatcgggatgaggttcaggatggccggatcctcaagctccaccggaccgcagccggccacgttgaagtagcgcagcgcgcagaagcggatgccgaacggctgctcgcaggcgcgtgccatccactcgccgaacagcttggtctggccgtaggggttgatcggcagcatcgggacgacgtcctcaggcaccacatcgaccggcggcacaccataggtggcggcggaagaggagaagacgagcttcttggcgttcttggactgggtcatgccggtgagcacgttgagcatgccgttgatgttctgctggtagtaccacagcggcttctccacggattcgccgacctgcttgcgagcggcaaagtggatcacggagtcgacgccttcggcatcgaggatttcggccaaacgctcaccggcgcccggggcggcgatatccatgccgtacaggcgggagtcttcgatgcgagtgggcttgccgtagctcagatcgtcgacgacaacgaccttttcgccggcctgatggagtgcgtgaacgacatgagcgccgatgtagccgcagccgccggtgacgagaactgtcatagttgacctttccttgtgcgggttgcaaagcgtcggccgtggggagttcagcggctgttcacttttggtccgctttgttaccttttgaaacaatttgagtatatcacacgaacataatcgcacaaaacggtggtgtcgtccggcaatatctgcattcattaggtcgatttggcgttcattaggtaggtcggcccggagccggcccgcacggacaccgggtaaacggcttgatatggtggttggtatcgcacaccacctacctaatgaacgccaaatcgacctaatgaatgaacagcggtgcggcgcacaaggaaaatccgaggaatatatgaccgatcccgaatccacagcaatcgatcccgtcgccgcgatggccacagaccacaccgaggcaccggcgcaccccctgcacaaggtgctctccttcgtacgccgctccggacgtttggacgatcgcctgcagcgcgcctgggacaactatgccgacacatatctgttggatattgcggccggcaacctgctggacgtgcgcgagggcgtcacgctcgaccgcgcgttcgtggagtccgcatggggcaacgacaatccgctcattgtggaaatcggcaccgggcagggagaaaacgtggcggcagcagccgcagcccgcccggagacgaacttccttgccctagaggtctatgaccccggcgtggcccacacgttgctgctcgccggcaagcaggggctgaccaacattcgcgtggcccaggtcaatgcgcccgagctgttcaaggtgaccgcggccggcaccgtggccgaggtatggaccttcttccccgacccttggcccaagaagaagcaccacaagcgccgcatcgtgcaggaggccatggccggcgacatccatcgcgcgctggtcacagacggcgtctggcgtatcgccaccgacatcgaggactatgccctgcacgtgcacgaggtgatggacggcctcgatggctggaagaacctgggcagcgtaaccgtcagcctgccgctggagcacgtgggcaagggcaatgccgacatggccgccgatatgccgcacgccgacttcaccgaatccgagcgattcgagggccgcgtgctcaccaacttcgagaagaagggcctggccgccggccgcgtgattcatgacttcacctatcaggccgttaccctgaactgattgcgacacgccgaaatgccgtcgatttgcataaccgaacaacctcccgtaaagtaattcgagttgttcgcccccatcgtctaacggttaggacaccagactttcaatctgacaacgagagttcgactctctctggggtacttcactaaagaccccggtcatagcgaccgaggtcttttcgtattcgcgggaccaggtctgaaagcattcggcccgcttgatatgtgctcatggtttcatctcagcacgtgttcgcgcccgccacaaggactatcccaccgtagacgatgtgacatcctccacactgtgacttcgcgcacagggtcccgacgccaccctcaccccgtttatcgacaccatgcgtgtataaccgcatatggcatcatcggcgaacatcggccggcagaccagttgtacaaggagaacatcatccacatggcagacaccgccaacaccaacaccaacgcctggctgccggcgctcaaagcggcgtttccgctgaccataccgatttgcctggggttcctgtttctcggcgcctcgtatggcattctcatgggcaccaaaggcttctccttcgtatggccgatgtgtatgagcgcgttcatcttcgccggttcaatggaattcgtcacggtgaatctgctgctctccgcgttcaacccgctcgccggctttctgctggccctgatggtcaacgcccgtcacctgttttatggactatccatgctcggcaaattcaaagggctcggctggaagcgcccatacctgattttcggtatgtgcgacgagacttttgccatcaactccaccgcgaaaatccccgccggcatcgaccgtggctggttctacttctgggttacgctgtgcaatcagctgtattgggtgaccggcgccacactgggcgggctgatcggcgcgcatctgccgttcaataccgacggtcttgatttcgtactgaccgcgctgtttctggtgatcttcctcgatcagtggctcgacggcaagcatcgcgagcgactgtccgccgtcatcggtgtgctgacatcactggcctgcctgctgatattcggggccaatgatttcatgattccctcaatgatcgccatgctgatactgttcgtcgcgctacgcccgcatctggacgtgttgcggccggccgccgacgccccggaagccacggcagaccatgccatgagccacgcagcggaccagcagaaggaaggacagacgcgatgacgatgaccatctggcaaggcgcaatcactatcgtgacggtggtgctgggcacgatgtgcacccgttttctgccgtttctggtgtttcccgagtccaagcagccgccgcgcatcatcgagtatttcggccaggtcctgccctatgcgatgaccggtctactggtggtatacgcactgcgcaacaccccgattctgaccggttcacacggccttccggaactcatcgcctgcaccgtcatcgtgctgctgcacgtatggaaacgcaatatgctgctttcaatcgccggcggcacaattgtatatatgttgctggtgcaactggtgttctgaggcacccgactcgttagtctctccctccgcttcgctatgctcagcacctcccttacagagggaggtaatcttctgtaccttcctctgacgagggaggcggcaccgcgaagcggtgacggaggtagagacccgcagtcgtaagactgcgaaacacacagcatcggccacaggccgattcctacagctgcttcgccacccaatcgacgatgtacggggcgacttcctcaatctggtcgatggcgacctcgaactcgtgcttgccgccgtaccacgggtccaccagatcgatctgatcttcgcggccgggcttcggcttgggcagattcgggtcgaagctgcggtacatgtgcacttcggcgcgcttgccggccggcagcatgcgcagcagggcgcgcatgtgggaggcggtcatcggcaggaacaggtcggtacggtcgatttcctcacgcgagatgcggtgtgcgaagtggtcacgcggaatctcatcaccatagccacgttcgcgtagcacgcgcacggcacgcgggtcgatcgggtggctccactcctcgtcggacacaccgctggattccacgttcacctggtcgccaagaccgcgctcattaaagaagtgacgcagaatgatctcacccataggcgaacggcagatattgccggtgcagacggtcattacggtgtagggctgggtattgctcatagctttgaatcaatcctcaatcgggcttcaccgggccgcacacggcccgactgtattgttggggtcgaatgaatatgaatccggctcatgccgctataaagggcataagccggattcgcatgcttacttggttttggccaagatacggaaacgataggaatcgatgccggactcctccttggcgggcgtatgccactcgcccacttcggcttcccgccacatcccggcctcgaccagcgacgccatatcgggcgcgtagctgtcggcatccacggtggcggccagatcagtcacataggctttgtccgcgaacggcaaagccttggcgaacaactgggcgccgccgatgatccaaatctccgaacggtccagaccgtcgtccggaatcgcctcctgacgggccatatcgagcgcgtcgtcaagactggtgaccacagtggcccccggcgcacggtacatcggatcgtgggaaacgacgatgttgtcgcggttgggcagcggccggtacttgccccccagcgattcccaggtcttacgacccataatcaccggatgggagacggtcagctccttgaaatgcttcatatcctcggcacagtgccaaggcatgccaccattgaggccgatggcaccggcgcgaccttccttgtcacgggcttcggcccagataagattcaccgagaaggtcttgggataatcgtcaccccagtcttcttcagtggcagacagcccggcagatccgggctcgggttcgtgatagccgctacggctactgtcatgctccatttcgcttactcctcctggattgcggaactgggccttagtgtagtggacagcgaagactcgggggccgtcaccttcacagtattcgctgtccacgaaacggtaatcagcatcagaccgcaacaggtgccttaatagtggggtgatgctggtagccgacgaccttgaagtcctcatactggtagtcgaacagggaatcggccttacggatctcgatggtcgggtacgggtagggcttgcggcccagctgctcaaggaactggtcgacgtggttgtcgtaaacatggcagtcgccgccggtccagacgaattcgcccggcttgagcccggcctgctgcgccatcatcatggtgagcagcgagtaggaggcgatattgaacggcacgccgaggaacatgtcgcaggaacgctggtacagctggcagcttagcttgtcgtcggccacgtagaactggaagagcgcgtggcagggcggcaacgccatcttctccacctcggccggattccacgcggagacgatcatgcggcgcgaatccggatgatgcttgatgaggtcgagcacattggagatctggtcgatggtgcgattcgggtcctcgggggtcggcgcgggccaggaacgccactgcacgccatagaccgggcccagatcgccgttctcgtccgcccactcatcccaaatatgcacgttgtgctccagcagccagttgatgttggaggaacccttcaaaaaccacagcagctcataggccaggcctttgaagaacacggtcttggtggtcagcaacgggaagtacttcgacaggtcaaagcgcatctgctggccgaacagggaaatcgtgccggtgccggtgcgatcggacttcagcgtgccttcggtcaggatcttgcgcaccaggtcctcatagggcatcggaatgtccgtttcgggacgtgcggggatacgggagcgaatatctgcgagttgttcttcggtcaaagccatgtgcaccagtgtagcttaggggcataatagagaagtccgatgatgcgggagagcggccaggtgccgcgctcccccgctggcatggcgatgggccagatcgccggcggctgaaaataaaggagcagctatgggtaagcgactgtgggttgagcgtaacaaggacggttcgtgggatgcgttcagcgacgatggcgcacacattaagttcggcaaggatcgtggccagttcacgccgggcgatctgatgaaggtcgcgctggccggttgcgccgcgctgtccagccagttcgccatcgaacatacgctgggtgagggcaagggtgccaagattgtggtggatggcacgtacgacccggaaaatgacgcctacaccggtttcgaggagcaggtggtgattgatgcttccgacgccggtctgtccgaggaggatgccgacaagctcaaggagcgcgtcacccgccatatcgacaagggttgcacggtcaagcacacctacgtgcaggagaccccggtgcgcatgaacgtcaccgtcaagcactgagacgggatataaattgaagaggctccctggcgggagcctctttccgtatattcggactttactggcgatcgggatcgatggtcttttcgatctgctgggcgacttcaggctcggctgcggacaccggaatctcctcgacgccggcaatctcctccagcgacttggtaggcacttcggcgggcgagctcggcacggtgtcgagacgcgattccgcggcctcaacatacttgcgtggcaccacgtacaccgggccgaccgcatgctgcagcaggccctggctggtggagcccagcagcaagccagtgaagccgccgcgaccacgggagccgacaacaaccacatcgtgatcgtagctggccttggtcagggcgctcacggccgggccggaaacgatctgcttgttgatcttcagatcaggatgcgattcctgcaacggcttgatgcgcacctcaagatcgtccttgtaggactccatgacggcgtcctcgccgtccacacccttcaggttcggcacagcggaaatcacgtccagttccgcaccccagcacgtggcgaagtcggcggcaatgtccagcgccttcagaccccacttggattcgtcggagccgacggccaccttggtgatcgtgttgttcaggtgcatcaggttaccgtcatcatcggtgtacggcaccaccacaatcgggcagtaagcatatgccggcagcgatgaggacgtagtgcccagcaggcgctcggccagaccgcccttgccacggttgccaatgacgatcagattgtagttacgagacaattcgacgaacaccgatgccggatctccggtaacaatcagtgtggcggcttcgacgccctgctcgtctgcgatggccttggccttggacagaatctcctgagcatcggaatgcgcggcgttatcgtcccccatcgccgtgtaagtggcatcgaacgaaacggcggcatagctcggcagggaatatgcgcagacaatctgcagcgtcagccccgcgtgctttgcataattcgcggcccaccatgttgccttgtaactggcatgcgacccgtcaacgccgacgagaatagccttgtcgttaatcatgacgacctccttgaagttattgcggcacgaataccgcgtatctcaacaataccccgcgacactcggtttggccggtatcctccgctcaaaaagaaatccgcgtatacgaaaaaggcacaccccaaaggacgtgccttaatacgaattcgcttaccgcataattcttgtcacatcacgcggcgaatggaatatccagctccaccgaatacggaaacgtcgcttactgccgttccctgcaccgggttcatagcattcatcacctgtccgttaccgatgtaaatggccgcatgagtaccattcgcaagaatgtcacccggcttggcatccgccaagcttgcgaccggagtacccacggtggcttgagcaccagaggtacgaggcagggagatgccaaactgggagaagacgtactgcacaaaaccggagcaatcccatcctgccggagtgttgccgccggcaacatacggatagccttggaacttcagtgagaagctagcaagctcagcgccagtgccagtgccagtcattttacccaagtcaacctgtggaatcgacgcacgctgttcagagcggctggctgccgcagcagcagcggactgggctgcagcagcttcatcagcggctttctgagccgccgccgctgcagcagcttccttctcgccctgagactcggtctgtggcacatcaagagtctcgatgccaccccatttagagttctcatcaaccgaggtggaggtggattcggcgaacaaattcttcttcaccgaactcgccttcgggaaagaacgtgaggacaccacagcactcgtctgcgcggaatcggcagaggcaaacggggctacgcacgcaaacatggcacccgtggcgataatcgccactgatgtggaaataatagtcttaacgctcatcatcaacgccatacactagcacacatgggtcgatttcataacaggaatagcatttcgaagatgatgtcgcgggtgcatcattcggcaggagaacgcaacaggcctcggataccgatcggcatccgaggcctgcaataaatcaatcaataagactgcatcacgggatacgcaccacgatggtgagcttttcggtcatggcactagcgagagccacgctatagccattccatccaccatggaccgcctgaccgttgccgacatacaacgccacatgatcgtagtgtgcaccaccgttccatccaccggtgttggcataaatcagaatatcgcccggctgcagggatccgtctgtgactacgtggccaccaggaacattgacgtactcttcaggccaaccgtggaagttaatgccacgggccgccaacgcttgactgaccaatgcggtgcagtccatgctctgtccgatcaaagaatacgcacggtcgatagaggcaccggcaccagcggaaaccgaaccactggcatcggaataagtaacagaagagcgagactcattacggctcgcggcgttggcctgctcctgggtcgcctgagcctcgacctccgcctgcttctcggcctcctcttcggcagccttcttggccgctgcggcatccttttccgcctgagattccgtctgcggcacatcgaggttctcaatgccgccccaatcagcattgtcctcaacgctcgtggcagtggcttcagtcgtcagatctttgcgcacctgggtgtacgaggggaaggacttggtggaagtcacagtaacaccctcagctgcagttgctgtaggaacaaacataaacaagcaggcacaggagacaatcgcggcaacaatggaagaagctacagttttggtcttcatagaactatcaccctacacggtgcgcattaactcgtacaggatggaagaaataaaacaccccggagctattgggatatatcggcgtgtcggcacaggtcagttcggactaatacgcggccgcaacacttgaaatgtcatttcgcgcgaacgattgccgatagggcgacgtcacatccgaacagtaatcaccgaatgtaagccaatgaaatgaatcagtagtgaacgtactggaacttaccggcttcggcggcgctgaacgtacgggtcgaaatcacacccaatcccttggcattggattcggagatctcaatggagccgtcggcattgatcttttccagaacggcaacatggccgtacgcgccatcggcatcggcctggccaggagcgaacaccacagcatcaccgacatggcgaggagtgttgtccacccaatagcccagagcggaagctgacgccgcccacgcgccaccattgccgaagttgccgctggaaggcaggcccagttcggcacgacgctggtacgcgtaccacgtgcactgaccccacggatagttgttggagttggtgccaacggcatggttcgggttgaagccagccggcacagcatcgccatcggcatccacgagagccgacaccacaggattgttcgcattattgcgattcatcagcttggcgtccaaggtgctgtctgaattgctcagcccccagccgccttcattggtggactgtgcggtaacggaggatgaactcaaatcagtacgcgcttcggaacgagaagccgcagtcacatcgctgatgcgcttaatctgcgtggtcgtcgtggccggatcagccacgaacgagttcgtggcgtcttcattgttggaaaacgcgagagcacctgcggccgtgccgaccagagcggccagtgaggccgaggcaagaatatggctacggcgttcagcggcacgagcggcctcacgaatggaacggcgggtctggggagcgatttcgttgatcttctcggcgatggccggatcaagccccaaaacaacggcgtcgctaccagcggattgcaccgcacgcacagcacgaacggaatgagaacccttgccggaggcaaacaatgccttcgctaagctgaacttctggcgcgagaccgtggtcgctttatgcgaagcatgcttcatactacgttaactccttggatgggttcggcggggtcatttcgatgacctcgtatgaccgtcacaattgagtactgtacaacgaacagaggtcaatcctcaatgtgatcccccaccatccgggtgtgtcaaacgatttacgtaaccgtgcggccgggtgaaaaaactgccttgtttccgcccgttcacgaacctcactatccggttatcggaagaatcactaactcatgtcattccgacacaccgtaaccatgatgtgctgcgtacattctgcactgcattccgcattgccaccactgccgcccggcaccccggaattccgcagtaaccccgcagtaatcccgcacaccgagcattatccgcgatattccccaacactggtctacccttgaaaccatgactatcacactgagtattcccgagtcgctgaagcccgaagatggtcgcttcggctccggccccagcaaaatccgccccgaacagatcgccgcgctcgacgccggcgccaccaccctgcttggcacatcacatcgccaggcaccagtcaagcaactggtcgcttcgattcgtgaaggtctgcgcgagttcttccacctgcctgaagggtatgaggtggcgcttggcaacggtggcgccagcgcgttctgggagattgcctgcgcttcgctgatcacccgtcgcgccgcattcggcacgtatggctcgttcagtgccaagttcgccgcgtccgccgcgaacgcacccttccttgaagacccggtgctgttccccggcgagccgggcacttaccgtctacctgagctcaccgagggcgtggacacatattgctgggctcacaacgagacctccactggtgtggccgccccgattcgccgcgtggccggaagtcgtgaagctggtgccttgaccgtcatcgacggcaccagcgcagccggcgctttgcctgtggacatcagccagaccgacgtctactacttctcaccgcagaaggccttcggtgccgatggcggtctgtgggtcgccatcctctcccccgaagctatcgatcgtgcggcaggcgtcgaatcaagcgctcatctggaaggcgcacatcgctgggtgccgccgttcctctcgctgaccacggcactgaacaactcccgcaaggatcagaccctgaatacgcccgccgtggccaccctgatcatgatggaaaaccagattcgctggctcaacaacaacggcggcctcgcctgggccaccacacgttgcgccaagtccgcatccatcctgtactcgtgggccgagcgctccgaatacgccgctccgttcgtcgtcgatgcggacgcacgctcgaacgccgtggtcaccattgatctggacgagcgagtccaggcctctcaggtactgtccatcctgcgcgagaacggcattgtggacgccgccggctaccgcaagctgggccgcaaccagctgcgcgttggcgtgttcccctcggtggaaccggctgatgtcatggccttcaccaagtgcgtcgactacgtggtcgagcacctgtgatggcatatatgccccgcattgccgaccatatatgccatgcacattgatcggtctcaactgatgccgattgaataaatcgtagggagggatgtttgacgcccctccctactcttactacagtgcatgagtatgaagttcgcgcctctcattgaccctgccgtccgcaaacccgcacccaagcccgtacgggtggatctgcgtaaggtgtttgccatcggtaccggtctatggattgtggcgttgattgtcgtgctgattctgctggccgtgggctacagcgtaatgccgttggtgattatgtgcgtggccggcgtcattattggcttgctactgctggtctgggaatacttcgaccgctgggactaccgccgcctcggacagtaacgcaacacaagctccctctgatgacgggagctgtcagcgtagctgattgagggagagaccgcggccgcaggtcgctcatcaaacagcattggtggcatgcaaggcatgccaccaattccttacctcactgcgccaatggcaacgtaaggctgaacgtactgccttgcccgggcgcgctccatacggtcacatcgccatgatgggtcagcgccacatgcttgacgatggccaagcctaggcccacgccatccgccgtgcgattgctctgttccacgccccggtagaaccgctcgaagatgcgcgcctggtccttcttagcgatgcccgtgccttggtcaatcacgcgaatcaccgcgcggtcgccatccttgtctttggatgcggacacgctgaccacgccattttccttggaatagccgatggcgttttcgatgagcttggtcacggcgctgtcgatctggtccgcctcaccattgatgactagatcatcgtcgcccttgatgttcagctgcacgccagcctcggctgcctgcggctccagtcgcgccgccgtggccctgagctgttccataacgttcagtcggttggcggaagacggcgtaatcggctcctgcgcgcgtatgagcagcagcaaatcagacaccatgtggttgagcttgctgcagctggaacgcacctggcgagcgtcggcagccacctgctgttcgtccagattgccggactccagcgaatcggcgagtttggccagagcctcagtggggcccaacaattgctcggacacattggtaataaacgagtcacgcacttgagcgaaacgaatcacatcactgacatcggtaatcaacacgatgacgaactgctcgttgatacgccctacagtcaccttcagccagttggggcggtggacggactgcgtggcgacgtgatcgcccttgttctggtctgcgacgtaccgctccggagtatcggtggtcaagtcgaactggcgcttgccaccggacttgcgcgcctcgtgaatggcatccagcacatgctgctgggcaatggcgtcatctgacaccacacccaggcggtaggcggcgggattgcagcggaccacctcgtcgtgctcgtcgaccaccacggacgcacctggcagcatggacagcagcgtggcggtgtcgtcggacagatcgtcattgtcgtcatcatcggccagcggcgattccatggacactcgatgtgtcgcaaatcccacgatgagcgtgatgattcctaccacaaataaaacagccgtgacaataagagcaatcgcggcgacgagcggcatctgtgtcatgcccccattctttcacaccacacgccgggattgcggtttgccggcacgccggtaacatgaatttcaggtgaacaacccaatgaacagtagaacaacttgaggttgccattacctacgttgaagtggggaacaagtactggaataatacactggtacaggttgcaataagcaagcatgaaaggctagagaaatgcgcgttattttcaacgaggagctgaagcaggttgctgacgacctcgaccgtatggcgcagaacgtacgcaaggcgatcaaaggagctggggaagccctgctgaatcaggacgttgaagccgcacagactgtgattgacggcgacatcgaaatcgatgccctggagtcctctgtgattgaccagtgcgtcaagttgctcgccaagcagaatccggtggccaccgatctgcgtgtggtcgtttccaccatgcgtctggcttccacgttcgagcgtatgggcgatcttgcccgccacgtggccgaggccgctcgccgcacctatccggccgccgcgattcctgaatccgctcaaccggtgttcgccgagatgatcgacttcctggacaacaccgctgaccagctggtggccatgctcttcgatcgcgatgccaagaccgccgaggccatcatcctggctgacgacaagctggacaatctgcaccaccagaccttcgatctagcgctgtccgatgacatcacccgtcagcagaccgtggatatcgtgctgctgggccgcttcctggagcgtctcggcgatcacgccgtgtccgccgcccgccgtgtggtgtacatcgtctccggcttcgaccccactaaggagccgacccgcgacgagggcaccgacatcgactgattgggacttgttctcacattgggcgaataactgaacacttgttctcctgtggtttgaggaggatgcccgaaagcggcgatccggctacggctggacgccgttttttgttgcttttgggcggtacaccggcgtatccatggggcggcaaaacacccatagggcggtaacttgcccatggggcggtttgaaggatatgtgaaaccgcggaattaagccattctggcataccgccccatgagggttttaccgccccatggggtaatcaccgccccatggggatttggcaggcatagcaaaggggagccgcacgttatgtgcgactccccttacagcttgtaccgtgttagcggcttaggctcacttctggccctgagcggcgacagcggcggcaccggcagcagcagcctccgggtccaggtactcgccacgcggcttgatcggcttgaagttctcgtccagctcgtagagcagcgggatggcggtcgggatgttgaccttggcgatctcttcctcagacaggttgtccagcatcttgacgatggcgcggagggagttgccgtgggcagcaatcagcacggtcttgccggccttgagctccggctcgatagcggactcgaagtacggcttcacacgctcaacaacgttggccaggcactcggcttccggaaccggatcgccggcgtagcgcgggtcgttgttctgggcgtactggtcgttcgggtcgatctcgggcggcggggtggcgtaagaacggcgccacagcatgaacttctcgtcgccgtactcttcgcggatctcggtcttgttcttgccctgcagagcgccgtagtgacgctcgttgagacgccagtcacgctgaaccggaatccacagacgatctgcggcatccagagcgatgttggcggtgttgatggcgcgacgcagcagggaggtgaacacgatgtccggaaggacgttcttctccttgagcagctcgccgccacgcttggcttcggcttcaccctgctcggtcagcggtacgtcgacccagccggtgaactggttagttttattccatgcgctctgtccatgacggagcagtactagtttataagtcatacggttcagtctacagccgcgtgcgcccaaacacgagtattcgtcttattatttcgctctcagagcgtcacggaaaccgccagcaccaccgcaaacagcaaggtctggaagctggcggcgggcagagccgggcggaattgacgtttattcacgctggagaccatgcgcacaggtattccgacgcccgagatcaacagcactgcgccccacggccaccatagggtcgcgcacatgagcagggctatggcccacgcggccacgcagcacacaatcagcagcgtacgcgcgccggattcacccagccgtacggccagcgtgcacttaccatgctcacgatcctcgtcgatgtcacggatattgttcaccatcatgatcaggcaggagaacaggccagccgccacagcacccaatagtccgccgacgtccaccgtgccgcacagcgcgtattcggtgcccaataccgcagccaagccgaagaacaggaacacgccgacttctcccagcccgacgtatccatacggatgcttgccaccggtgtagaaccagccggccagcaaggaggccacacccacggcaaacagccaccaagcttgggaaatcacgatagcggcaatgccgcatatgcaggcgatggcggcgcaaatcatcgccgcgaacagtacatgcttggccggtaccagtccggatgcggtcagtcgctggggtttgcctgatttcgattcgtccgtgtcacgcccggcgtcagtgccgcggatgccatcggaatagtcgttcgcatagttgacggcgatttgcaggaacagcgcgactagcaggcacaggatggtcaccggccagaatcggtccatcagcagggtctgctgttcacgggccgtggcgcaggaggccggttcgggatatattgcgatgcaggtgcccgactgctcgatatgcgcgtatgccatcgtcgccccaaccatcaccgacgcgatggaagtggccaaggtcttgggacgcgcgccccgaacccacaagccgatggacataagcaatccctttcatatataactcggctcccctctctgaggggagccagagtatgcctaatcagccaacgagcggcttgaccagcgggaaggtgatggtctcgcgaatcgtggcaccggtcaaggcgataagcagtcgatcaatacccatacccataccgccggccggaggcatgcccacgccgagagcctcgaggaagtcctcatcgatgtcgcaagcctcttcgtcgccagcgagcgcgtccttggcctgagccacgaaacgttcacgctgcacgatcgggtcgttgagctcggagtagccggtagccagctcgaagccgcgcacgtagagatcccacttctccaccacgccgggcttggtgcggtggcccttgaccagcggggaggtttcgaccgggaagtcacgcacgaaggtgggctcgtaaagcttgtcctcgtagaagtgctcccacaggtgttcgacgagcttgccgtggttctccacgtcgtcgcgctctacgccgagcttgtcggcgatggcgcccaggtgctcaacggaggtgccgggggcgtccgggccgccgttcggcacaatctcctcgcccaacgattcggacagggagtcgtacatgctgatggtcttccattcgccgccgaagtcgtattcggtgccgtcgagcagggtgaccttgtgcgagccgtagacgtccatggcggtcttctgcacgagctccttgaccagctggccgatggaatcataggtgccataggcctggtaggcctcgaccatggtgaattcgggggcgtgcgtggcgtcgacgccctcattgcggaagtcacggttgatttcgaacacgcgatcgatgccgccgaccaggcagcgcttgaggaacagttccggggcgatgcgaaggtacaggtcaaggtcgaaggcgttcatgtgcgtggtgaacgggcgggcggccgcgccaccgtgcagggtctgcagcatcggggtttcgacctcgaggaagtcgtggtcgtcaaaggtgcggcgcagggaggccacggccttggagcggttgcgcaccatgttgcggatgttctcgtccgcaatcatgccgatgtacggcttgcgggtgcgggtgtcttcgttcaggtccttgtgcagggccggcagcggctgcagggccttagaggcgatagcccactcagtggcgaatacggacagctcgccggtcttggaggcgatgacgcggcccttgaggtacaggtgatcgccaaggtcgacgagctgcttgaactgcttgagcgagtcggcgccaatctccttcttggagatcatgccctgaatcttggtgccgtcaccggcggacagctgcacgaagcacaggccgcccgcgttgcgcaggaacagcacgcggccagcaatgccgaccatgtcttcggtctcttcgccagcctcgagcttgccgtcatacttggcgcgaaccgcctcgatggtgtcggtgacgtccaagtgcaccgggtagggggcgatgccggcctcaagcatcatcgcgcgcttggccacgcgcatctgcacctgctcggggtgggccagcgggccgaactccttgttggaggggtccacggcttcgtccagcgtggcaccggacttgatcttctcgcggatggtggcgtcctgcttgagcagcatttccgcacgttcgacggtgctcatctgcgggacggccggggtttcattctcagtgttttcggtattttcgacaacttcagccatgattcatcagtgtacgcaaggccggcgattatgagcccggcagaccgcacggccatctgaacacccgctcacatgacgcaaaaccggccctgcacaaggcttgagagacctgtacacatggcgaatccaccatcacgcaacactcgcgacatgccgatttgcattgtccaccaccacaatgtaatatctacatctgttgccaaacgggctgtagcgcagcttggtagcgcgcttcgttcgggacgaagaggccgcgggttcaaatcccgccagcccgacaactggaccggattgttgagaaatcagcaatccggtttttcgtttcctgtcccaacaatcaaaccaagcgattgaacagcggtaaacaacccgccgcacacagcgacaaaccacatcacggcaagcccccgtatttgttggcggaccaccgtaatatatcgctcgaatcaatcgattgccgcactgtttttgtaagtaatactgaagtaattagaggaaccatgaagaagagtctgcttgcactggcttcgggcgcgttcattctcggtgccgccgagttcgtgatgatgggcattctgccgcaggccgcggccgccaccggcgtggacatccccaccgcaggccattacatttccgcgtatgcgatcggcgtgtgcttcggcacactgattctggtattcggccgcaaggtgccgccgaaggacctcatcatattgtttatggtgattgccttggtgggcaatctggcttccgcattctccgtcaatgccgccatgctggtcgtcgcacgattcgtcgccggcctgccgcacggcgcattcttcggcacagccacactcatcgccaagactctggcggaggaaggcaaggaggcgcaggccgtatccgtgatggtcaccggacagaccgtggccaatatgctcggcgtaccggcgggcaccttgatggccgagttcctttcctggcgtcttgccttcggcattttggccgcttgggcggcaatgacgattgtgctggcgtcggcgtggattccgtacgttgcaccgatcaaggacgcaggcatcgccggtcacccgccgtggcccgtgggtgattttggccgccgtgttcaccggcaatgccggtgtgttctgctggtggagctacgtctccccttggctgcagaaaaccggcggatggtcgtcttccctggtgccgatgctgatgatgcttgccggctttggtatggtcatcggcggtctgcttggaggtcgtctgaccgaccattggaggcatgccggcgcggccgcaataggtcagtccatctcctgcctcggcttgttgctggtgcttatcactccgggtaatcagccgatgaccgctgtactgacgttctggatcgccatcggattgttctttacttccgctccacagcaattgctgatgaccgaagccggccagggcggcggcgagctgatcgccggcgcggctgtacaggtggcgtttaacttcggcaatgccatcggctcgattgtcggcggcgcgatgctcaccaccttctcgatgaactatcgctataccggcctgggcggtatgccgctggctctgcttgccgtagggctgctggccttctactcgtggcgctgcgaaaccgataccgacgccattcaccgcttgcgcgaaaccaaggtggactgagaccaagctcacagcaaactccctgacgtgtttgttcacagtattaatagactgaaatcagacacgattcagggaggtctggcggtatggatgaggaagcactgctcaaacaattcgccgcgcaattcgcgcatggtccagacgatgccgacgacaccgatgcggcggccgcagcacaaggtgccgattccacggcgaaccaggttgcggacgatgccgatcaatcgcccgcaacctttgatacccaacaattcctgaacggactggacgcgattttcgatcgccacacggccgccaccgaagccggcccgtacttggaacaggcgatggtggacgcggaaaacgccggcgacgaggccggactgctcaccgtgctcaacgaaacgatgggcttctatcgctcgcaaggtcggcacaaggagaatcagtggattgtgcagcgagcgctggaactggccgctcgtatgggcttgaccaccggcacatccgaggcgtgggccaccacgctaatcaattgcgccacctcgatgcgcgcggccaaacaatacgatcaggccgaggatttgtatcatcaggcgcagagtgtctgccggcattcgctggtgcccaccgaccgtaggctcgcagcactgcacaacaatctgtcgatgctctacagcgagacgaatcggcccgacaaggcggaactggagttgcgtgaagcgctgcgcattatcgaagcctcgagcgtgaacccggacgcggatatcgacgtgtccagctcgcacacgaatctggcgttgaccctgctgaccgaacacaagttggaggacgcgcattggcatgcagccaaggcgctggaaatctatcgcaccggccatctggaacattccgcgcattatgcctccgcactggcgggcttcgcgcaggtgtgctttgccgagagacggtatgcggatgcggttactggataccggcatgcgctggccgtgatcgaggaatgttacggcaaggacaccgattactggcgtatcaccgccgacaatctgcggcaggccgaggaagcggcggcgcaggccggggtgacggttgacaatgcaggtgttgccggcgatgcaggcgcgctgccccagtccggctcgcggctgccgaacagcccggcacagggcaagaccggtgcgaacgcggcatcttccccatccaccgtttcggtgtcgaccggttctgcgggcgcggccgaggccgtttccgcatgcccggtgtccggactgaagctggcccgcgcgttctggacgcagatgggcaagccgatgattgcggcgaagtatccgcagtatgccgggcgtatcgccgccggtctggtgggtcatggctcggaatgctacggattcgatgatgcgtattcgcaggaccacgatttcggcccgcgcttctgcctgtggcttacggatgaggattacgcggcgatcggcgagcaacttgaggtcgattacgaggcactgccgcgcaagttcagcgtggatgcgcaaggccgcgtgacgttcgaggcgcatgccaggtccgatgcttccggagcattcccctccgcaggtgcaggctccaccgtcatacccgatgcggcaaacgcacccacccccggcaccgctacgcacgataccgccactgccgagtcaggcgcggcgtcctctgatgtggcggaagcgatgacgactccgattgatgcaccgctctcccccgtcacgccgcgcgcacagggcacgaatcgccgtgacggcgtgttccgcatcggtgacttctttgagtcgatcaccgggtatcacactgcgccggcgcagaccgcgccgcatgagtggctaatgcttcaggaatcgaccttggccgccgccaccaatggcgaggtgttcgccgatcccaccggtctgttttccaagacgcgccaagggttcaagaacatgcccgacgatgtgcggctcgcgctgatctccaagcgactcggcatgatcgcccaggccggtcaatataatctgccgcgttcgttgaagcgcggcgacggcgcggccgcatggctgtccatccacgagttcgtgcaggccaccgcctcgttggtgttcctggttaacgtgccgatggtggtgggctatatgccgtattacaagtggcagttcgcagcattgcgcaagctgtctggctcgatgttcgcgctgttgccgaacgtgggcgaacagttggaaaccgtgatgcgattgagttcggcagcctgctatggcggggccggatttggcgaaggcggcaagggcgcggctccagcaatcgagaaaatcaacgatattgtggagcagattgcggtggatatcgtcaaggaactcaaacgcgaacacctgaccacgtccggcgagaccttcctcgaatggcagcgcccgtatgtcgaggaccacatcgcctctgatgatccggtgcttaaaagtttgtagattcaagctccctctgccacggcttcgccgtgccacctccctcatcagagggaggtatcagtgaaaggaacgtcgatgaccaacgaactgactgatgatgaactgcgcgaggctattgtgcgtcatgaatgggatcagttccagcgcaccaacaatgagggtggacgcgcggcatgccaaggcaactggccggtgttccaccagatgcggttggcccagttcctcacatgggagcggccattactcaccagctatgccgctgatcttgacgcggccgaccacgtgggccgcaacctcgtgaccgaaaaatacggccgcatgatggcctccaccgcaccggaaaatttcacgaagaacatagagccgtatattccgcgtctctctgaagagcgcgcggcccgtcaggaacaggtcatcgcccagcaggtcgcctgggccaaggatttccgcgagcgctaccccaagctcggcgaggcgatgcgcgcactcaccaccaccgaagacacaccatctgccacctcattcgaaacctatctgcgcggcgagcttggtacgtattccgaccagaccttcgaacgttacgaagcgatgattggcgagcgcgccgcagccagcccgcaacgcaatatcactgaggaaaccttgttgcacacagtccagctcggcggtttcgacaccttagaggaggccgaagcctcccaagcgtaatactcagccattcactgtgtatcggacaccccgactgatgtacgtcggccggccatacccaggccaacgcaatctgccgatcgccccacacccagaccaccaacgcagcctgcccgccaggccccatttaccagcgcacatcggcagaattacagcgagaataggccccaaaatgccagtgtcatcagtgtggcgagagtgccgagcgctaccatcacgcatatgacgcgccgcacaccgacgatatcggcgcggcaataccagacacgttccatttcccaagcaaacagcaccaccaacagcatggtcgctattcgcagcaccacccatccgacggcaaacagccgcggttgaggcataaccaatacagccgatacgcctacggcgctcatatagccgtacaacagcccagtaatcaccatcaccgctgtgccgataccggcagataagccggcaatgccgtgcaacatgcgccgctgggcggcccccagctcactcggcgtcgcatgcacggcccgcacagtcgccacactacgtcgcccggccagcaacgtctgtagccaagaaaacacagtcaagccaatacctaatatcgccgccatcacgatcagcacgggccctgccaccatcagaccggccagcacgccaagcgagccgacgataccggatctggtacgttgcgacgcggcgaagcgctggtgaggtgttgcaccggcgacttgaggcgttgcccatccatcggctttggttccggcagtcacaccgttcacccaattttccagcgcttgcgtatagccttcggccaatggcaggttcggggtgaataagccctcaccagcccgcatctgatggttgccggcaaaatagcgtacggtgacgttctcgttgccggacttgttggccgtagcgatgatccgctgcgccccctgttcgatgggcatggccgtatcgtaggtgccgtagttcaccagcaccggcatggtgagggatttcagataccggtcggcatcaaagtcggcataggctagatcaaatggcgcgtagtccagcgacatcaatttggccatgtctttgaccacgggcttgggcgcgccggcctcatgcgtataggcgctgacagccatggccatttgctcacgtccattgaacaccggtgcggatgtaagtacggcaaaggcaatgtcttgccgtttcgaggttagaatcgtggcgatccaggtgccttcggattcggcgtagatgccggttttggcggggtccacgccgattctgccacgcaacacgtcgagcgaacgcccgtattcgcgagcaaaacgcgggtagtcgcgatgcagcacggtgtagttgtcgttgcgcttggccggcaccaaggtcacgataccggcagaggccatggcgttggcgatatcgccgaaatcctcggcaccactggtaccggacccgtgaatgaacagacaagccgggcgtggcccgggagcgccgaccggttcacgtagtacggcgggtagcgtgacgccgtcgccggtcttgatggatagtcgggtttcacgcgtacgatatcgcccctcgtggggaatgttcgcatgggcaggggtgatggtggtgtcggcagaagcgataacgatgtgcttggtgtagggccgtgtgttccattgcggcatcatcgcccagccaagtgtggcgaataccagcgtcatcgccatcgcggtgacgatgacgctcgctacccgccgcaccgaaatccgcttcatagttactatgcctccccccatcagcatagaacggtcggctcttatcggtcggctcccgtcataatgtgcttctactgggaccgtaatgcaatggtttgtaacgctattttctcttcttgacggcaccgactatggcccatacaacggccactattaccagaatcagtcccactacggcgcaaataacagccgtcagcaattgcggattcggcgagaacaacgaaatcatccgatccggagatatgtacccgaaaaccagcgcgatcacgccgataatcacgcctaatagtccgaataccacagtaggcgcgctggtgctctgtttctggatgttcttggcactcttgacatccttagcattctggacgttcttggcgctctggacgttcttggcgcttcccccaggctggcatggtttgccggcggtctgagactgcccatagggaggtcgtgctgaagatgctgcgtacatcggcacatcatcggcagatggaatcggcccaccatctccctccacggcatcggcaactgtttccagggcaatccgatctgtggttggttcgatgggcgatggagaggcagctgttgcctgcgtatccacatccgagaccgacgcatccgcatgattgtcggggacgggcagcacagccgtttcgtcatcatccgctgcggatggcagcaccgtggtatcggttcggtcatcgacggtcaccatggttgtggtcgcggtggtcgcgtcggtttcggaaggtatggccgtggtcggtgtcgcatcctcaatggaggcgaattccttggtttcatcagtcatgattccatctcctagttgcaacggcttgatcattccgattgttcggttgtgttcttgcttgtactgttgccgtcgtatatatcggcaagcggctggaacgtagagccttcccaatcggaggcgtacaccacgttgacacgtgcttccaccacatagggaatattgatttttaattctgggccgttgtccggcatggcggattccttatacaaccattcgtgatcaggcccattggtggcactttcagcttcgaagaaaacaaagcttggacccatgtagttgttgtataccatctcgtatttgccgccaacgtcactcgaagtggagtagtaggagtcggcggtgccgaaggcgtaagtgcaggaatccggcagaacgatatgcacttgcgcctgtgttgcggctatggtgatggtaccgaccgggcaattactgatggaagttttgccatccagcatcttcaccgtgtgcggtccatgtgtcttgtcccaatcggaccaatcaatgattgcctgatcggtgttgtagttttcaccgctgaacgccacaccttgctgcaatgtttcaaacgtggcatcgctggcatcggcaacgaagatgccatccttttgcacatcgttcatgccgtcgctgtttctcgcactgacagattggctcagtgaaacaacagtattgatgccgctggcaccaagatcacggtagtacacgccatacgtgcctgaaacgatggtcatgcagagcgcgcatccaccggcaaccagtccgagaggaatcagaccaccggtacgccgtcctctgaatccgagaatgatgaccaccagccccatcactatgcatactgcggcaatccagatggtgcccagacgcataatgccgataatgcccatgtcgtttacccaaatcagtcccatcagaccggcaaaggagaggaaggtaaggcccagtatgctcaagaccacgattgggcccgccggcttgcggcgcttggactcggtggggcataggccgtcgcattcatacggtcgggggcaaacggcccgttgggtactgtgccgggcatcgcgccgggcacagtacccggcatcacgctgggcatcgactgatagacaggctgtgaaacaggctgtgaaacactaggcgcggtttgtgaaacaggctgtgaaacaggttgtggaaaaggttgcggagctgaatacaaaggagattgaggtactggttgcgcggctggatatgagacaggctgtggagctggatatgacacaggctgtgaaaccggtcgcggcgcagatgccccgaatccgtacccttcctgctggcgaatgccgcttttggccaacagccatagcgctaaggcggcgagcgcaatacaaccccaccccgcacctggaatcacgattgccacggcgaggaacaggaagcatcccagacaattccagtcccattggccggcaatgaggtcctcggccaagatgtgcccatcgcgtacatccggcatcagaaaccagccgagtgcgtacagagctgcgccaaaaccgaagaacaatgtacatacaatcaccaacgcacgtactaatgtggggctccagccaagccgtaaagcgatgccgctgcatacgccgccgatccaccggtcgtcgccgcgaaccagtccactggatcgcacccaagtgaagaagcgtcgcgatgtcttgtttttttgcggaccaggctgcggctgtggctgatatggattcgcgtttggattgctcatgattccattacaccgcccgaccactgccacaacgctcggggaacaccctgattgttccctgaacaccgggtaaaaccccggccgcaacgccctgagcgcggcacaataggagtatgacgtcatctcccgaaccattgctgcccgcgcgcatgccgttgatgcgcccccggcagggccgttggctcaccggcgtgtgcaagggcatcgccctgcacttgggcatcggcgtggcatgggttcggattgcgttcatcgcactgaccgtcctctacggcgcaggcatcatcgcttatgtattcctgtgggtgttcatgcctgccggagacccggtggcggctgcggctcgcacagtgcccgttaatcaggcgccgcttgcgcgaggcaatcagccacttgccgctcatgacgacgaatcggctgccgcaccggaatcattgtccgaggccatccaacgtgctccgaaaccggccgtcgtggcattggccggtttcgcgttgatggccactggactgttgctcaccagcaccggtgcggatgtccagattgtgtttccgctgctggtagggttgggcggcatcgcactggcatggatgaatcttagtccgcgaggcacgcagctgttgtctatgttgggcggcatcgcactgattttcatgggatgggcattgtatgtgcataatgtcagcattcctgggtggggcacctctcctcgacgcattgttgccagcggattcgtgatgatcgtcggtatcgtggtggcggtgatgccgtgggcgaacgcgatgctgcaacgactcacccacgagcaggcattgaaggagcgcgaagaggagcgcgcggacatgaccgcccatctgcatgatggcgtgctgcaaacgttggcgctgattcagctgaactccgaggaaccgaccaccgtattcgccctggcgcgtagccaagagcgcgagctgcgcgaatggctgtatcaggaacgttccacatcggatcgttcggtgggagccggattgaagcagatcgccgccgaggtggaggacgagcacggcaagccgattgaggtggtcaccgtgggcgacgcgcggccgagcgcccagaccgatgcgctgctggacgccacccgtcaggcgttggtcaatgcggtcacgcatggcggcgagccggtgtctttgtattgcgaggccagcgacacgatggttgaagtgttcgtgcgcgaccatggcgaaggcttcgatatggacgccattccgcccgaccggctgggcatccgcgaatcgattatcggccgcatcaaacggcgcggcggtacagtggagatagtgtccagggccggctggggcaccgaggtcagaatgcatatgccgatcgcgctgaaagcggcgcagggagaacatcgatgagcgagaacgagacagccaagattcgtgtggccatggtcgatgaccatgagatgttccgtgcgggcgtaatcgccacgttgcgcgattccttcgatatcgtcggccaagcggcggacgtgcccggttcggtggcgatgatcgcacagaccaagccgcaggtggtgttgctggatgtgcatgtgcccggcggcgagggtggcggcggtgccgagatcctcgccaaatcgcggccctactcccccactaccgtgtttctggcattgtcggtttcggatgcgccgcaggatgtggggtcggtgattcgcgccggcgcccagggctatgtaaccaagacgattaccggcgctgatttgatttcatccatcaagcaggtgcatgagggctatgccgtgttctcgccaaaactggccggttttgtactttcgaccttccagggtgtgccggcggcggggtctgatggcggcgctgatggtgcggcacgggctcatgatgaggagctggaccggctgtccgcccgcgagcaggaggtcatgcggctgatcgcgcgtggttacacgtataaagaggtggcggccgaactgttcatttcgatcaagacggtcgaaacgcacgtgagctcggtgttgcgaaagcttcagctttcgaatcgcaccgagctcacccgctgggccgccgataggcgcattgtgtgataaacgacagatgagctccctcatcagagggagctcatctgctcatatcactccgcgtcgcggaaaccgttggggttcttggtctgccagttgagggaggaggcggccatgtcgtcgatggtcagctcggccttccagccaagctccttctccgccttggaagcgtcggcgtagcaggcggcgatgtcaccggggcgacgcggcttgatcgcgtacggaatcggatgaccggcggccttctcgtaagccttgataacctcaagcacggagtagccgtggccagtacccaggttgtagacgaacacgccttccttgtcgatgtggtcaatgacggccacgtggcccttggccaggtcgaccacgtggatgtagtcacgcacaccagtgccgtcgggcgtgtcgtagtcgtcgccgtagacctggacttccttgagctcgccgaccgcgaccttggccacgtacggggtgaggttcgccggaatacccttcgggtcttcgcccagcaggccggactcgtgcgcgccgaccgggttgaagtagcgcagcagcacgatggtccaggacggatcggccacatgcacgtcgcgcagaatctgctcctggaacagcttggaggtgccgtacgggttggtggtgccgccggtcggcgtctcctcggtgatcggcagttccttcggcgtgccgtacacggtggcggaggatgagaagatgatcttcttgacgttgtgcttcttcatcaccttgagcagcacaagcgtggagtacaggttgttgtcgtagtattcgatcggcttggccacggactcgcccacggccttgagaccggcgaagtggatgacccagtcgatgttgttttcagcgaagacgcgttccatgagcgcctcatcgcgcacgtcgccgtcataacgcttgaccggcttgccggtgatttgctcgacgcgctcaagcgccacgggcgacgagttgccgtagttatctacggaaataacgtcgtagcccttgttgagcagttcgatgtcggtgtgagtggcgatgaatccagcaccgcccgtaaccagaacagtagtcatattccctcctttggaaggacttgccttcggtttttccttcagtattgagcttacttcacttgacctgtttcacctagcggcaaaaccaaggctttcgaggaatgtttgcgtggtggctttctgcttgaagacggccgtgttgccgaggatgcggtagcagacgctgccgagctcgtcgtgtacggcttggcggatggcctcgcggtcgtggtttccggccaacgtttcagcgagttcgccccattcgagactgaattcgctgacttcatcgggcaaatcgcggccttcggcgagcgcctcttcgacaatgccgagctggtcgacgagccgtccgggcagaatgaacaagccttgggcctcgatcagtccgatcggctcctgcttgaccggccagtattcggggtgtgcatggaaaataccttccgggtactcgtcgctgatcgcattgttgcggaagatgagactcatctcatagccgcgttcggtgatgatcgcgctgggcgagagggcggattggcggttgccatccgcgtcatggctggcgatgccgttcgccgcgtcgtcataaccgacccatgcctcgcggatgatgtcggatacgtcgatgatgctctggcgactcttcgacaccacgcgcacggcggtgccgggccagtcaaggatttcaaccacggcgtccggatagtcggcaagtgtgaaggcggcccaagtggcggccttgtgcatcggcagcagttcgccgccgccctggtaatggtcatgggcgagcaccgagccgccgatgcgaggcagcgcggcgttgcatccgaggaagtatccggggaaacggtccacgaagtcgagcagatggccgaaggtgtcgcggtccacatgcatcggcgtgtggtcggtgttcacgcagatgccgtgctggtcgaagtagccgtagggcgagaactgccagaaccatgactcgccgccgagcgtgaccggcaaggtgcgcagcgtgcgcttgtcacgtccggcgaagccctcgttctcatggcagatcgtgcacttcgggtagccgccggccacggcgttgccggccgccgccttcttcatgttcttgaattcgggtttggcgaggttgatggtcaccgtcagcccgtgcgagtcgaagcgcgggttccggtcgagctgggcacgcttgacataattgttggccacacagtagtcgtagaaccattgcatggcggccatgccgccatcccggtgctcgacgagcaggaatcggtcgtcgagatcagcggggttggcggagaggatgcccatgatggtgtcggcgtaggccgggccttcctccggcttgaaaaggccggcggttgtggcggcggcgcggaaggcggcgagcaggggtcgggggtcttttcgccatagggggcctggcttcggctgccaacaatgtcttggactacgtctgacactgacgccgccgacgttgtggttttgggtccggggtaggaatctaggcggaagagggcgaagatttggttgcgggtccagtctgcgttgcgtgggtcaaggtcaagatgggccaaggcataatcgatcagggcgtcgatgctggcgtatacctcggtcagctgatcgttcattgctctgcctccatcatgctggttcgggtatggttcggctgacggctcacctggcagcctccatgatgtcggctacgatggcgcgggtttcgctggccttctgctccatctcctgcacgagtttgatctgggtgcgggtgcgcaccagattatgctcggggtacttggtggcaaagtagatatcgccttccaagtagtcggcgagaaagcgcatgccgcattccatggtgagcaggttgccgctgaacggcagcagttcggcctcgcgcgcggtgatgctgccgcgtagttcgcccacgaagccttccgtgtaggcgcggaacagctcggtgctgaaatgcaccttgctgaggtccttttcgtcttccagagcagtggacgcaccaaagcgtatggaatcgccgaagtcgaacagcatggagccgggcatgatggtgtcgagatcgatgatcgcacgcgccttgccggtggtggcgtccatgaggatgttgttgagcttggtgtcattgtgggtcacgcgcagcggaatcgaaccgtccctgagcccatccatcacgacggcatactggtcggcgtgactcagatagaagtcgatttccggctggcatgcggcggcgcggccgagcttgtccgcggcgagggcggccttgaagtcctcgaaacgatgcggggtgtcgtggaagtgggcgatggtttcggtcagctggctggcgtcgaattcggacaggaagttctggaagtcgccgaatgcgctgccggcttcgcggaacacgtccgggttcggcacgaggttgtaggacacggtgtgttcgatgaacttgtagacgcgccatgcgccgccatcgatctcggcccaggtggcgcctgaggtggtgggcacaatgtccagcgtctctttgccctgagccttgagagtggaggtgaccagttcgacattgcgcatcagattcaccgtatcggggaagatgctggtgttcatctgctggaggatgtagcgggggccgtccgtggtcaccagataggtggtgttgatgtggccgtctccgtaaggttcgataccggtcacggcaccttccagcgcaaaatgcgaggcgatgccgaataaatcttcattgctttcagtcatgatgggtccgttctccaaaacgtgggatcaggcttcacgccaggcgataccgctgtcaggcaggtcgaagtcctcggtggtgccgtcggccaaagtcaccgtggtcttctgcggctgatcggtgttgttgattacgcaatacagcccttgctcggggaagtgtgccacttcgcattccggattggacgagctccaggccgcatacttgtcttcgttgtgggaagcgtagaacagcacgcgttccagcagtcgggcgttggccgccgaatagggcaggccggagatgtacacgccgcggcccttgccataatcgttggtcgcgagctgtacctggccgccgtccgcgcgcagcagggtcacgttttcattgaccggatacgtgttgagcacgggttcgccgaaatcgatgccgcccaacggcttgatggactggccgccgccgcagccgctcagcgggatgcggtagccggcctgctcccaagcctcgcgggccgccgggtcgaccggcacatcggcggtgatgaagtggtccggcaccaccggcgggaaatacttgtccaccgaaagggtctgatagcgctcctcgtccacgccaatcacgtcggccagctggaagaaccggcccgtttggaagcgcggtgccgagctcggctcgcccacgcccacgaacgcgccgccgccacgcacccaggcgcgcacggtttccacgagcttcgggttggtccacacatcgccgccggtgaatgcggtgtcgaccgggccgccgttgatgattacgtcgatatcgctatcgatgccatgcgcgagtacgtcgtcgaagctgatgaaccgcacgttcacgcgcatgccggacagggattccagaatgccgtagtaggagtaggtctgcttgttgggcagggcgtgtgccacggtgaacgccatccaggagcgcatcttgccccaggaattcagaatcgccacgttgagctcaccttcggcggccaccccaccggtgcggtcgtggatgtcgcggaattcgttggcgatatgggtcaccgtgtccacgaacttcgggaacttggcggccagggagagatagccgccgtagcccatgcggctgatcggcgagcgcaggatcgcgcggcgggccttgcgccagttgtcgaggccttcgatgctcggatcgttgccctcgtagaacgtgtcggggaagaagtacggcaggaagcggccttcggtgtacttgacgcccggaatatcggcgatcatgcgggtggtggtgccgtcgccgatggaaccgaccacggcgtccaggccgagttcgtcgaatccgtccttgtacggttcggtgccgatccactggtcgccgaggaacatcatcgcctctttgccggcggcgtgggacatgtcggcgagctgcttgacgttttcgcgcacgaagccggagaggaagtcgatccagtcgcgctgggcttttctgggcacgcgccatgcggagttgtaggcaccgccgtccacgaagtcctccgggcgcaggcggtagccatacttggcttcgaaatcatccagcgcacgcgggcttacggtgcaggcgcaaccaaaccagtcgacgaccttttcgcggcgcttttcatcgaacaggagcgtgaactggtagaagaacgtggtgaatcgcaccacatcggtctgcgggctgtccttaagccactgctcgaacgtgtcgaacacgaacttgcgggtggccggatggtagatgtcgaacgggatctcgtgttccttgtcgccccagtcgttggtcagatggttgtacatctcgaccgggtcccagatgatgtaggccaggaaactcaccgtgtactcatgccatgcggcaacgccgctcacatgcacggtgtcctcgtccgcgtcaagcgtccagttcgccgaatcaacgacctcgccggtggtgcggtctacaacctcccaatacttgtgagggtcggcatcacgattcggcttcagctgctcagcgaagaagctttccatcagcggaatatcaaccgtatccgattcggcgagaatgcgatcggtcagcagatacacctgtggcgtctcatccatatgcagcgtaatccactcgttatgcgcgcgagtcgggaaatacgcattgtaaatcttcttgcccaaggcaagcacagcctcatccagatgcgtgccatcggagttacgaatggcgtctgctccccacagttcggcaagctccttggtcttctccgcaaaattctcctcgctaggcaaggtgaagcggccggtgctagtcatagtctctcctttgaggacattgattatttttttggataattaaattgtaaacaatatatgcatataaaacaagaatccgacacaaccgtcgggcgtccaggatcctgactgtataaatccttgagagtagccccacggcaacgccggaagagcgaattgaacatcaccggagcttcccggtcagtttcaccgacaatctcatgacaagaatcaggaaggctctggatcggtatggttgcgtgctacttattgttgagaagccgtccggcgccggaaggagtagcacgaggcaccggacggcgggaattattggtcttaggctgtccgcttaacgcgtcgccttcggcccctgcaattaaggactcgcctacggcgagactcaatgctgccttcgctcggctaccgcctcgctcgggccgacgctacagacagcccaccgggctgtccgcttaacgcgtcagcccttgaccgcaccagcggcgaggccggcctgccagtagcgctggagaccgaggaagagcacgatcacaggcagcacaccgagcagagcacccatcatcagagcgccacgatcagtgaaggtagccagagagaccatgccgtacagacccaaggtcaccggcttcaaggtgtcggaagagaccatcatcaacggcagcaggaagttgttccaagtggccacgaacaggaacaggaagatcgtgaccattgccggagccagaatcctcaacacaatggtgaagaagatgcgagcttcgcttgcaccatcgatacgcgccgcctcaagcagctcgttcggcactgaggtctgcgcgtatacgcggcccaggaagaagccgaacggagagacgcagcacgggatgatgatggagagcatcgtgttggtcaggtgcatggcatggaagatggagtactgcggaatggtcagcagagcggccggcatcagcatgcagcccataatcacgccaatggcaaggttcttacccttgaagttgaactttgcggtagcgtatcccgccatcacagccacgagcgtacccaccagagcggaaacacccgagtagatcagggagttcagcacccagcgccagaactggccacgggtccaaccaatcagcgtgccatagttcttggcgatggcggcaggcaaatcgctcagacccacggcgaaccacagaccgttgctgccggtcatctggctcggcgtcttggtcgaggcgatgatggcccagtaaatcgggaacagaaagtagatcagcgcgaagaccagaacaacgatggtgatggtcttgaccagcgcggaaggctgcatggaacgaggcaggtcgttggcatgcttgtcgcgaatcctgtcagccttcttacgagcgcgtgcgaccgcgcgggattccttatcagtagcttctacggtgctcattctgcgttcaccttcctttcaacgagcgtgtagaccacggcgagtacgccagcgatcagtgccataacgatggccacagcggatgcaggtccgtcaccacccggggtcagcgtgccctgcgaggtattgagggccatcatcattggcgtgtacgacttggaaatgctcggatcggaaatcgacatcacctgcggctcgttgaacagctggatggtgccgacgatggagagcagcatggcaagcagggcggctgcacgcacgttcggcagcttgatcttcatggcgatctggaagccactggcgccatcgatgcgtgcggcctcgtacagatcgtgcggaatggcctgcagtgcggcgaggaagatcagcatgttgtagccggtgaaggtccaggtcgtgatgttggccatagagccgaggaccacattgtcgccgaagaagttcaccttgatgccgatggcggcaagtcccttaacgataggggaaatctggccgttgtagaggtacacccagatgatggatgcgaccacgcccggaatggcgtacggcaggaagtagctcagacggaatgcggtgatgtgcttgacgatataggaatcgatgagcattgccagagcaagtgccgcgatgatcatgaccggcacctgaatcacggtgtagagcactaccctgcccacgccagcccagaagttgccggaagtaataacgtattggaagttctgaagtccgacgaacttatcgaccagttccccgccgccgtatgcgccaccgcccgtggtgacctggcggaagaagctggaataaatagcccaaatgatgggaagaataaataccagagcgaacaggatgccaaacggtgccatgaaggcccagccggtacgattctcacgcttcacagcatcagaagcctttggcttatcggcacgcctggcgacccccgtcttcgccgtttttgttgttgcagtcatagggaaacctgtctttcaaaagaacagtgagaaatagaaagcacgtaatgcagttcgaatcgatgcagtcagatcaaacacaattaatgatgaaccgaactcgagtaaaaggaaaggccggagtgttgagctccggcctttcgatgtgtggttgaggatatcagcggctggaaggaaccctaaccgttaatgtcactcggaaacagacaggccgaagttcttcagcgtatccacagaggtggtctgtgcgtcggagaagatgtctgcaaccttgccggagccatcggtggccttggcggcggtttcgttcatcttggcggcgactgcggagaagccaggcatgtaggtgaagtcacccatgttgttgttagcggtcttgaattccttcatgatgtcctgaccaccgaagaaggtggaccactcggaaggagtctcagcgtcttcagtggtagcagccggcacgaggccctgggaaaccagatcaggaacctgggtgttgaaccaatccaggaactccattgcttccttcgggtgcttggagttcttcagcacggccacggcggaaccaccgtcagggccggtcttgccagcgttgccgaaccagtcaccgagctgagcgacctgccattcgccggagccggtgccaccggaggaggtcatgaacagcggggcttcccaagcggcggccacagtaccgatcaacgagccatccttgatggatgcatcgaaggacggatcccaacgcgggttggtggtggctgccttggcgtcgagcagctgctggtagaagtcagcggttgccttggagccatcggtctcggtgttgacgacccaggagtcgcccttcaccttgtaccaaccaccggaggcgccagccagaccggagatcatgttgccggcctcatcaggctggtaggacatgatgtacttgccagcggcggcagcggtcttggcagcggcgataaactcatcggcggtctgcggaatctcggtgatgccgagcttctcgaactcagccttgttgtagaagtaaaccagcgggccggtgtcctgcggcaggccgtaagccttgccgccaacctgaaccaggctgtacgggccggatgcgaagtcgttcttgtactgctcggcatactgggtcacatcctgcagcagacccttggtgaagacctcaggcagctcggcgtaaccgacctgagccagatccggagcctcgccggacttgacgtcggtctcaagcttcttgatcatgtcagaggccttaccatcgaacttggtggccttgacctgaatatccggatgctgcttattccacttggcaacgatgtcgttgaccagagtcatgccctcggaatccggcagacggtgcatgtaggtgatgttgaccacgccaccatcatcggtggtcttcgtgtcgccggcagtgtcgctgccgcaaccggccaagcccattcccattgctgctaccgcggcaaaagcagccacgatgcgcttattgcgagataccatatctctactccttcgtagtgaaatcatcatctcagtgtgatgactgattactaatgtatgccctcattcttttattgtcaacttagctaacaattaccgcgcgtcccgttgaggcgagtagcattaaaccggttcgatgctcgattgtgcgagtttgttcatttcattaactccccttacaaagcaacgtacttttggtccaccggtaggcctaatgagatattggatagcggcaacaatccaagacgttagcttgcaatcgtccaccgcaaattgcaagcacttgccaacattatcggttttcaggtcgccggcgcgatacccgaccagggggcaccgcaccttaatgagacgctacacgagcagtctcagcaactggtagagctgccacaggctacgcacgttgaagtgcgtgccgtcaaccgtggcgttcgcctcgccatcgcccatatggacgatcacggtgcgcccgttcacggtcagactaccgtgcatcgtgatatgattcatcttgcaaccttgttgattaaaggcgcaagccggtaatcaacgcaaaggcccgatgctgcaaacgtcgggccttttcttatcggctcacgccgatcggcccgtcatatcaacggggacaccgcatgttacggcatcacaaaccaatatatcagcaccccggcggcaatcaagaagacaggttccagaaaaagaaaaaaagggcctgggcatgttgcccaggcctcggttcgcggacagggcgagattcgaactcgcggagggttgcccctcaacggttttcaagaccgtctctttaggccgctcagacacctgtcctgatgcgcgttcacacgcgcaagtattcattatacagaagggagggatgttgatattcggcagtgcggtcggtcttggattcgcctgctggctatcagcgatctctccctcagtaatctctccctcagtcagctacgctgacagctccctcatcagagggagctaaagcacgatgagactcaggcctcccacttcgtgggctcgataacttccttgccgcccatgtaggcgcgcatggccttcgggatctcgatggagccgtccttctgctggtggttctccatgatagcgaccagccaacgggtggtggccaacgtgccgttcagggtggagaccgggcgggtgccgccgtcttccatacgctcgcggatgttcaggcggcgagcctggtactcggtgcagttcgaggtggaggtgagctcgcggtaacggccctgggtcggcacccaagcctcgcagtcgaacttacgggcggcggaggaaccgaggtcgccggcggcggtatcgatgatgcggtagggcacctcgaccttggcgagcatctcctgttccatggccagcaggtgctcgtgctccttgtaggagtcctcctgcttggcgtaaacgaacatctccaccttgtcgaactggtggacgcggatgatgccggaagtatccttgcctgcggcaccggcctcgcggcggtagcaggaggaccaaccgcagtagcgcagcgggccgttgccgaggtcgaggatctcgttctcgtgcatgccggcgagcgccacttcggaagtgccgaccaggtactggtcatcgggctcgcgcagacggtagatctcgtcggcgtgggagttcaggaagccggtgccgcgcatgacctcggggcgcacgagcgtcggggtgatggccagcgtgaagccgtgctcttcggcctggtccacggccatggtgagcatggcaatctgcatgcgggccacctggccacgcaggaaatagaagcgggagccgccgaccttgacgccgcggcgcatatcgatgccggccacgccggtgccgagggtcaggtggtccttgggctcgaagccttcggccgcgaagtcgcgaatctggccaaccttcttgacgaccacgtagtcatcctcgccgccttcgggagcttcgggctccacgatgttggagagcttccacatggcggtggtgtattcctcggctgcggaatcggccttggacttgtattcggagaccttctgggacagttccttggtttcggcgatgagcttggccttctcgtccgccggggcggaggcgaccttcttgccgatttccttctgctgggcgcgagcctcttcgaaggccttcagcgcctcacgacgtgcggtgtcggaggagagcacttcgtcgacgagctccacggactcgccgcgcttgcgctgggattccttgacgatatcggtgtgttcacggatgaattgaatatcaagcatgggcaccagactagccgcgtaagcagacaccgacaatggccgaatgcgcgggagtcacgcggaaatcacagggaagcccgggaaagtccgcggacgggtccacccggccaatttcgtcagatgagacgcgattgaaccataatcacgccccacggggctgttgcgtgcaggaaatgttcacgtacggcgcaccatggccgcaaacgacctccccaccgataacaataggagccatgcctcagcctgccctcaccgtgtttctgatcatcgccgcaatcgccattgtggtggtgctcatcgccgtcatcgtcatcgctctgcgcgcgcagcgccgccgcaagctggctcagacgctggagaagcgccgggacgacgaggtgcagtacgccttcatcgtgaatccgtccaaaccgcaggccgaagcccgcaggctgcatatccagaggttctgcgaggccaaggggctcaatcgcatccgcttctacgacacccagcttgacaaggacggcagggtctgcgcgcttgaggcgctggaggacggcgccgacgtggtgatcgcggtcggcggcgacggcacagtgcgcacggtggcgagcgccgtctccggcaccggccatgcgctgggcatcatccccatcggcaccggcaacctgtttgcccgcaatatgggcgttcccgtggacgatatcgacgccgcgctgaccgtggccacctcccacggctcccgcctggtggacatgggccgtctcaccctgctcgaccacccggaggacgaccacggccacgccttcctcatcatcgccggcatcggcttcgatgcggccatgatcgacgacaccaaccccgagctcaaggcgaacatcagctggctcgcctacttcgtgggcggcgtgaagaacctgttcgcgccgaagttccgcggcacgctgacagtcaccagcgccgacggctcgacccacaccatcaagaatctcgatttccgcacggtgatggccggcaactgcggccagattcccatgttctcgctgatgccggcggcatcctatgacgatggtctgctggacttcgaaatcatcgacaccaccggcggcatcctcggctgggccaacctgttcggcgacgtggtgcaccagacgatcatcggcaagcccgaacagaacccgctgtccacgaactcgaccatcgaacaggttcagggcgtcagtgccgaaatcacattggaaaagccggccaaagcgcaggtggacggcgacatgctaccggagaccaaacatattcgtttctcagtggatcatcgcgcgctgatcgtgcgcgtacccgacgcctccgcgctggaaaagaccgcacaggccgctgcctcaaacgccacctcggatttcgccgaaatgaccggcacgctcgagccgattcgctgatccgctacgatgcgtggccggtgactcgggcgacgtgcattgccagataggcggtttcgtcgtcgctgatatccgtgtcgaggcgcagttcgagcagggaggcgatggttcgcgcgcatcgtagcgcggcgggataggactcacgaatcaccttcatcaccggtgccggctcatccgtcagttgctggtgctggtggatgcgtacgaacaggtaacgcagatgggtgatgaacctgcccacattcacggaactgcggtccaacgtgatgccgtagctgtggtcgataatgtcaagcagttgctggatcacgcccgtcatcgtatacgtataggacaggtcgccggtggcgaagccggcgttgaccagatgcatggcaagcgcggtggcctcgccgtccggcagcgtgacgtcgagccgcgcattgagcgatgcgagcatcgcacgcccctgcgcgtattcctgcgggtacaggttgctcacctcgccgagcagcgggtaggtaatgtcgatgccgcgccgcacccgctccaccgcattcgccacgtgatccgacaaggccatgaccagcgtggtgctgccggtctcacgctcccccagtccggcttcctgcatggattcgacgaccacgcggatgatttcgggcggaatgtccgccagcatctgcgccagatggtccgggtcacgcccgtccgacggcacgaaggtgcgcacgactttcgactcgtcgaccgtctgccccggcttggcctggaaccccagtccacggccggtgagaatcacctcaccgccgtcgccgcctttggcgagcacgacgttgttgttgaacactcgcagtatttccatggcatcctttcgcaacgtcattgttccacatcgatgatcgggctgccggctgatacggttttgcagtcaccgccgttgttgtcgccgctaccgtcgccgatcaacggcgtgaccacggtcagttcagcggcgttgaccaccgtcaccaccaccacaacgctgtgcccggccgccgcgactttgccgaaatccacggtggccagtggctctcccgccgcgatccgctcgcctttagccacgaccacagcgaatccctcgccatccatatcgacggtgtcaatgccgatatgaaccagcacctcgatgccgccatcggttttaatgccgaaggcatggccggttcgggccacggttttcagcatgccactgaccggtgcgagcacggctgtctcaccggtcgtctccggcacgacgcctacaccctcccccagcgcgcgggaggcgaacaccggatcgccagtcgcttccagattcatcaaccggccggcgaccggcgacaggatggcgttggagtcaggagtccgatcggaggcaggccgcgatggggaatcttccgcagactccgcatccgacgatgtcgcgccaatccctctcaccgcatcctgcgagcgtacgttctcgcccgccgagaccatctgcgcctccgtggcgcgcggcggcgtacggtacccgaacagcaccgtcagcaccatcgccattacaaacgcaacggcgatggacagcgcgtacacccacattctgtcaaacaccggaatcgtcagcaacgaggagaaggcgaacgccgtagtcgtgacgccccggaccatctgaccggatggcagcacggacgggaacagccagccaagcaccgcgctggtcacgccgccggccgcgcagccggcgagcagccagcggtagacgcggcggtgatgcagatggatgccgtacaggctcagttccgaaacgccacccagcaatcccgcgagcaacgcccccaccgcggtctgccgcatggccgaatccttgccgcgtacggccagcacgagcacgccagcggtggcaccgaagcaggcaaagttccatacacccatcggaccttggacgaaatcgtagccgagcgcctgaatgttcatcagcatcagggcattcaacggccagtgcagaccgagcggcacgagaaacgggtagagcatcgggatgatgagcgcgaataggaacggcacgtgcgcgttaagccatgctgtggccgctcccagcccaccgccgagccatattcccagaggcccgataaccagtatggtgagcgcaaaaacgacgaccagtgagaggaatggcacgaacaccagctgtacgctgtcgggaatgacgcgcttcaacccgtggtagaccacggcgagcacggcagccatgagcaacggcacgaagacgttgccgccgtagtcgttgagttgaatcggtatgccgaacgccgacacggtgcaggtttcggtgccgaatacggcgttggccgagcattgaatcgccccggagagggcgctggatacggacgtcccggacattccggacatcacgccagtaaactgcggggtcatcagcgcggccataatcgcgccgccgagccaggggtcgacgtccagtttcttggccgcattgtaggcgatcataatcggcagaacggtgaacacaccctcccaaatcgccttgagtagtatccaaccggtggacgtctcgccatcaggcacaatgccgagtgcaacgatcacgttgacgatggcgatgaccagcgaggcaccgagtagcacgcccagaatcgggcggaacgagtcggacaggtagtcgaaaaacgcggcagcccgggcacgggcggcactgccccactcgcggatggtacgaggcatgaagtgacgggatgtattggctgggccgtgactctgctcggtgtcggtatcgcgcaatggtgcgacgtcgtcggaaaggttcggcgcggactgcgtaggctgcgtaggctgagtggattgcgttgactgagtggattgcgttgactgagtggattgcgttgactgagtggattgcgttgactgagtggattgcgttgactgagtggattgcgttgactgagtggattgcgcggactgcgttggccgcgacgccgccgatggtaattgcgttgccggagtcaatcgcgctgcctgcatccgaacgatctgctcgtacaccgaggcgaccgctccgccgatgatgacctgataacgattgccggttcgcgggaatgcgccgaggactccggggatggattcgagaccgtgctggctgacctggccggcgtcgtccagttcgaagtgcagtcgcgtggcgcaatgggtcaggttggtgatgttcgcggagccgccgacggcatcaacgatgcacgccgcaatcactgcaggcgttgcgttcgatgcgttcgccacggttcctccttgctgccgtatgccactgtgttccattatcggcgctgggtgccccaaaagcacggcaatgccggcaaagcatcgcgaaacggcaactatgcgctacggtgctccgcgatagcgttccgctatggtgttccgccgcacccgttctccgtatttgccgcagcgcccattccgacttcattccaccatgcagaatcctgcaatcgttgtcaaaaatcatcgttttttgccgcctattcggagtgtcgcgaccgagaaagtcgtatcctatctttcacacacgttgcgtagcagggttgttactcaaaatgaggcaagacctggagtgacgtggaatttgcgtatcgtaatatgcgaattccacgttgttccaggtctttttttgttttcgggcgacttcaggcaatcgaagcctgaccttgcatgcggcagaggggccacgcggcaggcgcggcccgtcaacggcgaaaggacaaggcaatgacgacgacaacggcatcacccgtatcgaagcagacggcatccgcggcacaggagaccggcgcaaccggtgcagcggccaccgcaatcgaaaccatcgaaaccggcgtggccggggtggcggacgcggccacaaacgcggcagcaaacgcaatcgaggacctcgaagccgccgaatcacgcggcttctccacgcgcttcccgctcaacagcgcattcatcttcaccttcggcgcgctcggcggcatgctgttcggtttcgacaccggcatcatctccggcgcctccccgcttatcgaatcagacttcggcctgagcgtctcccagaccggcttcatcacctcctcggtgctgatcggctcgtgcgcaggtgcgttgtcgatcggcgcactgtctgaccggttcggccgcaagaagctgctcatcgtctccgcgctgctgttcctgctcggctcaggcctgtgcgcctcctccaccggattcgcgatgatggtgtgcgcccgcatcatcctgggcctcgccgtcggcgcggcctccgccctgaccccggcgtacttggccgaactggcgccgaaggagcgtcgcggctcactgtccacgctcttccagctcatggtcaccttcggcattctgctggcctacgcctccaacctcggattcctgaaccacaacctcttcggcatccgcgactggcgctggatgctcggttcggcgctggtgccggccgccttgttgctgctcggcggcctgctgctgcccgaatccccgcgttatctggtgaacaagggcgacacccgcaacgccttcaaagtgcttacgctgattcgcaaggacgtggatcagacccaggtgcagattgagctggacgaaatcaaggccgtggccgcacaggacaccaagggtggcgtgcgcgaactgttccgtatcgctcgtccagcgctggtggccgccattggcatcatgctgttccagcagctcgtgggcatcaactcggtgatctacttcctgccgcaggtgttcatcaaaggcttcggcttccctgaaggcgacgcaatctgggtgtcggtgggcatcggcgtggtgaacttcgtgagcaccatcgtggccacgcttatcatggatcgtttcccgcgcaagggcgtgctgatcttcggttccatcgtgatgaccgtttcgctcgcagtgctcgccgtgatgaacttcgtgggcgacgtggccgtgctggccgtgccgacgatgattctcatcgctttctatatcctcggctttgcggtctcgtggggcccgatcgcctgggtgcttatcggcgagatcttcccgctgagcgtgcgcggcatcggctcctccttcggctcggcggcgaactggctgggcaacttcatcgtctcccagttcttcctcgtgctgctcgatgcgttcggcaacaatgtgggcggcccgttcgcgattttcggcgtgttttcggccctgtccatcccgttcgtgatgcgcttggtgcccgagaccaacggcaagtcgctggaggaaatcgaggaggaaatgaccaagcgctagacaaccggcacacgattcgcacaaaagttgacaactcttaacataatcgtacccaacgtggcgaaaaaacgtggcagaatagggagcatggtagcaaacaatgcgggtcagcccgccaccccagcagatctgatcaatgtcgatgaggttatcggcaaatactatgacctcgtccccgatcccgaagtccccgagcagcgtgtcatcttcggcacctccggccaccgcggatcgtccctgaagacctcgttcaacgaggcccacatcatcgccatctcccaggccatcgccgaataccgcaagaaggccggcgtcaccggcccgctgtacctcggctccgacacccacgcgctgtccggcccggccaagaagaccgccatcgaggtgctcgtcgccaacggcgtgcacgtgcgcgtcgattcccgtgacgacttcgtgcccaccccggtggtctcccaggccatcctgacccacaaccgtgcggccgacggcacccagcgcttcgagggcgagggcctcgccgacggcatcgtcgtcacgccgtcccacaacccgcccaccgacggtggcttcaagtacgaccccgtcaccggcggcccggctccggccgagaccaccaatgccatcgccgctcgcgccaacgagctgctcggcgacttcaagtccatcaagcgtgtgccctacgaggaggccatcaagtccgagtacgtcgagggcttcgacttccgcgagcactacgtggacgacctggagaacgtcatcgacttcgacgtgatccgcaactccggcgtgcgtctgggcatcgatccgctcggcggcgcttccgtgaactactggccgctcatcaacgagaagtacggcctgaacatcggcgtggtgcgtcctgaggtcgacccgacctggcgcttcatgaccatcgaccacgacggcaagatccgcatggacccgtcttccccgtacgccatgaagggcctggtcgacgagctcaacgccggcgcttgggacaagtacgatctggtcggcggcaccgacccggacgccgaccgtcacggcatcgtctgcccgaactggggcgtgatgaacccgaaccactacatcgccgtgtgcgtggagtacctgttcggcggcaaccgtccgggctggcctgagggcgcagccgtgggcaagacgctggtctcctcttccctgatcgaccgcgtggccgcatcgatcaacgcgaaggtcatcgaagtgccggtgggcttcaagtggttcgtggacccgctgttcagcggcgaagtcgccttcggcggcgaggagagctccggcatgagcttcctgcgcaaggacggccgcgtgtggaccaccgataaggatggtctgatccccgacctgctggccgccgagatcaccgccaagaccggcaagaacccggcccagcttcaccaggagcaggtcgagcgcttcggcgagtcttggtacaagcgcgtcgacaccccgaccacgctggagcagaaggccaagttcgccaagctgaccggtgatgatgtggccgccacgcagctggctggcgaagacatcaccgccaagctgaccgaggcaccgggcaaccacgccaagatcggcggtctgaaggtcaccaccaaggacaactggttcgccgcccgcccctccggcaccgagaacatctacaaggtgtacgccgagtctttcgtctcccccgaggctctggacaaggtgctcgacgaggccaccgtcgtggtagacaaggccctgagcgagtgaaatcgctgcgttagtcgcgttcaccgcaactaataaggctctgcattggattcatacaatccactgcagagcttttttagcgcatatgcagttcgcgaccactgaaacacgcaggtcaacggttctcctcatgcaccgtgactgcattttctcaacatcactgcagggcaggacggccagatgaccgcgaaacgttcgcctgcctaccatcatcattgtggggtcacagcggccagatgaccgccgaagcgttcggtcggcttgcatcatggtcgagttttaacatcgttgtgggacgccacgacgaatttgcccattccagagttgccatcccacaaaagcgtgggacaacagctaagtcaatcgttttacattttcccccatcccacacactcaaactggaaaccccggaaagacgccattcctgccacacccgtcacagccattacccgaggggccgtgggacgccacgcaaaaatcggcaaaacacgcgtagcgtcccacacccattggcgcaaatccacgcccaatgcaccgcccccccccaatcgaccactatgacacaggcgggttctagtgatcgttgcaacacctgacctaccgcaaggagggtcaggtgaccagaagccaccgaaacgaagaccgtggcggggaacaccgttggacgttcaacggcgtcgaatatccgacgaggaagctgatgtgcgaggcgagacgcgccgagtacgtgcgcctgctggacgaggaaggcatgaacttcacccaggccgcgcacgcggtcggcgtctcgaaacgcaccggcaaggcgtggcgcaacggcaggacgcgcgccacgggaaggaacgagaaacccctggtggactggtatcgttccaccatggacaaacccaagaccctccatccgcgctacctgagccaggaggagcgcatccagatcgcggaccgtctgcgtctgggcgattcgatccgcgccatcgcccgcctgctgggccgcgaccccggcacggtcagccgcgaggtcgagcgcaacaggaatcccgagtccggcggttacgagccttaccgcgcccagcagaaggccgcggaccggctcaaacgccccaaaccgcgcaaggcggccgagggcacgcgactgtgggacgagatcgccgccgggttgcgcaggcattggagcccggagcagatagccaaccggctgaggctggacttcccggataatggggatatgcacgcgagcgtcgagacgatctaccaggccatctacctgcaggccaggggcgaactcaagcaggagctgaaacgcgccatgaggcaggggcgaaccgcccgcagaccccaaggcggccaaggccgcaaaccccgtttccgcgaacccatggccatgatctcggagcgacccccggagatcgaggaccgggcggtcccgggccactgggagggcgatctcatcaccggcagccgcaacaaaagcgccatcggcacgctcgtcgagcgcaccaccaggttcacgatcctgctgcacctgcccgacgggcacgacgccgaacacgtccagcaggccatcatcgacaagatgcagcacctgcccaaactcctgcgcaacagcctgacctgggaccagggagcggaactcgccctgcacaaacggatcggcgcctcgctggacatggccgtctacttctgcgacccgcactccccgtggcagcgcggcaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaaaccaagcgagaagatcatcgaactgctcgacgccgcgtgataacctcaacaaccgacaacgtgaccatggaaggccgctcaaacctcaggtgttgcaaccaccactagaatctgccacatttccctccacaatcgaacactagtcattcacgaaatccatcactacgaggcatcgcaatcgaacggcatgcaatatcaagcacacaccacaacaacaggtcgtacaaatattgcctttacatcagtccatttcggacattatggtcacagcaggctctgcgacaactcttcaagagacatggcaactacatgaaactcgaatacggcaccgcgcgaagcaagcgccctcgccacgttgaaagcgaattcagcacgagcgtcctcgttagcgatacttgccgccgtggcgacgaagaccagccatctccgcccgaccagcacaccccttttctcttggtcacggcgccattgagccttactcgtacgatgatgatggccatcatattcaacagcgaccttgaactctggccacgctaagtccaacgttatgggagctccagatgcaaaagccgcatccggcaccacatagttcgcaaccggctgtggaatcccatgcgctaccagagagagtcgttcttctgattctttgggcgaatcagcaccaggtgatatcagcggcaatgctcgaacgcaggacgggcgccctctgaatcgggtaaatcgctccacgaacttcaccagatcctgatagattgcagcagcatcacgatccttggccaatactggctgtttgctcgtagcagcgatgacggcatccccgagcacaatcagggactcaaaagaaacatacggggcaagttgggcccatacgtgaaacaggtccagcgcaaacacgtgttggttcatttccacattggcggctttagccgcatgtttccaaatatgcgtttgcagtggtgcatggcgtgtacgaaaccgcttgctcttaacgctggatacagtgtgcagcttggccgagtcgaggtcgcaatcggcgggaatcggtacggattgcagagcgagggaagtggtcatgccgaaaagcagcttcttgcccgcccgtttcgcttcctcagtgcagcgtgcgaccatgtcgcgtctgcgctgggcgaggctttcgctcatggtcggtgtcgctgcagaatcatgtgcaccactgttcggcgatgacgagtcgcgagaagtcgggtatttcgagtcagtagaaaatgaccccgcaaattcaggcggaacaaaaaccgcctccgattcttccggaggctgatcgtatatagagcctggcagagctccatagttggtgatgccgtcggtcatcctgttcatgacaccaccatatgggtagtgggtgcggaaacggaagccgatccgaggtatgtggtcctagcttcacttacgcacattcattgtggataaccatgtggacacctcacttatacacatagtcatccacctcttcaaccccgatttgacacactaactgtatctgatatgattacagtatcataactgtacacatcatagttacagtatcgactcggtaaggaggtcgtttcatgaacggcgaccattcactggcagtgcacgcattggtctaccttgaccatcgcgccacacacctgcccagtcagatcctggccgagaacatatgtaccaatgcggcgcgcgtgcgcaaagtaatgcgaccgctcgcctcagccggactcatcgccactaaagagggtgctgaaggcgggtacgctctggcccggcccgccgccgaaatcactttgcgcgcggtagcggaagccaccggcaccacttttgtgaaagtgaactggacaccgggcgacgtacacgaggactgtctggtgtcatcttcaatgggcgcagtgatgaacgacatctatgccgggctcaaccgcacttgcctcgaacaactcgaacacaccaccatccacgacatcaccgaacagatattcagcgagcgcaaaggctaataatcccgcgcgtttcccctagccagcatcagtcgataacgcttcggcagtcaaagaagaaaacagacgccgcacggcacacaacacatcagcacaacgcactcttatcactcgaatacgtaaggaagtaaccatgtccatcagcacacccaatgccatcagcacacccagcacctcccccactatcaccaccgacgccctgatcattggattcggcaagggcggcaaaaccttggctgccaagctcagtgcagccggccgcaaggtcgtcgtcgccgaggcaagcgccgacatgtacggcggcacctgcatcaatatcggatgcttgccgtccaagtcactgattttgtccgccgaacaggcgcggcgggatggcgcgaacagtactcccgaaacccgcgaagcagcgttcgaggctgctatcaaggagaagcgccgcgtcacttcgatgctgcgcgacaagaactatcacaagctcgccgaccaagacaacatcaccgtaatcaccggccgcgctcacttcaccggccctcatagcgtggaaatcgccaccgctgagggcccggtcgccgtgaccgccagcaagatcttcatcaataccggtgccacgccgcgcattccggatattcccggtatccacactacgcccggcgtctacaccagcactggactgatggatctcgacgatatgccgcagcgactggtgattatcggttcaggattcattggacttgagtttgcctcgatgtttgccgatttcggcacggcggttaccgtgctgcagcacaatgccgagttcctgccgcgcgaggatgcggatgtggcggccgcgattcgcgcacagttggaagcgcagggcgtcaagttcctgttcaacgcggataccaaggccatcgcgcctgctgctgacggcggcgtcaggttgtccgttgcggtgaagggtatgactcgcggcgcatcgcaagcttgcgattccacccccgccggcaccgggaacgctcataccgatatcaccggcgccaccgacactacaacaaccaccagccccactagcaacccgaccgatcacgccacgatgtcacacgttcaaacgaaaccatcagacgatggcgagccgcggttcgccgagccggctgaagcccgattctgcctgaccaccgacgcggtactggtggccaccggacgtacgccgaacgtcgagggactgcatcttgaggcagctggcgtggagctcaccgaacgcggtgccgtgaaagtcgacgagcttctgcgcaccacagcagccgacatttgggctctgggcgatgtgaacggcggcccgcagcacacgtacatttcgctggatgactatcgcgtggtgtggtcgcagctcaatggttccgaccgtccgtacacggtgaaggaccgcaagcatgtgccgtcgagcacattcctcgccacgccttactcgcgcgtgggattgaatgagcgcgaggcgaaggcggctggattggattatgtggtcaagcgattgccggtggccgctgtgccgaaggcccaggtaatgcggcgaccggatggtctgatgaaggcgattgtggaacgcaatactggccgcattctgggtgcgatgctgctttccgtcgagtcgcacgaggtgatcaatatcgtcaagttggcgatggatcttgacgcgccggccagcacgttgcgcgatatggtgttcacgcatccgacgattgccgaggcactgaacgacttgttcgcgtagtttgttcgcatagcacgcccgcgcagcatgacccgcgtagcgcagcccgcaacagactcccctaatgcgcgcgaaggtcctcatcgacgtaaaccgatgaggaccttcgcgctgtcgtcatgatccgtacgtgacagcaatcacgtccgaaccagccgttacttcaagccgagcttacggtccagaatgtcggaggcatccaatcctaagcggcgtcggatgaaccagccaagaccgagcggcaggccgggagccaaggccatgccgcctggaccgagtgccacggttttggagttgcctgcgataagcatggtgcccttggatgcggccgtggaggtcgaaccatcgctgtccgcctctggtttgaggatttcgatgttgccgtcactggttttgtacagtcccttattctcattccagataccggatgcgccattgttgccggcctcacccgcagagaggaaatgtcttgtttttcttgtgagcgctcacctattcacgcgcgatggcatgtttttcaagcaaagtcaataggtgtgatgttattcacactcttcactacgttgttttgcctcgcactgggcaaccccacttcagcaagagattgcacagcttgcgttagggtggagaacatgactatcacagtatccacagatgggtccgcattagggaatccaaacgggccaatgggctgggcctgggccgatcatgagcagaacgccggcggcaagcccggccataagcacgacgaccatggttatgatgcgggcggcgcgaccaacggcaccaatcagattggtgagctgtgcgcagtgctggaagctttgcgagcgcacccgggccctgagccattgctcatcgaatcggattcgcagtacgccatcaattgctcgaccaagtgggtcaaaggctggaagaagaacggctggaaaaattcgcagaaaaagcctgtgaagaacaaagagcttattcaggcgatcgaccgtgagatctcacaacgccctggcccggtggatttccgatgggtcaaaggtcacgccggcaacgagggcaatgagttggtcgatgaactggcacgcacctatgcgggcgattgccgttcgggtgcgcgcgacggctatctaccgattgaaggctggcagtcgctgctgggctccgaatacgcacatggcaccgatgtgcctccagacgtgcaattggtattggacggcaaagcggatgcggcaagtttgcgcaagccggctgcggcgacggatcagacggatgccgcaaggccggagaccaagtcttcgtcacccttagcggcacaatcaacgcaacctgtacaatcaacgcaacctgtacaatcaacgcaacctgtacaatcaacgcaacctgtacccccgcaaagcccagcgggctgacggtatccggtacgctgaccttctcccccgcgccgaaaacgagcccgtatttcaacgggcagccgatgccgatcaaaggcagcatcgaaatcgaaggctatgtggacggcgacggcaacctgaccatcaccaacgcaccattcgtacgacactgacacccaaacacacgaatatgtaccgcaatcggacacgatgacacaaaatcgctcattcgcgttaggataggagataaggcttcacgccgttgatccatgcggcggaggcaaggatggcaaaggagaaaccatggataaggcacagcaggatgcgctgaagaaggcggccggcatcgaagccgccaagctcgttgaaaacggcatgatcgcaggcctcggcactggttcgaccgtgaagttcctggtggacgagctcggccgccgtcatcaggaggaaggtcttgagttcactggcgtgaccacgtctcgccgcacgcaggcccaggccgagagctacggcatcaagatcgtggacatcgacgacgtggaccacatcgacgtgaccattgacggcgccgacgaagtcgacaagaacttcaacggcatcaagggcggcggcgctgctctgctgtgggagaagatcgtggccaccaactccaaccagatcgtgtggatcgtggacgagtccaaggttgtggacaccatcggcaagttcccgctgccggtcgaggtcattccgttcggtgccggccaagtcatcaagaagttcgaggcccgcggctacaagccggtgcttcgtcttgacgccgacggcaaggaagtgcgcaccgacgagaacaacttcgtggtggacctgcacctggagcgcatcgatcacccgcaggagctggccgaagacctcatcaacacggtcggcgtggtggagcacggcctgttcctcaacatggtcgacaaggtcatcgtcggcgacccgaacggcccgcgcgtgatgaccaacgccaacaagtgatcgtctcacaccactaagcttttccaagcccgcatctgcacatcgcaggtgcgggctttactgttgcccgaacaaggcaaagagccaagcaaaagagaaaccccgcgaccataacgatcacggggtttctaatgccttgattgcaggtaagactacttacgctggtggcgggtcttacgcagcagtttgcggtgcttcttcttgctcatccgcttgcggcgcttcttgatgacagaacccatctgaagcctccatttcgattaatcgtaaaagttgcaactcgcaccataatacacgtgttgccagacagaggaaaccagtatgttgtcgatagtccgcatatgccctgaacgcagttggggcatccacatcagcaatgtggatgccccaacgttcataagtttgtgcagcagctgacagccgatactagatactacatcgggaacttctggtagaagcgatcgaccgcttccttggtgccggtagcttggaagaccacggtatcgttctgccagatggcaacggcgttcttgctgttggaggcatcggccttcaccacgtacgcgcccgtgacgttgccggaaaccttgacgttgccggatgccgactcatcgccggtctgcgcagcgaccaacgcatcgtactgggtcttggcattgtccgccgacgaccactgcgcggcgaccagcgtgacatccttggcggcatcaccagtggagtaggtcagagtgtactcctcgagcggcgacgcggaattccacgtcgtggaggcatccgccttggtacgcgcgtaattcagcacgctgcccggcatggccttcaacagctcactggcatcatccggcaaagctgtggcgtcgatggtcggcttggtcggctcggatgattcggttttctgctggctgttttgggtggtagtggaggtgccatcattcttctggatggcccaacccggccacacaaaggccgaaagcactgccaggataatcacaacagctgcggcaaccaccactgcaatcaacttgccatgggattgcgtggtcgaggagttctcactattagtcatgccccgattctctcacagccgcgtgacgctaggcggccgtaattttagtcgttgtgcgcaagccgcgtgaaactcttgtgaacggtaaaaatttaccgtccgctggtgtttgggttagggtgagaccatggcgaaatcaagtgtgcagtatgtatgttccgaatgcggttggaacgggccgaagtggtacggccgttgccccgagtgtggtcagtggggcacggtcgaggaatttcacgaggctcggccggcggcaggctctcgcacggccgctcccggccgaacatcacgcacgcagtcggttacggttgccaacaacgccagatctgcagcccgtccgattaccgaagtgggcacggaaagcgtcgagcggctcggtaccgggttttccgaattcgaccgtgtgctcggcggtggcgtggtgccgggttcagtaacgctgatagcgggcgaaccgggtatcggcaagtcgacattgctgttgcagacggccggcaatatcgcgcgcgttgtggcgggagacagtacgttccgaggggcaggtcagcggtctgcccaacagtcgggccgggcgcagggcaacgcatcgaacacggtgccgatgcggggcaacgcatcatcaacacacgccaacaccgtgctgtacatttccggcgaggaatcacaggcgcaggttcgtttgcgcgcttcccgcatcaatgcggtggagccgaacttgttactggcctccaccaccgacctgtccacagtattggggctgatcgaacagaacaagccggccttggccattgtggattcggcgcagaccatcgtctcgcaggaggtcgatggcatttccggcggttcgactcaggtgcgcgaagtggcaagcgcgctgatagataccgctaagacacttgacattccagtatttctggttggtcatgtgaccaaggatggttcgattgcaggcccgcgcacattggagcatctggtcgatgtggtctgccaattcgaaggcgacagcgagactgcgctgagaatgctgcgagcggtgaagaatcgttttggcccgaccgatgaagtcggctgtttcgacatgagcggtgaaggcatcgaagaggtcaccgatcccgccggattgttcctgtctggagacggccctgatgcggccaacgcggcacccgtggaaggcacctgcgtgacgttcacattggatgggcatcgcagtctgcctatcgaagtacaggctctggtcaccacgtcggtgctgcccacaccccgtcgtgcggtcaatggcgtggaccccagccgtatcgccatgctggtcgcggtgctctaccgtcacagcaagctcaacctgctgtccaacgacctgtatatctccactattgccgggggccaggccaaggagcccggttccgacttggcgatagtggcggcactggcgagcgccgccacgtcaaaacccattgcgcgagccacgtgcgccattggtgagatttccctgaccggtcaggtgcgcccggtaccgcgtatggaatatcgccttcgcgaggccgcacgcctcggcttcaccacggcggtcattccgccactgcgcaagccggtgcatgtcgagggacttcagctggtggagtccaacacattgtccgacgcattagacgccttgggagtgcgtaaatagccctgagatatgcctcaggcggtaagacgcttggtctcctcgacgttgcgcttgagttcgtcgacgagttggtcggggccatcaaacttgacctgcgggcgcaggaagccgacgaattcgacgcgaaccttgtggtcgtacaggtcgatccattcttcagtgatgcagtaggcctccaccacacgttcgttgagccctgttttctcgctgaaggtgggtttggtgccaatggagatggcggcgggccaacggttttcaccatctaccagccaaccggcatagacgccgtcgaccggaatgtagcctgcaatgtcggagccaagattggcggtggggaatccgatggtgcggccacgctcctcaccgtgcaccacttcgccctcgatggagtgcggagcacccagaatggcgttggcgtcctggattcggccatgagccagcaggtagcgcacattggtggagctccatgcgcgcattgccttggcctggttcttcttgctccatgcgcggcgctcggccttggtggcattggccagcgggtcgacgggctctccccattcgctcggggcttccggcttgaaatcgcgcggaatacgcacttcacccgggccacggtcatcgaccacatcaagttcgaatacaccggtggcggcggcaagattggcgatatgcttcacatcaccttctcgacccttgcccatggcggcatcctgcccaaggaccaacgtgcgcatacccagcttgccggtgagtcggccaaggaagaaaatgtatgacatagctgcgaaggccagcgtgtagtgcaccaccagcacgtggtccacgccgaactgttccatgcggtgcagtcgatcatccacactggtcaaggcttcggcatccacgttctgcaccgcgggttcttcgccatggtgcgagatgacccagccgtgcacgaatgcggggcgcggatcaaacagaatcaccacggaaaaagcatcatgctggtgcgcgagttccaccacacgcttgatcaccgcctgatgacccaagtgcatgccatcaaatgcgcccaatgtcaccacggccttcttatcgttactgaacgagggccattcaatcgaaccttcggcgtcaggggtcaggtgcgtgatatccatcagtgtgctgttccttttatccgtgcgatgttattcatgcaatatagacgttgttgtgcgcggcctgtatcaagctgcacttttcaccgcgtctactttacgcgagggggaatacggtgaccggcttggcctgatgagcgtttgcacgctcgataatcgccgccacatcatgcgtttgcggcacaatggcggcagtgggctcgctgattgtacgctcaatacggcggccgaagcgtaattcgctggcctcctcaggagtgatgtcaagcgccggcatcgcacctcgagcggcctgttccatggtaagggcatggtcaagcagccagttgcggcgctcgtcaccggcaagaccttcaggagtgtccaatacgcacttgttgcgcgtgacggtttgcccttcccgattagtgaacgtcttctgatcggtatgtgcggtgacggtatgggttcgcgtgtcaagcatcgcctcaggagcgataagtccgctggcatcgtccggcaacgcgaatcggccgactcgcgtacggcgcaaacgggtcaggtatccgccgacgccaagttctttgccgagatcgcgggcgagcgcgcggatataggtgcccgatgaacagctgatccgcacgtcaacatcaagtgcgggaatcgctcccgtgttcgcgtcttcccgcaatggttcagcggcctgctcccctgctacgaatccgctgcggatatccagcacggtgaattcgctgatggtgaccgggcggggtttgagttccacatccttgccttcgcgagccaagtcgtaggcacgctggccgttgattttgatggcggagaacgtattggggacttgttcgatatcgccggtgaaattggtggcgatggtgcgtgtgagcaggtcttgccatgaggcagttggtaacgccgttggttcgccgctctggccaccctcagtcagctgcgctgatagcgtttgccagcgggagcgggcttcgtcatcgacaagcacctcgccttcggcatcgtcggtagtggtgcgcaggccgaggcgtatggtagcctcgtaggttttgtcatgcgccacgatggcgttgagcagtcgtgtggcgtggccgaaggcgatgaccagcgtgccagtggccatggggtcaagggtgccggcgtgaccgaccttcttgatgtgcaacgcgccgcgcacggcggcgacggcgtcgaaactggtcacgccttgcggcttgtcgatgatgagcagaccgctgggggttgtatgaagcacactactcctcgtcagagtcgtcttcgaagtcgtcgctgggctcgtcgtcatgcttgtacggatcggcgtcgccggcgtactgggcggtggcgcgagcacgggcgagttcttcgtcacgcttcttggccacggcgagaatgtcttcgatctcgtgagcctcgccgggcacttcatcgaacacgaattggagctgcggagtcagacgcaggccagccttgtggcccaccagagaacgcaggtggcccttggcctgatcgagtgcctgctgggcgcgcttgcgttcgccttcctcgtggccttcgtggccgagctgggtccagtagaccttggcgatctgcaaatcgttggtcacacgaacttcggtgacggtgatgctggcgagtcgcttgtcatgcagttcgcgctcaatggaggaggcgacgacacgctgaatcaaggccgcaatacgtgcggcgcgcgggttggttcctgccataggaatttccttttctagacttgagccccctctgacgaggggctgccgaacgcagtgaggctggggagagaaaatcatggaactaccatgtctctcccccagtcagtctgcggctgacagccccctcgtcagagggggcttaacaatgactacttgcgctcgacttcccgcatctcgaaggtctcgatgatgtcgccgagttcaatgtcgttgaaggtgccgaggttgataccagcctcgtagccttccttgacggactgaacgtcgtccttgaagcgacgcagcgaggagatctcgaggtcgttgaccgtggccacgccgttgcgcaggatacggcacttcgtaccacgcttgacctcgccgtcctgcaccataacgccggcgatgttgccgaacttggaggagcggaagatctcgcggatctcggagtgagaggtgacgacctcttcgtattccggcttgagcatgcccttgagggatgcctcgatgtcttcgatcgcacggtagatgaccgagtagtacttgatctccacgccctcgcgctcggcgaggtccgcgacctgacggttcggacgcacgttgaaaccgatgataacggccttgtcgaccgtggccaggttgacatcattctgggtgatcgcaccgacgccgcggtggatgacctggatgccgacctcgtcggatacctcgatcttcatcaaggaatcctcgagcgcctcgacagaaccggacgaatcgcccttgatgacaatattgagcatgtcgatctcggactcggcgaacttcttcttgaagtcctcgagggagacgaccttgcgacgcttggccagctgggcggcacgctcggtggcctgacgcttctcggcaatctggcgagcggcacgatcatcggaggcgaccaggaagaggtcaccggcggtgggcacggaggtcaagcccagcacctgaacaggtgtggacggaccggccgcttccatcggctgaccgttctcgtcgagcatggcacgcacgcggccgtacgaagtgccggccacgatggcatcgcccacgtggagcgtaccctgctgaaccagcacagtggccacggcaccacgacccttgtcgagtcgggcttcgacggtggcaccacgggcgtccatgtcggggttggcgcggaggtccagctcagcgtcagccgtgagcagcacggcttcgagcagcttgtcgacgtgcaggttctgcttggcggagatgtcgacgaacatggtgtcgccaccatactcttcagggaccaagccgaactcggtgagctggccgcggaccttctccgggttggcaccgggcacatcgatcttgttgacggccacgacgatcggcaccttggcggcctgagcgtggttgatggcctcaacggtctggggcatcacaccatcgtcggcggcgaccacgaggatcgcgacgtcagtgagctcggcaccacgggcacgcatggcggtgaacgcctcgtggccaggggtatcgaggaaggtgatcttgcgcggttcgccttcaaggttcacggtgacctggtaggcaccgatgcgctgggtaatgccgccggcctcacgtgcgatgacgttggtcttgcggatggtatccagcagtcgtgtcttaccgtggtcgacgtggcccatgacggtaacgaccggcgggcgaggcttgagatcctcgtcatcctgcagttcttcctcgtcaaggttgatgtcgaactgctggagcagttccttgtcttcctcttctgcggagacgagctggatgttccagccgatctcttcgcccagaatctggaaggtctcctcatccaaggactgggtggcggtagccatctgacccaggtggaagagcacggtgaccagcgcggcctggttgacgttgatcttctccgcaagatcggccagggacgcgccctgacgcagacggatggtctggccgttgccgttggggatgcgaacgccgccgatggtcggtgctttcagctcctcatactcatggcgctttgccagacggttcttacgggcctttgaagacttgccgccctgacgtccgaatgcgcctgcggcaccgccgcgaccgccgcgaccgccgccacgtgcgggaccgttgctcggtgcaccgccgccctggaagttattgccgccgccttggcccccacggaagccgccgcgtgcgccgccctgaccggcaccctgggagccgccgccctgacccggacggttgtggccccactggccgggacgcggaccgccctgaccaccttggcccggacgaccgccacggaagccgcggccctgcccctggccttggccgggacggcccggacgaccgccacgaccgttatcagcagtcggacgagccatcggatgcggacgcggaatatcacccggcgtcggggtgtgcataccctgcttgcgggagaacgggttgttgcccgggcgcgggccctgagcgtgcgggcgcggaatcgcatttgaagcggcattgccgccattggcaccggcgccgccctgagcgtgcgggcgcggagccgaagcattgccgcggttgttctgatgctgaaccggctggccattgttcggacggccctggttgttacgacgatcgttgttacggcgatcgttcgggcgactctgacgaccgttctcacggccttcgcgattatcgcgaccattctcacggttgtcgttctgaccgtggcggccgggggtcggcatgccggggcgtgcgccgccctgcggacgcggtgtcggtgcacccggagtcggagcctgctgatgtgccgaggcaggcgatgcctgacgtgcgggagcggccggagtcggtgcggaagatgaagtggaagccggggccgaaggtgcggccgggcggcgctgctgcacgggcttggaatcgcccttggcgttgtccttggcgaactctgccttcagacgccgggctaccggcggttcaatcgtagaagaagcggacttgacgaattctcccatgtccttaagcttctcaagcacggttttgctatcgacattcaaaaccttagccagttcgtatacgcgtggtttcgccactaattactcctattctgtgaccacgcgcgtgcatgggcgtggtcagttggtgatgacggcaagcctaccctgtctcatcgtgcgaccatgatcgtgttacctcgtctctggtgtgggcgatttcgcgcacactgcgccagcccacatacgccaatcaagcatactcatagcgctggatagcgtagacgcagcgagccgcgccattgctgacgcggctcgtatcaggaaataatgcgccctgaagatcattcgccttcgagcccggcggcctattcggcttccggagcagcagcctcggccgcagcctgggcggccttttcggcggcgactttcttggcatgggcctcggcggattcgatgccgatcttccagccggtcagcttggctgccagtcgtgcgttctggccttccttgccgatggccaaggacagctggtcgtcgtggatgaaggcgatggcggtcttgttcttctcgctgatcacctgcacgccggtggccacagccggggacagcgcggctgccacgaacttggccggatcgtcggagtagtcgacgatgtcgatcttctccgggccaaggttctccataacggcacgcacgcgagcgccgccggggccgatcagcgcgcccttcgggttcacgccatcggtgttggccttgaccgcgatcttggtgcgggcgccggcctcacgagcgatggccatgatggacacggcaccggagaccagttccggcacttcgcgctcgaacagcttgcggaccagctccgggtgggagcgggacaccacgatttccgggcccttgatgccacgggccacgttcaccacgtacacgcggatgcgttcgccgtggcggtaacgttcgccgggcacctgctcacggcgaggcagaatggcttcgacatcgcccatcgcgacatgcacgttggaggggtcggaagcatcctgctggatgatgccggtgatgagcttgcccttctggccggagaacgcaccgaataccttctcatcttcggcgcggcggaacagctgggtgatgacctggcgtgcggtggctgcggcgagacggccgaagtcacgcggggtgtcatcgtattcctcgcccagcttgggaacggggtaagggttgtcttcggtgggttcgaccggaatttcgtcggcggcccacacggtgaagttgccggaacgttcgtcaagctccacgcgcgcgtgcttggcggcgtgcggggtcttgaggtaggcgaggcgcagggcctctgccagcgcatcatccagggtttcggggtcgattccttgctcggcggcgagcttgtgtattcctgtcaggtccagttccatcgatccgtacctcctatgaagttatgtggcgcatggcctatgagtagtcacagttagctattagtgtatgtttccatgcagacacgcttctcttcaggacggtttacccggcgcttggcatccgtactatgcgcgagcgcgatgctgtgttcgctttcggcgtgttcgatgccgcgactggccggacgggccgaggcggaagctcaaatgaccccttgcgagaaagcgatgacgttggcgaactacgccacccatccggctgaaggcacaccgttattagagcagtatgccaccggtctggccgccccctggcttggattgacgttgccgggtattgttcgggtcgttttgccgagggaacgttacgtgacgcgcagaccaagcaatggatggcttttctggccgataaattcgggcagtccgcgcctgaggtgacgccggcgcgtcttgatggcgtcacgtccgccaacgttgaccgatcggtattggatgcgatggccgtggccgaggatcgcgccggattcgctatcgaggtcttggccgcacgaggacagaccgctggggctacgttggcgttgagtgatatgcataagaccgccgggcagcagttggttgcgctggcgaacggcaattttgatgattccggcgcacaatccagttcttccggccaaagcgacccccgccaaaaggtctatgccatcgaccaactactggccaaccccaccaccatcgccgacaaggcaagtggccaaaccgtaccgaccgccgccgccatcgaaatggactgcgcccgcgcgcagatcaaggccgtgaccgaatcgaaatcttccaccgagagcgatatgctgctcatcctcgccgcactggccgccaagcacgcctacaccgcgttccaacttggctacccagcgactgacgccgaattgttcgagtagacacacactcctcacgaagccgatgcgaacttgttggatgctagtgggcaagtcgagttgaggcacgttccaccaatgtgaaatcggtggtgtacgtacgggccgggcctgagtatccttcgatgcggtcgataagcatgtcaacggcatgcttggcataatcatcgatatgaggatcgatggtggtcagcgccggcaccgagtactcggcttccggcacgttatcgaagccgaccacttgtacatcgtcaggtacatgcaaaccacatcgttgcaattcatgaattgcgcctaaagcaatggcatcattgagacacactacaacatccgggcatgggagcttgtctagcatagcttttgtcacgcgcataccttcacgctgattcatgctttctgccggaatcacataccgccaatttaccgataatccgcgctcttcaaatgccttcacatatccttgggcgcgtaacgcctgggtcccttccgtctgacgacgcagcactgcctcatccaccagttcaggaagaacacccatcagagcaaccgtttgggcaccttcatccaaaaatcttcctacaaccgtggagatggattcaatgttgggcatggtgatccaatcgcttttcccgtaggccagatggtctccggtcgttacaatcggatatggctgctccagaacggccccttcatccgcgagcggcgacattacgaacagaatccatccttccgtccctaaacgatagaactcgtcaacgctggcaaccaacccttcaccgtcggaaccatatgtgttgatgactacaccgtaatggcgttcttttgcgtattcaatgaccttgtcagtgaaaaaaggaacgaacggctgcgagaaatcgaagatgttgagtccaataagctttgtgccgccagatcgcattgcacgcgccgaaatattgacggtatatccaagcttacgcatcacctcttccacacggcgacgtgtatccggtctcatactgccagtgtcattcagcacattggaaaccgtcttgatggagacgttcgcctcacgcgccacgtccttgatagttacgcggtttcccattgttcgaatccatttctgcttattacatgacacaccttcaacagcgtcattatgttcttattatggtaagtcacagtcgggtcgagcatctcctcctcatatcggaatcatctacccctcaacctcagaattcagccaaggagctttcctccgttggaccccatgcaccattaggcaaatatccttctgacaatactgcaggacgatcgaacgtagaggttaaactttctggttgaagaaacgcacgcacgccatccgaacaagggactttctgaccgccggctttcaacctagctttttacatacccgtcttttctccttattcctttgttgggtatcgaattgttccagtcgatgtgaatgacggcattgtcttcctttgactggtatgccacattacattagtggcgaatccgaacctctctttctgcaatccgggcatgttgatgattgtttgggtattgcttggtggttgtacagggcacagcaaccataagagactgcgccctgtcatgcgccaccgtcactcgaatcacttcacgtgcacggcggtccaggagaccggcggcaaggtcacacgcacagtgccggtatcggcgtcggacgtgatggtggtgttggggtgcagaacgactcggttctggtcttccagcgtgttttttgccagcagatcatcctcgtgcagggtttgcgcctcgaccgcggaaagtgcgaatccttccggcagcttgatggcaaagtcattggccgcttccatggagcgattgaccacaaacacgctgatcgtaccgtcctcaccacgcacggctacggaattgatcgtcggcacttcaccgtatttgtcggtttcatacgttccggaagccagtttcggttcaagcaccgtgccgcccttggcgagctttgcggtcagcgagaacggatagaacgtggtctgacgccacgccgggccgcccggttcggtcataatcggcgcaattacgttgaccaactgggccaggctggcggcgtgcacgcggtcggcgttcttgagcagggtaatcatcaaatcaccgaacaccacggcgtcggcggcgctgtacacatcctcgagcaggcgcggggcaaccggccaattgccgatgccttccggattcttgctcggctcttcgttgagataccagacattccattcatcgaacgagatgaacacgtcgtgcttgctcttcagccgggccttggttgcatcgatggcggcggcgacatcgttgatgaaaccgtccatatcgacgcccgaggcaaggaagctcttcatgtcacgggtgccatcaggctgaagttccggatggtagtacgcatggcaggagacgaagttgacgttgtcaaacgtcttctcaagtacggtttcttcccacttgccgaaggtgtccatcacgtggctggatgaaccacagaccaccagttcaacgttcggatcgatggcgcgcatacctgccgccaccgaggccgccaaggtgccgtaatcctcggcggacttgtgaccggtctgccacgggccatccatctcattgcccaagcaccacatcttgatgccgaacggctgatcggcaccattggcgcgacgctcctcggagagcttggtgccgccgggaatattcgcgtattccaacaggtcgagggcctcttcaagaccacgggtacccagatttacggcttccatcagctcgttgccgccggttttttccagccatttcgccatttcgtgcagaccaaactgattggtctcggtggaatgccatgccaagtccaggcgacgcggccgctcatcacgaggaccaacgccatcctcccagcgatagccggaaacgaaattgccgccaggatagcgaatcgtggtagcgccgagttccttgaccagttcgatgacgtccttgcggaaaccgtcttcatcggcttcggggtggcccggctcatagatgccgtcgtatacgcagcgacccagatgctccacgaacgacccgaacagtctgtcgttgaccggagctacttcaaagtcattatcgacgacgagtcgagattcctccagctcccccggtttattgtcgtgcgaatgctcggacatgtgctctcctttaatcgttgtcttcaataccgcaagacaacgttgtgctaaataccaaaagcaatcggcccatcttcttggttcacctgttttgcggcatcgccaatcagcggtgaatgtgcgttctggatatttaatacaaccttgtacttctgttgatatcgataatacgatggttgtacttagtacgcaagtcccgctgagtacaacgttatccttttcgctattttccacccgacacgccgtatacgatacagcacaggagcgaatacggacgttcgtatcaaaaacaaaaagggttccgggacaaacccggaaccctaaaggcggataaggcgagattcgaactcgcggaggctttcacctcacacgctttcgaggcgtgctccttagaccgctcggacacttatccatgctgccaaaatggcaacttgttcattatgccacattctgccgacctggcaaatcggagtttcgctgagctcgattcggcgtgggataatgcgattttgtgtgagattgcaatgggtcagacgatgagccgattaacagtccgaattgatcaactaccaaaatccgaatgttgcaacgacgaaaatccgaatattggtggtggtagaagcggtgacggggccactctgcattgagtggtctctccctcggtcagccttacggctgacagctcgaacgcaattaaggacagctttccagctgccattttatttgctcactgtcgttcgccttcgcctaaaaacgcctccggcgttttcttcacggctcagctcatcagagggggcttggaattttatttatgccacctgttcgtggacggaggcgttgacccattgggactgctggacgttgtatccagagaagatgccgatgtcgagcatgcagtcgcggtaatcgcggccgtgggcgatggtgatgtagctgtcgtccaccaatcggttatgcgtgggatccagtccgacccatcggccatcctgatacacctcgacccaagcatgggtcgcgccctctccccaagcaaaccggcaatgtagcgcgcggtcaatccacatgccggcacacggacagcatcacgtgcgcataatcctggcatacgcccttgcgctgagccaaggcctgttcggcggtggtgcgaatcgtggtggaaccgggcgtatacacaaacgccttgtagacctcatccatcacttcggcagcctgctgcaccggagtggcgtcggaaggcagcgccgccaagcgttcgcggcatacggcaatcatcgcctccacgttcgggccgggaatggtgagcgctgaattgaatcggtacagcggttataggcttccttatggatatgcgcattgtcccgaaggcgataccggtcaccgagtagctgaatatgtcgtgcggctcagggatgaatccggtcataccacggagtcaaaggagtcgatggtggtttcgagttcggtttcgggctgaatcttcactccacgtcaatcacctgttggcgagggccagtggagggaatacagcgaagctggaacctgtgatcggtgaccggtgcgctgaaggacagcctcatctcatagtcgaacacgagttttttcacaacgtctcctgcacttgcacacgagccggcaaccggcatattctcgggataacgacactacagccatggctgaggtatggtccgtgcgctcacagcccacgcatatattccggcaatctgctgatatgcacaggccggcactcggggcacggttttttcgccataccaccatagcatttgaaccgtcagggtgtcaggtcgggatcagggacgcttggcgtccatgttcatggagctcagtgagcccatgtctttgatggccagcgcgctgacacggccggagtagtcgtcaaggtacttcttcagcaggtcggcgacttcctgatatccgcgagacggcagctgaccgaccagccagctcagtccgtcggcgaagcagctgggcagcggcatgccgtccaaggtcatcgaataggcggcgagcttcttgagcggcgcttccagatctccatcgtcagg
